US011220694B1

(12) United States Patent
Čermák et al.

(10) Patent No.: US 11,220,694 B1
(45) Date of Patent: Jan. 11, 2022

(54) RICE CELLS AND RICE PLANTS

(71) Applicant: Inari Agriculture, Inc., Cambridge, MA (US)

(72) Inventors: Tomáš Čermák, Brookline, MA (US); Richard Bailey Flavell, Malibu, CA (US); Eva Konecna, Brookline, MA (US); Yajie Niu, Lexington, MA (US); Michael Lee Nuccio, Salem, NH (US); Jennifer A. Raji, Waltham, MA (US); Randall William Shultz, Acton, MA (US); Davide Sosso, Cambridge, MA (US); Maria Margarita D. Unson, Pawcatuck, CT (US); Barry Andrew Martin, Boston, MA (US); John Patrick Casey, Jr., Boston, MA (US); Michael Andreas Kock, Rheinfelden (DE)

(73) Assignee: Inari Agriculture, Inc., Cambridge, MA (US)

( * ) Notice: Subject to any disclaimer, the term of this patent is extended or adjusted under 35 U.S.C. 154(b) by 9 days.

(21) Appl. No.: 16/261,219

(22) Filed: Jan. 29, 2019

Related U.S. Application Data

(60) Provisional application No. 62/623,478, filed on Jan. 29, 2018.

(51) Int. Cl.
*C12N 15/82* (2006.01)
*C12N 15/11* (2006.01)
*C12N 9/22* (2006.01)

(52) U.S. Cl.
CPC .......... *C12N 15/8213* (2013.01); *C12N 9/22* (2013.01); *C12N 15/11* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| 7,422,889 | B2 | 9/2008 | Sauer et al. |
| 7,691,995 | B2 | 4/2010 | Zamore et al. |
| 7,786,350 | B2 | 8/2010 | Allen et al. |
| 8,030,473 | B2 | 10/2011 | Carrington et al. |
| 8,314,290 | B2 | 11/2012 | Allen et al. |
| 8,334,430 | B2 | 12/2012 | Allen et al. |
| 8,395,023 | B2 | 3/2013 | Gilbertson et al. |
| 8,404,928 | B2 | 3/2013 | Allen et al. |
| 8,410,334 | B2 | 4/2013 | Allen et al. |
| 8,697,359 | B1 | 4/2014 | Zhang |
| 8,748,699 | B2 | 6/2014 | Reuzeau et al. |
| 8,816,153 | B2 | 8/2014 | Gilbertson et al. |
| 8,946,511 | B2 | 2/2015 | Allen et al. |
| 9,040,774 | B2 | 5/2015 | Ivashuta et al. |
| 9,139,838 | B2 | 9/2015 | Huang et al. |
| 9,192,112 | B2 | 11/2015 | Allen et al. |
| 2009/0293148 | A1 | 11/2009 | Ren et al. |
| 2011/0131679 | A2* | 6/2011 | La Rosa ............ C07K 14/415 800/278 |
| 2015/0082478 | A1 | 3/2015 | Cigan et al. |
| 2015/0307889 | A1 | 10/2015 | Petolino et al. |
| 2016/0194653 | A1 | 7/2016 | Cutler et al. |
| 2016/0208243 | A1* | 7/2016 | Zhang .................... C12N 15/82 |
| 2017/0037432 | A1 | 2/2017 | Donohoue et al. |
| 2017/0166912 | A1 | 6/2017 | Brower-Toland et al. |
| 2017/0175140 | A1* | 6/2017 | Hummel .............. C12N 15/907 |
| 2019/0264218 | A1 | 8/2019 | Shultz et al. |
| 2019/0352655 | A1 | 11/2019 | Niu et al. |

FOREIGN PATENT DOCUMENTS

| WO | 2016007948 A1 | 1/2016 |
| WO | 2016123514 A1 | 8/2016 |

OTHER PUBLICATIONS

Bartlett et al., "Mapping Genome-Wide Transcription Factor Binding Sites Using DAP-Seq", Nat. Protoc., 2017, pp. 1659-1672, vol. 12, No. 8.
Bortesi et al., "The CRISPR/Cas9 System for Plant Genome Editing and Beyond", Biotechnology Advances, 2015, pp. 41-52, vol. 33, No. 1.
Burgess et al., "Advances in Understanding Cis Regulation of the Plant Gene with Emphasis on Comparative Genomics", Current Opinion in Plant Biology, 2015, pp. 141-147, vol. 27.
Cai et al, "A Key ABA Catabolic Gene, OsABA8ox3, Is Involved in Drought Stress Resistance in Rice", PLOS One, Feb. 3, 2015, pp. 1-13.
Campbell et al, "Allelic variants of OsHKT1;1 underlie the divergence between indica and japonica subspecies of rice (*Oryza sativa*) for root sodium content", PLOS Genetics, Jun. 5, 2017, pp. 1-31.
Ellis et al, "The ocs element: a 16 base pair palindrome essential for activity of the octopine synthase enhancer", EMBO Journal, 1987, pp. 3203-3208, vol. 6, No. 11, Oxford England.
Eom et al, "SWEETs, transporters for intracellular and intercellular sugar translocation", Curr Opinion Plant Biol, Jun. 2015, pp. 53-62, vol. 25, Elsevier Ltd.
ERISdb: a Database of Plant Splice Sites downloaded from <http://lemur.amu.edu.pl/share/ERISdb/home.html> on Mar. 2, 2020.
Gao et al, "OsSDIR1 overexpression greatly improves drought tolerance in transgenic rice", Plant Mol Biol, Apr. 16, 2011, Springer Science+Business Media B.V.
He et al., "Improved Regulatory Element Prediction Based on Tissue-Specific Local Epigenomic Signatures", PNAS, 2017, pp. 1633-1640.
Kagale et al., "EAR Motif-Mediated Transcriptional Repression in Plants", Epigenetics, 2011, pp. 141-146, vol. 6, No. 2.
Kromdijk et al, "Improving photosynthesis and crop productivity by accelerating recovery from photoprotection", Plant Science, Nov. 18, 2015, pp. 857-860, vol. 354, No. 6314.

(Continued)

*Primary Examiner* — Brent T Page
(74) *Attorney, Agent, or Firm* — McKee, Voorhees & Sease PLC

(57) ABSTRACT

The invention relates to novel plants, seeds and compositions, as well as improvements to plant breeding and methods for creating modifications in plant genomes.

16 Claims, No Drawings
Specification includes a Sequence Listing.

(56) References Cited

OTHER PUBLICATIONS

Morita et al., "Targeted DNA demethylation in vivo using dCas9-peptide repeat and scFv-TET1 catalytic domain fusions" Nature Biology, Aug. 29, 2016, pp. 1060-1065, vol. 34.
Mout et al., "Directed Cytosolic Delivery of CRISPR/Cas9-Ribonucleoprotein for Efficient Gene Editing", ACS Nano, 2017, pp. 2452-2458, vol. 11.
Narsai et al, "Genome-wide analysis of mRNA decay rates and their determinants in *Arabidopsis thaliana*". Plant Cell, Nov. 2007, pp. 318-3436, vol. 19, Amer Soc. of Plant Biologists.
Office Action for U.S. Appl. No. 16/146,871 dated Mar. 20, 2020.
Office Action for U.S. Appl. No. 16/261,233 dated Jun. 12, 2020.
Oka et al., "Genome-Wide Mapping of Transcriptional Enhancer Candidates Using DNA and Chromatin Features in Maize", Genome Biology, 2017, 24 pages, vol. 18 No. 137.
O'Malley et al., "Cistrome and Epicistrome Features Shape the Regulatory DNA Landscape", Cell, 2016, pp. 1280-1292, vol. 165.
Pajerowska-Mukhtar et al., "The HSF-like Transcription Factor TBF1 Is a Major Molecular Switch for Plant Growth-to-Defense Transition", Jan. 24, 2012, pp. 103-112, vol. 22, No. 2, Elsevier Ltd.
Pnueli et al., "The Self-Pruning Gene of Tomato Regulates Vegetative to Reproductive Switching of Sympodial Meristems and is the Ortholog of CEN and TFL1", Development, 1998, pp. 1979-1989, vol. 123, No. 11.
Sah et al, "Genetic Transformation of Rice: Problems, Progress and Prospects", J Rice Res,, 2014, pp. 1-10, vol. 3, No. 1.
Schaeffer et al., "CRISPR/Cas9-Mediated Genome Editing and Gene Replacement in Plants: Transitioning from Lab to Field", Plant Science, 2015, pp. 130-142, vol. 240.
Song et al, "A rice ABC transporter, OsABCC1, reduces arsenic accumulation in the grain", Proceedings of the National Academy of Sciences, Oct. 2014, pp. 1-6.
Soyk et al., "Bypassing Negative Epistasis on Yield in Tomato Imposed by a Domestication Gene", Cell, 2017, pp. 1142-1155, vol. 169.
Svitashev et al., "Targeted Mutagenesis, Precise Gene Editing, and Site-Specific Gene Insertion in Maize using Cas9 and Guide RNA", Plant Physiology, 2015, pp. 931-945, vol. 169.
Szczesniak et al., "ERISdb: A Database of Plant Splice Sites and Splicing Signals", Plant Cell Physiol., 2013, 8 pages, vol. 54, No. 2.
Ulmasov et al., "Aux/IAA Proteins Repress Expression of Reporter Genes Containing Natural and Highly Active Synthetic Auxin Response Elements", The Plant Cell, 1997, pp. 1963-1971, vol. 9.
Walker et al., "Molecular Mechanisms of Auxin Action", Current Opinion in Plant Biology, 1998, pp. 434-439, vol. 1.
Xu et al, "Global translational reprogramming is a fundamental layer of immune regulation in plants", Nature, May 25, 2017, pp. 487-490, vol. 545, No. 7655.
Xu et al, "uORF-mediated translation allows engineered plant disease resistance without fitness costs", Nature, May 25, 2017, pp. 491-494, vol. 545, No. 7655.
Liang et al., "Efficient DNA-free Genome Editing of Bread Wheat Using CRISPR/Cas9 Ribonucleoprotein Complexes", Nature Communications, Jan. 18, 2017, vol. 8, No. 14261.
Wang et al, "Simultaneous Editing of Three Homoeoalleles in Hexaploid in Hexaploid Bread Wheat Confers Heritable Resistance to Powdery Mildew", Nature Biotechnology, Sep. 2014, pp. 947-952, vol. 32, No. 9.
Zhang, et al, "Efficient and Transgene-Free Genome Editing in Wheat Through Transient Expression of CRISPR/Cas9 DNA or RNA", Nature Communication, 7:12617, Aug. 25, 2016, pp. 1-8.
Andersson et al., "Efficient Targeted Multiallelic Mutagenesis in Tetrapioid Potato (*Solanum tuberosum*) by Transient CRISPR-Cas9 Expression in Protoplasts", Plant Cell Rep., 2017, pp. 117-128, vol. 36.
Bahal et al, "In vivo correction of anaemia in b-thalassemic mice by gPNA-mediated gene editing with nanoparticle deliver". Nature Communications, Oct. 26, 2016, pp. 1-14.

Baskaran et al, "Gene delivery using microinjection of agrobacterium to embryonic shoot apical meristem of elite indica rice cultivars", J. Plant Biochem. Biotechnol., Jul.-Dec. 2012, pp. 268-274, vol. 21, No. 2.
Burstein et al, "New CRISPR-Cas systems from uncultivated microbes", Nature, Feb. 9, 2017, pp. 237-241, vol. 542, No. 7640.
Davies et al, "Identification and use of the sugarcane bacilliform virus enhancer in transgenic maize", BMC Plant Biology, 2014, pp. 1-12, vol. 14, No. 359.
Ferré-D'-Amaré et al, "Small Self-Cleaving Ribozymes", 2010, Cold Spring Harbor Perspectives Biol., pp. 1-10.
Ge et al, "A tissue culture system for different germplasms of indica rice", Plant Cell Rep, Jan. 24, 2006, pp. 392-402, vol. 25, Springer-Verlag.
Guo et al, "Directed evolution of an enhanced and highly efficient FokI cleavage domain for Zinc Finger Nucleases", JMol Biol, Jul. 2, 2010, pp. 96-107, vol. 400, No. 1.
Hendel et al, "Chemically modified guide RNAs enhance CRISPR-Cas genome editing in human primary cells", Nat Biotechnol., Sep. 2015, pp. 985-989, vol. 33, No. 9.
Jores et al, "Characterization of the targeting signal in mitochondrial b-barrel proteins", Nature Comm., Jun. 27, 2016, pp. e12036, 16 pages, vol. 7.
Komorl et al, "Programmable editing of a target base in genomic DNA without double-stranded DNA cleavage", Nature, Oct. 20, 2016, pp. 420-424, vol. 533, No. 7603.
Laurie et al., "A Novel Technique for the Partial Isolation of Maize Embryo Sacs and Subsequent Regeneration of Plants", In Vitro Cell. Dev. Biol., pp. 320-325, vol. 35, Society for In Vitro Biology.
LeCong et al, "Multiplex Genome Engineering Using CRISPR/Cas Systems", Science, Feb. 15, 2013, pp. 819-823, vol. 339, No. 6121.
Liu et al, "C2c1-sgRNA Complex Structure Reveals RNA-Guided DNA Cleavage Mechanism", Molecular Cell, Jan. 19, 2017, pp. 310-322, vol. 65, Elsevier Inc.
Mahfouz et al, "De novo-engineered transcription activator-like effector (TALE) hybrid nuclease with novel DNA binding specificity creates double-strandbreaks", PNAS, Feb. 8, 2011, pp. 2623-2628, vol. 108, No. 6.
Mahfouz et al, "Tale nucleases and next generation GM Crops", GM Crops, Jun. 2011, pp. 99-103, vol. 2, No. 2, Landes Bioscience.
Marand et al, "Towards genome-wide prediction and characterization of enhancers in plants", Biochim Biophys Acta Gene Regul Mech., 2017, pp. 131-139, vol. 1860, vol. 1.
Martin-Ortigosa et al, "Mesoporous Silica Nanoparticle-Mediated Intracellular Cre Protein Delivery for Maize Genome Editing via loxP Site Excision", Plant Physiology, Feb. 2014, pp. 537-547, vol. 164, American Society of Plant Biologists.
Niu et al, "Transient Expression Assays for Quantifying Signaling Output", Methods Mol. Biol., 2012, Chapter 16, pp. 195-206, vol. 876.
Office Action for U.S. Appl. No. 16/261,243 dated Jun. 26, 2020.
Peter et al, "Mechanism of signal transduction of the LOV2-Ja photosensor from Avena sativa", Nature Communications, Nov. 16, 2010, pp. 1-7, Macmillan Publishers Limited.
Ran et al, "Double nicking by RNA-guided CRISPR Cas9 for enhanced genome editing specificity", Cell, Sep. 12, 2013, pp. 1380-1389, vol. 154, No. 6.
Ran et al, "Genome engineering using the CRISPR-Cas 9 system", Nat Protoc., Nov. 2013, pp. 2281-2308, vol. 8, No. 11.
Ravi et al, "A haploid genetics toolbox for *Arabidopsis thaliana*". Nature Communications, Oct. 31, 2014, pp. 1-8, Macmillan Publishers Limited.
Senapati, S.K., "A Review on Research Progress on in vitro Regeneration and Transformation of Tomato", Annual Research & Review in Biology, Mar. 4, 2016, pp. 1-9, vol. 9, No. 6.
Shmakov et al, "Discovery and functional characterization of diverse Class 2 CRISPR-Cas systems", Mol. Cell., Nov. 5, 2015, pp. 385-397, vol. 60, No. 3.
Sticklen et al, "Shoot Apical Meristem: a Sustainable Explant for Genetic Transformation of Cereal Crops", In Vitro Cell. Dev. Biol.-Plant, May-Jun. 2005, pp. 187-200, vol. 41, Society for In Vitro Biology.

(56) References Cited

OTHER PUBLICATIONS

Stroud et al, "Plants regenerated from tissue culture contain stable epigenome changes in rice", eLife, Mar. 19, 2013, pp. 1-14.
Suay et al, "Specific roles of 5' RNA secondary structures in stabilizing transcripts in chloroplasts", Nucleic Acids Research, Jul. 22, 2005, pp. 4754-4761, vol. 33, No. 15, Oxford University Press.
Tahir et al, "Genetic Transformation Protocols Using Zygotic Embryos as Explants: An Overview", Methods in Molecular Biology, Chapter 21, 2011, pp. 309-326, vol. 710, Springer Science+Business Media, LLC.
Urnov et al, "Genome editing with engineered zinc finger nucleases", Nature Rev. Genet., Sep. 2010, pp. 636-646, vol. 11, Macmillan Publishers Limited.
Vinoth et al, "Optimization of Factors Influencing Microinjection Method for Agrobacterium tumefaciens—Mediated Transformation of Tomato", Appl Biochem Biotechnol, Jan. 10, 2013, pp. 1173-1187, vol. 169.
Xing et al, "A CRISPR/Cas 9 toolkit for multiplex genome editing in plants", BMC Plant Biology, 2014, pp. 1-12, vol. 14, No. 327.
Yang et al, "PAM-Dependent Target DNA Recognition and Cleavage by C2c1 CRISPR-Cas Endonuclease", Cell, Dec. 15, 2016, pp. 1814-1828, vol. 167, Elsevier Inc.
Zefu et al, "Combining ATAC-seq with nuclei sorting for discovery of cis-regulatory regions in plant genomes", Nucleic Acids Research, 2017, pp. e41, vol. 45, No. 6, Oxford University Press.
Zetsche et al, "Cpf1 is a Single RNA-Guided Endonuclease of a Class 2 CRISPR-Cas System" Oct. 22, 2015, Cell, pp. 759-771, vol. 163, Elsevier Inc.
Zhang et al, "Genetic transformation of commercial cultivars of oat (*Avena sativa* L.) and barley (*Hordeum vulgare* L.) using in vitro shoot meristematic cultures derived from germinated seedlings", Plant Cell Reports, Jan. 14, 1999, pp. 959-966, vol. 18, Springer-Verlag.
Zoltowski et al, "Conformational Switching in the Fungal Light Sensor Vivid", Science, May 18, 2007, pp. 1054-1057, vol. 316, No. 5827.
Collonnier, Cécile, et al., "Towards mastering CRISP-induced gene knock-in in plants: Survey of key features and focus on the model Physcomitrella patens", Methods., vol. 121-122, pp. 103-117, 2017.
Jeong, Namhee, et al., "Ln Is a Key Regulator of Leaflet Shape and No. of Seeds per Pod in Soybean", The Plant Cell, vol. 24, pp. 4807-4818, 2012.
Li, Jun, et al., "Gene replacements and insertions in rice by intron targeting using CRISPR-Cas9", Nature Plants, Article No. 16139, 2016.
United States Patent and Trademark Office, "Non-Final Office Action", Issued in connection to U.S. Appl. No. 16/261,219, dated Dec. 3, 2020, 30 pages.
United States Patent and Trademark Office, "Final Office Action", Issued in connection to U.S. Appl. No. 16/261,243, dated Feb. 4, 2021, 36 pages.
Schaeffer, Scott M., et al., "CRISPR/Cas9-mediated genome editing and gene replacement in plants: Transitioning from lab to field", Plant Science, vol. 240, pp. 130-142, 2015.
Schmutz, Jeremy, et al., "Genome sequence of the palaeopolyploid soybean", Nature, vol. 463, pp. 178-183, 2010.
United States Patent and Trademark Office, "Final Office Action", Issued in connection to U.S. Appl. No. 16/261,233, dated Feb. 10, 2021, 35 pages.
United States Patent and Trademark Office, "Office Action-Requirement for Unity of Invention", Issued in connection to U.S. Appl. No. 16/480,992, dated Jul. 25, 2019, 16 pages.

\* cited by examiner

RICE CELLS AND RICE PLANTS

CROSS-REFERENCE TO RELATED APPLICATIONS

This application claims the benefit of U.S. Provisional Patent Application No. 62/623,478, filed Jan. 29, 2018, which is incorporated herein by reference in its entirety.

INCORPORATION OF SEQUENCE LISTING

A sequence listing contained in the file named "10010US1_TC181662_ST25.txt" which is 8669478 bytes in size (measured in MS-Windows), which was created on Jan. 29, 2019, and which comprises 1732 sequences, is electronically filed herewith and is incorporated herein by reference in its entirety. The sequence listing contained in the file named "39732US_sequencelisting.txt" which is 8.7 MB bytes in size, which was created on Jan. 29, 2018, which was filed on Jan. 29, 2018 as a part of U.S. Provisional Patent Application No. 62/623,478, and which comprises 1732 sequences, is also incorporated herein by reference in its entirety.

FIELD OF THE INVENTION

Disclosed herein are novel rice plant cells, rice plants and rice seeds derived from such plant cells and having enhanced traits, and methods of making and using such plant cells and derived plants and seeds.

BACKGROUND

Plant breeding and engineering currently relies on Mendelian genetics or recombinant techniques.

SUMMARY

Disclosed herein are methods for providing novel rice plant cells or rice plant protoplasts, plant callus, tissues or parts, whole rice plants, and rice seeds having one or more altered genetic sequences. Among other features, the methods and compositions described herein enable the stacking of preferred alleles without introducing unwanted genetic or epigenetic variation in the modified plants or plant cells. The efficiency and reliability of these targeted modification methods are significantly improved relative to traditional plant breeding, and can be used not only to augment traditional breeding techniques but also as a substitute for them.

In one aspect, the invention provides a method of changing expression of a sequence of interest in a genome, including integrating a sequence encoded by a polynucleotide, such as a double-stranded or single-stranded polynucleotides including DNA, RNA, or a combination of DNA and RNA, at the site of at least one double-strand break (DSB) in a genome, which can be the genome of a eukaryotic nucleus (e. g., the nuclear genome of a plant cell) or a genome of an organelle (e. g., a mitochondrion or a plastid in a plant cell). Effector molecules for site-specific introduction of a DSB into a genome include various endonucleases (e. g., RNA-guided nucleases such as a type II Cas nuclease, a Cas9, a type V Cas nuclease, a Cpf1, a CasY, a CasX, a C2c1, or a C2c3) and guide RNAs that direct cleavage by an RNA-guided nuclease. Embodiments include those where the DSB is introduced into a genome by a ribonucleoprotein complex containing both a site-specific nuclease (e. g., Cas9, Cpf1, CasX, CasY, C2c1, C2c3) and at least one guide RNA, or by a site-specific nuclease in combination with at least one guide RNA; in some of these embodiments no plasmid or other expression vector is utilized to provide the nuclease, the guide RNA, or the polynucleotide. These effector molecules are delivered to the cell or organelle wherein the DSB is to be introduced by the use of one or more suitable composition or treatment, such as at least one chemical, enzymatic, or physical agent, or application of heat or cold, ultrasonication, centrifugation, electroporation, particle bombardment, and bacterially mediated transformation. It is generally desirable that the DSB is induced at high efficiency. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. In various embodiments, the DSB is introduced at a comparatively high efficiency, e. g., at about 20, about 30, about 40, about 50, about 60, about 70, or about 80 percent efficiency, or at greater than 80, 85, 90, or 95 percent efficiency. In embodiments, the DSB is introduced upstream of, downstream of, or within the sequence of interest, which is coding, non-coding, or a combination of coding and non-coding sequence. In embodiments, a sequence encoded by the polynucleotide (such as a double-stranded DNA, a single-stranded DNA, a single-stranded DNA/RNA hybrid, or a double-stranded DNA/RNA hybrid), when integrated into the site of the DSB in the genome, is then functionally or operably linked to the sequence of interest, e. g., linked in a manner that modifies the transcription or the translation of the sequence of interest or that modifies the stability of a transcript including that of the sequence of interest. Embodiments include those where two or more DSBs are introduced into a genome, and wherein a sequence encoded by a polynucleotide (such as a double-stranded DNA, a single-stranded DNA, a single-stranded DNA/RNA hybrid, or a double-stranded DNA/RNA hybrid) that is integrated into each DSB is the same or different for each of the DSBs. In embodiments, at least two DSBs are introduced into a genome by one or more nucleases in such a way that genomic sequence (coding, non-coding, or a combination of coding and non-coding sequence) is deleted between the DSBs (leaving a deletion with blunt ends, overhangs or a combination of a blunt end and an overhang), and a sequence encoded by a polynucleotide (such as a double-stranded DNA, a single-stranded DNA, a single-stranded DNA/RNA hybrid, or a double-stranded DNA/RNA hybrid) molecule is integrated between the DSBs (i. e., at the location of the deleted genomic sequence). The method is particularly useful for integrating into the site of a DSB a heterologous nucleotide sequence that provides a useful function or use. For example, the method is useful for integrating or introducing into the genome a heterologous sequence that stops or knocks out expression of a sequence of interest (such as a gene encoding a protein), or a heterologous sequence that is a unique identifier nucleotide sequence, or a heterologous sequence that is (or that encodes) a sequence recognizable by a specific binding agent or that binds to a specific molecule, or a heterologous sequence that stabilizes or destabilizes a transcript containing it. Embodiments include use of the method to integrate or introduce into a genome sequence of a promoter or promoter-like element (e. g., sequence of an auxin-binding or hormone-binding or transcription-factor-binding element, or sequence of or encoding an aptamer or riboswitch), or a sequence-specific binding or cleavage site sequence (e. g., sequence of or encoding an endonuclease cleavage site, a small RNA recognition site, a recombinase site, a splice site, or a transposon recognition site). In embodiments, the method is used to delete or otherwise modify to make non-functional an endogenous functional sequence, such as a hormone- or transcription-factor-binding element, or a small RNA or recombinase or transposon recognition site. In embodiments, additional molecules are used to effect a desired expression result or a desired genomic change. For example, the method is used to integrate heterologous recombinase recognition site sequences at two DSBs in a genome, and the appropriate recombinase molecule is employed to excise genomic sequence located between the recombinase recognition sites. In another example, the method is used to integrate a polynucleotide-encoded heterologous small RNA recognition site sequence at a DSB in a sequence of interest in a genome, wherein when the small RNA is present (e. g., expressed endogenously or transiently or transgenically), the small RNA binds to and cleaves the transcript of the sequence of interest that contains the integrated small RNA recognition site. In another example, the method is used to integrate in the genome of a rice plant or plant cell a polynucleotide-encoded promoter or promoter-like element that is responsive to a specific molecule (e. g., an auxin, a hormone, a drug, an herbicide, or a polypeptide), wherein a specific level of expression of the sequence of interest is obtained by providing the corresponding specific molecule to the plant or plant cell; in a non-limiting example, an auxin-binding element is integrated into the promoter region of a protein-coding sequence in the genome of a plant or plant cell, whereby the expression of the protein is upregulated when the corresponding auxin is exogenously provided to the plant or plant cell (e. g., by adding the auxin to the medium of the plant cell or by spraying the auxin onto the plant). Another aspect of the invention is a rice cell including in its genome a heterologous DNA sequence, wherein the heterologous sequence includes (a) nucleotide sequence of a polynucleotide integrated by the method at the site of a DSB in the genome, and (b) genomic nucleotide sequence adjacent to the site of the DSB; related aspects include a plant containing such a cell including in its genome a heterologous DNA sequence, progeny seed or plants (including hybrid progeny seed or plants) of the plant, and processed or commodity products derived from the plant or from progeny seed or plants. In another aspect, the invention provides a heterologous nucleotide sequence including (a) nucleotide sequence of a polynucleotide (such as a double-stranded DNA, a single-stranded DNA, a single-stranded DNA/RNA hybrid, or a double-stranded DNA/RNA hybrid) molecule integrated by the method at the site of a DSB in a genome, and (b) genomic nucleotide sequence adjacent to the site of the DSB; related aspects include larger polynucleotides such as a plasmid, vector, or chromosome including the heterologous nucleotide sequence, as well as a polymerase primer for amplification of the heterologous nucleotide sequence.

In another embodiment, the invention provides a method of engineering a rice plant cell having a ploidy of 2n, with n being a value selected from the group consisting of 0.5, 1, 1.5, 2, 2.5, 3, 3.5, 4, 5, and 6, by creating a plurality of targeted modifications in the genome of the plant cell, comprising: contacting the genome with one or more targeting agents, wherein the one or more agents comprise or encode predetermined peptide or nucleic acid sequences, wherein each of the predetermined peptide or nucleic acid sequence binds preferentially at or near one or more predetermined target sites within the plant genome, and wherein each of the binding facilitates or directs the generation of 2n targeted modifications at 2n loci of the predetermined target sites within the genome to alter at least one trait of a plant comprising the plant cell, or grown from the plant cell; and wherein 2n of the targeted modifications are insertions or creations of predetermined sequences encoded by one or more polynucleotide donor molecules; and wherein the plurality of targeted modifications occurs without an intervening step of separately identifying an individual modification and without a step of separately selecting for the occurrence of an individual modification among the plurality of targeted modifications mediated by the targeting agents. In a related embodiment, at least one of the polynucleotide donor molecules lacks homology to the genome sequences adjacent to the site of insertion, and/or wherein at least one of the polynucleotide donor molecules is a single stranded DNA molecule, a single stranded RNA molecule, a single stranded DNA-RNA hybrid molecule, or a duplex RNA-DNA molecule. In another embodiment, the plant cell is a plant cell of an inbred plant. In another embodiment, at least one of the targeted modifications is an insertion between 3 and 400 nucleotides in length, between 10 and 350 nucleotides in length, between 18 and 350 nucleotides in length, between 18 and 200 nucleotides in length, between 10 and 150 nucleotides in length, or between 11 and 100 nucleotides in length. In yet another embodiment, the method comprises at least 2n insertions, wherein at least one of the insertions is an upregulatory sequence or a transcription factor binding site. In a related embodiment, the insertion or insertions of predetermined sequences are accompanied by the deletion of sequences from the plant genome. In another related embodiment, the donor polynucleotide is tethered to a crRNA by a covalent bond, a non-covalent bond, or a combination of covalent and non-covalent bonds. In yet another embodiment, the genome of the engineered plant cell has not more unintended changes in comparison to the genome of the original plant than $2 \times 10^{-9}$ mutations per bp per replication.

In another aspect, the invention provides a composition including a plant cell and a polynucleotide (such as a double-stranded DNA, a single-stranded DNA, a single-stranded DNA/RNA hybrid, or a double-stranded DNA/RNA hybrid) donor molecule that is capable of being integrated at (or having its sequence integrated at) a double-strand break in genomic sequence in the plant cell. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments, the plant cell includes a double-strand break (DSB) in its genome, at which DSB site the polynucleotide donor molecule is integrated using methods disclosed herein. In embodiments, at least one DSB is induced in the plant cell's genome by including in the composition a DSB-inducing agent, for example, various endonucleases (e. g., RNA-guided nucleases such as a type II Cas nuclease, a Cas9, a type V Cas nuclease, a Cpf1, a CasY, a CasX, a C2c1, or a C2c3) and guide RNAs that direct cleavage by an RNA-guided nuclease; the dsDNA molecule is integrated into the DSB thus induced using methods disclose herein. Specific embodiments include compositions including a plant cell, at least one dsDNA molecule, and at least one ribonucleoprotein complex containing both a site-specific nuclease (e. g., Cas9, Cpf1, CasX, CasY, C2c1, C2c3) and at least one guide RNA; in some of these embodiments, the composition contains no plasmid or other expression vector for providing the nuclease, the guide RNA, or the dsDNA. In embodiments of the composition, the polynucleotide donor molecule is double-stranded DNA or RNA or a combination of DNA and RNA, and is blunt-ended, or contains one or more terminal overhangs, or contains chemical modifications such as phosphorothioate bonds or a detectable label. In other embodiments, the polynucleotide donor molecule is a single-stranded polynucleotide composed of DNA or RNA or a combination of DNA or RNA, and can further be chemically modified or labelled. In various embodiments of the composition, the polynucleotide donor molecule includes a nucleotide sequence that provides a useful function when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease). In particular embodiments, the modifications to the rice cell or plant will affect the activity or expression of one or more genes or proteins listed in Table 6, and in some embodiments two or more of those genes or proteins. In related embodiments, the activity or expression of one or more genes or proteins listed in Table 6 will be altered by the introduction or creation of one or more of the regulatory sequences listed in Table 5.

In another aspect, the invention provides a reaction mixture including: (a) a rice plant cell having at least one double-strand break (DSB) at a locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated at (or having its sequence integrated at) the DSB (preferably by non-homologous end-joining (NHEJ)), wherein the polynucleotide donor molecule has a length of between about 18 to about 300 base-pairs (or nucleotides, if single-stranded), or between about 30 to about 100 base-pairs (or nucleotides, if single-stranded); wherein the polynucleotide donor molecule includes a sequence which, if integrated at the DSB, forms a heterologous insertion (wherein the sequence of the polynucleotide molecule is heterologous with respect to the genomic sequence flanking the insertion site or DSB). In embodiments of the reaction mixture, the plant cell is an isolated plant cell or plant protoplast. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments of the reaction mixture, the polynucleotide donor molecule includes a nucleotide sequence that provides a useful function or use when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease).

In another aspect, the invention provides a polynucleotide for disrupting gene expression, wherein the polynucleotide is double-stranded and includes at least 18 contiguous base-pairs and encoding at least one stop codon in each possible reading frame on each strand, or is single-stranded and includes at least 11 contiguous nucleotides; and wherein the polynucleotide encodes at least one stop codon in each possible reading frame on each strand. In embodiments, the polynucleotide is a double-stranded DNA (dsDNA) or a double-stranded DNA/RNA hybrid molecule including at least 18 contiguous base-pairs and encoding at least one stop codon in each possible reading frame on either strand. In embodiments, the polynucleotide is a single-stranded DNA or a single-stranded DNA/RNA hybrid molecule including at least 11 contiguous nucleotides and encoding at least one stop codon in each possible reading frame on the strand. Such a polynucleotide is especially useful in methods disclosed herein, wherein, when a sequence encoded by the polynucleotide is integrated or inserted into a genome at the site of a DSB in a sequence of interest (such as a protein-coding gene), the sequence of the heterologously inserted polynucleotide serves to stop translation of the transcript containing the sequence of interest and the heterologously inserted polynucleotide sequence. Embodiments of the polynucleotide include those wherein the polynucleotide includes one or more chemical modifications or labels, e. g., at least one phosphorothioate modification.

In another aspect, the invention provides a method of identifying the locus of at least one double-stranded break (DSB) in genomic DNA in a cell (such as a plant cell) including the genomic DNA, wherein the method includes the steps of: (a) contacting the genomic DNA having a DSB with a polynucleotide (such as a double-stranded DNA, a single-stranded DNA, a single-stranded DNA/RNA hybrid, or a double-stranded DNA/RNA hybrid) donor molecule, wherein the polynucleotide donor molecule is capable of being integrated (or having its sequence integrated) at the DSB (preferably by non-homologous end-joining (NHEJ)) and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and (b) using at least part of the sequence of the polynucleotide molecule as a target for PCR primers to allow amplification of DNA in the locus of the DSB. In a related aspect, the invention provides a method of identifying the locus of double-stranded breaks (DSBs) in genomic DNA in a pool of cells (such as plant cells or plant protoplasts), wherein the pool of cells includes cells having genomic DNA with a sequence encoded by a polynucleotide donor molecule inserted at the locus of the double stranded breaks; wherein the polynucleotide donor molecule is capable of being integrated (or having its sequence integrated) at the DSB and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and wherein the sequence of the polynucleotide donor molecule is used as a target for PCR primers to allow amplification of DNA in the region of the double-stranded breaks. In embodiments, the pool of cells is a population of plant cells or plant protoplasts, wherein at least some of the cells contain multiple or different DSBs in the genome, each of which can be introduced into the genome by a different guide RNA.

In another aspect, the invention provides a method of identifying the nucleotide sequence of a locus in the genome that is associated with a phenotype, the method including the steps of: (a) providing to a population of cells having the genome: (i) multiple different guide RNAs (gRNAs) to induce multiple different double strand breaks (DSBs) in the genome, wherein each DSB is produced by an RNA-guided nuclease guided to a locus on the genome by one of the gRNAs, and (ii) polynucleotide (such as double-stranded DNA, single-stranded DNA, single-stranded DNA/RNA hybrid, and double-stranded DNA/RNA hybrid) donor molecules having a defined nucleotide sequence, wherein the polynucleotide donor molecules are capable of being integrated (or having their sequence integrated) into the DSBs by non-homologous end-joining (NHEJ); whereby when at least a sequence encoded by some of the polynucleotide donor molecules are inserted into at least some of the DSBs, a genetically heterogeneous population of cells is produced; (b) selecting from the genetically heterogeneous population of cells a subset of cells that exhibit a phenotype of interest; (c) using a pool of PCR primers that bind to at least part of the nucleotide sequence of the polynucleotide donor molecules to amplify from the subset of cells DNA from the locus of a DSB into which one of the polynucleotide donor molecules has been inserted; and (d) sequencing the amplified DNA to identify the locus associated with the phenotype of interest. In embodiments of the method, the gRNA is provided as a polynucleotide, or as a ribonucleoprotein including the gRNA and the RNA-guided nuclease. Related aspects include the cells produced by the method and pluralities, arrays, and genetically heterogeneous populations of such cells, as well as the subset of cells in which the locus associated with the phenotype has been identified, and callus, seedlings, plantlets, and plants and their seeds, grown or regenerated from such cells.

In another aspect, the invention provides a method of modifying a plant cell by creating a plurality of targeted modifications in the genome of the plant cell, wherein the method comprises contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications alter at least one trait of the plant cell, or at least one trait of a plant comprising the plant cell, or at least one trait of a plant grown from the plant cell, or result in a detectable phenotype in the modified plant cell; and wherein at least two of the targeted modifications are insertions of predetermined sequences encoded by one or more polynucleotide donor molecules, and wherein at least one of the polynucleotide donor molecules lacks homology to the genome sequences adjacent to the site of insertion. In a related embodiment, at least one of the polynucleotide donor molecules used in the method is a single stranded DNA molecule, a single stranded RNA molecule, a single stranded DNA-RNA hybrid molecule, or a duplex RNA-DNA molecule. In another related embodiment, wherein the modified plant cell of the method is a meristematic cell, embryonic cell, or germline cell. In yet another related embodiment, the methods described in this paragraph, when practiced repeatedly or on a pool of cells, result in an efficiency of at least 1%, e.g., at least 2%, 5%, 7%, 10%, 15%, 20%, 25%, 30%, 35% or more, wherein said efficiency is determined, e.g., by dividing the number of successfully targeted cells by the total number of cells targeted. In embodiments, two or more loci are modified, wherein the loci are alleles of a given sequence of interest; when all alleles of a given gene or sequence of interest are modified in the same way, the result is homozygous modification of the gene. For example, embodiments of the method enable targeted modification of both alleles of a gene in a diploid (2n ploidy, where n=1) plant, or targeted modification of all three alleles in a triploid (2n ploidy, where n=1.5) plant, or targeted modification of all six alleles of a gene in a hexaploid (2n ploidy, where n=3) plant. In a related embodiment, the targeted plant cell has a ploidy of 2n, with n being a value selected from the group consisting of 0.5, 1, 1.5, 2, 2.5, 3, 3.5, 4, 5, and 6, wherein the method generates 2n targeted modifications at 2n loci of the predetermined target sites within the plant cell genome; and wherein 2n of the targeted modifications are insertions or creations of predetermined sequences encoded by one or more polynucleotide donor molecules.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding facilitates or directs the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant grown from the plant cell, or result in a detectable phenotype in the modified plant cell; and wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In a related embodiment, at least one of the polynucleotide donor molecules used in the method lacks homology to the genome sequences adjacent to the site of insertion. In another related embodiment, the modified plant cell is a meristematic cell, embryonic cell, or germline cell. In yet another related embodiment, repetition of the methods described in this paragraph result in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein the modified plant cell is a meristematic cell, embryonic cell, or germline cell. In a related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment, at least one of the polynucleotide donor molecules lacks homology to the genome sequences adjacent to the site of insertion. In yet another embodiment related to the methods of this paragraph, repetition of the method results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted.

In another embodiment, the invention provides a method of modifying a rice plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding directs the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein repetition of the aforementioned steps results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted. In a related embodiment, the modified plant cell is a meristematic cell, embryonic cell, or germline cell. In another related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment of the methods of this paragraph, at least one of the polynucleotide donor molecules used in the method lacks homology to the genome sequences adjacent to the site of insertion.

In various embodiments of the methods described above, at least one of the targeted modifications is an insertion between 3 and 400 nucleotides in length, between 10 and 350 nucleotides in length, between 18 and 350 nucleotides in length, between 18 and 200 nucleotides in length, between 10 and 150 nucleotides in length, or between 11 and 100 nucleotides in length. In certain, embodiments, two of the targeted modifications are insertions between 10 and 350 nucleotides in length, between 18 and 350 nucleotides in length, between 18 and 200 nucleotides in length, between 10 and 150 nucleotides in length, or between 11 and 100 nucleotides in length.

In another variation of the methods described above, at least two insertions are made, and at least one of the insertions is an upregulatory sequence. In yet another variation, the targeted modification methods described above insert or create at least one transcription factor binding site. In yet another variation of the methods described above, the insertion or insertions of predetermined sequences into the plant genome are accompanied by the deletion of sequences from the plant genome.

In yet another embodiment of the targeted modification methods described above, the methods further comprise obtaining a plant from the modified plant cell and breeding the plant. In yet another embodiment, the methods described above comprise a step of introducing additional genetic or epigenetic changes into the modified plant cell or into a plant grown from the modified plant cell.

In an embodiment of the targeted modification methods described above, at least two targeted insertions are made and the targeted insertions independently up- or down-regulate the expression of two or more distinct genes. For example, a targeted insertion may increase expression at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or more. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more.

In yet another embodiment of the targeted insertion methods described above, the donor polynucleotide is tethered to a crRNA by a covalent bond, a non-covalent bond, or a combination of covalent and non-covalent bonds. In a related embodiment, the invention provides a composition for targeting a genome comprising a donor polynucleotide tethered to a cRNA by a covalent bond, a non-covalent bond, or a combination of covalent and non-covalent bonds.

In another embodiment of the targeted modification methods described above, the loss of epigenetic marks after modifying occurs in less than 0.1%, 0.08%, 0.05%, 0.02%, or 0.01% of the genome. In yet another embodiment of the targeted modification methods described above, the genome of the modified plant cell is more than 99%, e.g., more than 99.5% or more than 99.9% identical to the genome of the parent cell.

In yet another embodiment of the targeted modification methods described above, at least one of the targeted modifications is an insertion and at least one insertion is in a region of the genome that is recalcitrant to meiotic or mitotic recombination.

In certain embodiments of the plant cell genome targeting methods described above, the plant cell is a member of a pool of cells being targeted. In related embodiments, the modified cells within the pool are characterized by sequencing after targeting.

The invention also provides modified rice plant cells comprising at least two separately targeted insertions in its genome, wherein the insertions are determined relative to a parent plant cell, and wherein the modified plant cell is devoid of mitotically or meiotically generated genetic or epigenetic changes relative to the parent plant cell. In certain embodiments, these plant cells are obtained using the multiplex targeted insertion methods described above. In certain embodiments, the modified plant cells comprise at least two separately targeted insertions, wherein the genome of the modified plant cell is at least 95%, at least 96%, at least 97%, at least 98%, at least 99%, at least 99.5%, at least 99.9%, or at least 99.99% identical to the parent cell, taking all genetic or epigenetic changes into account.

While the introgression of certain traits and transgenes into plants has been successful, achieving a homozygous modified plant in one step (i.e., modifying all targeted loci simultaneously) has not been previously described. Plants homozygous for, e.g., targeted insertions could only be obtained by further crossing and/or techniques involving double-haploids. These techniques are not only time consuming and laborious, they also lead to plants which deviate from the original plant not only for the targeted insertion but also for other changes as a consequence of the techniques employed to enable homozygosity. As such changes could have unintended and unpredictable consequences and may require further testing or screening, they are clearly undesired in a breeding process. In certain embodiments, the invention provides methods of making a targeted mutation and/or targeted insertion in all of the 2n targeted loci in a plant genome in one step. In embodiments, the two or more loci are alleles of a given sequence of interest; when all alleles of a given gene or sequence of interest are modified in the same way, the result is homozygous modification of the gene. For example, embodiments of the method enable targeted modification of both alleles of a gene in a diploid (2n ploidy, where n=1) plant, or targeted modification of all three alleles in a triploid (2n ploidy, where n=1.5) plant, or targeted modification of all six alleles of a gene in a hexaploid (2n ploidy, where n=3) plant.

The invention also provides modified plant cells resulting from any of the claimed methods described, as well as recombinant plants grown from those modified plant cells.

In some embodiments, the invention provides a method of manufacturing a processed plant product, comprising: (a) modifying a plant cell according to any of the targeted methods described above; (b) growing a modified plant from said plant cell, and (c) processing the modified plant into a processed product, thereby manufacturing a processed plant product. In related embodiments, the processed product may be meal, oil, juice, sugar, starch, fiber, an extract, wood or wood pulp, flour, cloth or some other commodity plant product. The invention also provides a method of manufacturing a plant product, comprising (a) modifying a plant cell according to any of the targeted methods described above, (b) growing an modified plant from said plant cell, and (c) harvesting a product of the modified plant, thereby manufacturing a plant product. In related embodiments, the plant product is a product may be leaves, fruit, vegetables, nuts, seeds, oil, wood, flowers, cones, branches, hay, fodder, silage, stover, straw, pollen, or some other harvested commodity product. In further related embodiments, the processed products and harvested products are packaged.

DETAILED DESCRIPTION OF THE INVENTION

Definitions

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as well as necessarily defines the exact complements, as is known to one of ordinary skill in the art. Where a term is provided in the singular, the inventors also contemplate aspects of the invention described by the plural of that term.

By "polynucleotide" is meant a nucleic acid molecule containing multiple nucleotides and refers to "oligonucleotides" (defined here as a polynucleotide molecule of between 2-25 nucleotides in length) and polynucleotides of 26 or more nucleotides. Polynucleotides are generally described as single- or double-stranded. Where a polynucleotide contains double-stranded regions formed by intra- or intermolecular hybridization, the length of each double-stranded region is conveniently described in terms of the number of base pairs. Aspects of this invention include the use of polynucleotides or compositions containing polynucleotides; embodiments include one or more oligonucleotides or polynucleotides or a mixture of both, including single- or double-stranded RNA or single- or double-stranded DNA or single- or double-stranded DNA/RNA hybrids or chemically modified analogues or a mixture thereof. In various embodiments, a polynucleotide (such as a single-stranded DNA/RNA hybrid or a double-stranded DNA/RNA hybrid) includes a combination of ribonucleotides and deoxyribonucleotides (e. g., synthetic polynucleotides consisting mainly of ribonucleotides but with one or more terminal deoxyribonucleotides or synthetic polynucleotides consisting mainly of deoxyribonucleotides but with one or more terminal dideoxyribonucleotides), or includes non-canonical nucleotides such as inosine, thiouridine, or pseudouridine. In embodiments, the polynucleotide includes chemically modified nucleotides (see, e. g., Verma and Eckstein (1998) Annu. Rev. Biochem., 67:99-134); for example, the naturally occurring phosphodiester backbone of an oligonucleotide or polynucleotide can be partially or completely modified with phosphorothioate, phosphorodithioate, or methylphosphonate internucleotide linkage modifications; modified nucleoside bases or modified sugars can be used in oligonucleotide or polynucleotide synthesis; and oligonucleotides or polynucleotides can be labelled with a fluorescent moiety (e. g., fluorescein or rhodamine or a fluorescence resonance energy transfer or FRET pair of chromophore labels) or other label (e. g., biotin or an isotope). Modified nucleic acids, particularly modified RNAs, are disclosed in U.S. Pat. No. 9,464,124, incorporated by reference in its entirety herein. For some polynucleotides (especially relatively short polynucleotides, e. g., oligonucleotides of 2-25 nucleotides or base-pairs, or polynucleotides of about 25 to about 300 nucleotides or base-pairs), use of modified nucleic acids, such as locked nucleic acids ("LNAs"), is useful to modify physical characteristics such as increased melting temperature (Tm) of a polynucleotide duplex incorporating DNA or RNA molecules that contain one or more LNAs; see, e. g., You et al. (2006) *Nucleic Acids Res.*, 34:1-11 (e60), doi:10.1093/nar/gkl175.

In the context of the genome targeting methods described herein, the phrase "contacting a genome" with an agent means that an agent responsible for effecting the targeted genome modification (e.g., a break, a deletion, a rearrangement, or an insertion) is delivered to the interior of the cell so the directed mutagenic action can take place.

In the context of discussing or describing the ploidy of a plant cell, the "n" (as in "a ploidy of 2n") refers to the number of homologous pairs of chromosomes, and is typically equal to the number of homologous pairs of gene loci on all chromosomes present in the cell.

The term "inbred variety" refers to a genetically homozygous or substantially homozygous population of plants that preferably comprises homozygous alleles at about 95%, preferably 98.5% or more of its loci. An inbred line can be developed through inbreeding (i.e., several cycles of selfing, more preferably at least 5, 6, 7 or more cycles of selfing) or doubled haploidy resulting in a plant line with a high uniformity. Inbred lines breed true, e.g., for one or more or all phenotypic traits of interest. An "inbred", "inbred individual, or "inbred progeny" is an individual sampled from an inbred line.

"F1, F2, F3, etc." refers to the consecutive related generations following a cross between two parent plants or parent lines. The plants grown from the seeds produced by crossing two plants or lines is called the F1 generation. Selfing the F1 plants results in the F2 generation, etc. "F1 hybrid" plant (or F1 hybrid seed) is the generation obtained from crossing two inbred parent lines. Thus, F1 hybrid seeds are seeds from which F1 hybrid plants grow. F1 hybrids are more vigorous and higher yielding, due to heterosis.

Hybrid seed: Hybrid seed is seed produced by crossing two different inbred lines (i.e. a female inbred line with a male inbred). Hybrid seed is heterozygous over a majority of its alleles.

As used herein, the term "variety" refers to a group of similar plants that by structural or genetic features and/or performance can be distinguished from other varieties within the same species.

The term "cultivar" (for cultivated variety) is used herein to denote a variety that is not normally found in nature but that has been created by humans, i.e., having a biological status other than a "wild" status, which "wild" status indicates the original non-cultivated, or natural state of a plant or accession. The term "cultivar" includes, but is not limited to, semi-natural, semi-wild, weedy, traditional cultivar, landrace, breeding material, research material, breeder's line, synthetic population, hybrid, founder stock/base population, inbred line (parent of hybrid cultivar), segregating population, mutant/genetic stock, and advanced/improved cultivar. The term "elite background" is used herein to indicate the genetic context or environment of a targeted mutation of insertion.

The term "dihaploid line" refers to stable inbred lines issued from another culture. Some pollen grains (haploid) cultivated on specific medium and circumstances can develop plantlets containing n chromosomes. These plantlets are then "double" and contain 2n chromosomes. The progeny of these plantlets are named "dihaploid" and are essentially not segregating any more (i.e., they are stable).

"F1 hybrid" plant (or F1 hybrid seed) is the generation obtained from crossing two inbred parent lines. Thus, F1 hybrid seeds are seeds from which F1 hybrid plants grow. F1 hybrids are more vigorous and higher yielding, due to heterosis. Inbred lines are essentially homozygous at most loci in the genome. A "plant line" or "breeding line" refers to a plant and its progeny. "F1", "F2", "F3", etc." refers to the consecutive related generations following a cross between two parent plants or parent lines. The plants grown from the seeds produced by crossing two plants or lines is called the F1 generation. Selfing the F1 plants results in the F2 generation, etc.

The term "allele(s)" means any of one or more alternative forms of a gene at a particular locus, all of which alleles relate to one trait or characteristic at a specific locus. In a diploid cell of an organism, alleles of a given gene are located at a specific location, or locus (loci plural), on a chromosome. One allele is present on each chromosome of the pair of homologous chromosomes. A diploid plant species may comprise a large number of different alleles at a particular locus. These may be identical alleles of the gene (homozygous) or two different alleles (heterozygous).

The term "locus" (loci plural) means a specific place or places or a site on a chromosome where for example a QTL, a gene or genetic marker is found.

The spontaneous (non-targeted) mutation rate for a single base pair is estimated to be $7 \times 10^{-9}$ per bp per generation. Assuming an estimated 30 replications per generation, this leads to an estimated spontaneous (non-targeted) mutation rate of $2 \times 10^{-10}$ mutations per base pair per replication event.

Tools and Methods for Multiplex Editing

CRISPR technology for editing the genes of eukaryotes is disclosed in U. S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U. S. Patent Application Publication 2016/0208243 A1. Other CRISPR nucleases useful for editing genomes include C2c1 and C2c3 (see Shmakov et al. (2015) Mol. Cell, 60:385-397) and CasX and CasY (see Burstein et al. (2016) *Nature, doi*:10.1038/nature21059). Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U. S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246).

CRISPR (Clustered Regularly Interspaced Short Palindromic Repeats)/Cas (CRISPR-associated) systems, or CRISPR systems, are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. In a typical CRISPR/Cas system, a Cas endonuclease is directed to a target nucleotide sequence (e. g., a site in the genome that is to be sequence-edited) by sequence-specific, non-coding "guide RNAs" that target single- or double-stranded DNA sequences. In microbial hosts, CRISPR loci encode both Cas endonucleases and "CRISPR arrays" of the non-coding RNA elements that determine the specificity of the CRISPR-mediated nucleic acid cleavage.

Three classes (I-III) of CRISPR systems have been identified across a wide range of bacterial hosts. The well characterized class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically a 20-nucleotide RNA sequence that corresponds to (i. e., is identical or nearly identical to, or alternatively is complementary or nearly complementary to) a 20-nucleotide target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence.

The target DNA sequence must generally be adjacent to a "protospacer adjacent motif" ("PAM") that is specific for a given Cas endonuclease; however, PAM sequences are short and relatively non-specific, appearing throughout a given genome. CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), 5'-NNGRRT or 5'-NNGRR (*Staphylococcus aureus* Cas9, SaCas9), and 5'-NNNGATT (*Neisseria meningitidis*). Some endonucleases, e. g., Cas9 endonucleases, are associated with G-rich PAM sites, e. g., 5'-NGG, and perform blunt-end cleaving of the target DNA at a location 3 nucleotides upstream from (5' from) the PAM site.

Another class II CRISPR system includes the type V endonuclease Cpf1, which is a smaller endonuclease than is Cas9; examples include AsCpf1 (from *Acidaminococcus* sp.) and LbCpf1 (from *Lachnospiraceae* sp.). Cpf1-associated CRISPR arrays are processed into mature crRNAs without the requirement of a tracrRNA; in other words, a Cpf1 system requires only the Cpf1 nuclease and a crRNA to cleave the target DNA sequence. Cpf1 endonucleases, are associated with T-rich PAM sites, e. g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e. g., Zetsche et al. (2015) Cell, 163:759-771. Other CRISPR nucleases useful in methods and compositions of the invention include C2c1 and C2c3 (see Shmakov et al. (2015) Mol. Cell, 60:385-397). Like other CRISPR nucleases, C2c1 from *Alicyclobacillus acidoterrestris* (AacC2c1; amino acid sequence with accession ID T0D7A2, deposited on-line at www[dot]ncbi[dot]nlm[dot]nih[dot]gov/protein/1076761101) requires a guide RNA and PAM recognition site; C2c1 cleavage results in a staggered seven-nucleotide DSB in the target DNA (see Yang et al. (2016) Cell, 167:1814-1828.e12) and is reported to have high mismatch sensitivity, thus reducing off-target effects (see Liu et al. (2016) Mol. Cell, available on line at dx[dot]doi[dot]org/10[dot]1016/j[dot]molcel[dot]2016[dot]11.040). Yet other CRISPR nucleases include nucleases identified from the genomes of uncultivated microbes, such as CasX and CasY (e. g., a CRISPR-associated protein CasY from an uncultured Parcubacteria group bacterium, amino acid sequence with accession ID APG80656, deposited on-line at www[dot]ncbi[dot]nlm[dot]nih[dot]gov/protein/APG80656.1]); see Burstein et al. (2016) Nature, doi: 10.1038/nature21059.

For the purposes of gene editing, CRISPR arrays can be designed to contain one or multiple guide RNA sequences corresponding to a desired target DNA sequence; see, for example, Cong et al. (2013) Science, 339:819-823; Ran et al. (2013) Nature Protocols, 8:2281-2308. At least 16 or 17 nucleotides of gRNA sequence are required by Cas9 for DNA cleavage to occur; for Cpf1 at least 16 nucleotides of gRNA sequence are needed to achieve detectable DNA cleavage and at least 18 nucleotides of gRNA sequence were reported necessary for efficient DNA cleavage in vitro; see Zetsche et al. (2015) Cell, 163:759-771. In practice, guide RNA sequences are generally designed to have a length of between 17-24 nucleotides (frequently 19, 20, or 21 nucleotides) and exact complementarity (i. e., perfect base-pairing) to the targeted gene or nucleic acid sequence; guide RNAs having less than 100% complementarity to the target sequence can be used (e. g., a gRNA with a length of 20 nucleotides and between 1-4 mismatches to the target sequence) but can increase the potential for off-target effects. The design of effective guide RNAs for use in plant genome editing is disclosed in U. S. Patent Application Publication 2015/0082478 A1, the entire specification of which is incorporated herein by reference. More recently, efficient gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing); see, for example, Cong et al. (2013) Science, 339:819-823; Xing et al. (2014) BMC Plant Biol., 14:327-340. Chemically modified sgRNAs have been demonstrated to be effective in genome editing; see, for example, Hendel et al. (2015) Nature Biotech., 985-991.

CRISPR-type genome editing has value in various aspects of agriculture research and development. CRISPR elements, i.e., CRISPR endonucleases and CRISPR single-guide RNAs, are useful in effecting genome editing without remnants of the CRISPR elements or selective genetic markers occurring in progeny. Alternatively, genome-inserted CRISPR elements are useful in plant lines adapted for multiplex genetic screening and breeding. For instance, a plant species can be created to express one or more of a CRISPR endonuclease such as a Cas9- or a Cpf1-type endonuclease or combinations with unique PAM recognition sites. Cpf1 endonuclease and corresponding guide RNAs and PAM sites are disclosed in U. S. Patent Application Publication 2016/0208243 A1, which is incorporated herein by reference for its disclosure of DNA encoding Cpf1 endonucleases and guide RNAs and PAM sites. Introduction of one or more of a wide variety of CRISPR guide RNAs that interact with CRISPR endonucleases integrated into a plant genome or otherwise provided to a plant is useful for genetic editing for providing desired phenotypes or traits, for trait screening, or for trait introgression. Multiple endonucleases can be provided in expression cassettes with the appropriate promoters to allow multiple genome editing in a spatially or temporally separated fashion in either in chromosome DNA or episome DNA.

Whereas wild-type Cas9 generates double-strand breaks (DSBs) at specific DNA sequences targeted by a gRNA, a number of CRISPR endonucleases having modified functionalities are available, for example: (1) a "nickase" version of Cas9 generates only a single-strand break; (2) a catalytically inactive Cas9 ("dCas9") does not cut the target DNA but interferes with transcription; (3) dCas9 on its own or fused to a repressor peptide can repress gene expression; (4) dCas9 fused to an activator peptide can activate or increase gene expression; (5) dCas9 fused to FokI nuclease ("dCas9-FokI") can be used to generate DSBs at target sequences homologous to two gRNAs; and (6) dCas9 fused to histone-modifying enzymes (e. g., histone acetyltransferases, histone methyltransferases, histone deacetylases, and histone demethylases) can be used to alter the epigenome in a site-specific manner, for example, by changing the methylation or acetylation status at a particular locus. See, e. g., the numerous CRISPR/Cas9 plasmids disclosed in and publicly available from the Addgene repository (Addgene, 75 Sidney St., Suite 550A, Cambridge, Mass. 02139; addgene[dot]org/crispr/). A "double nickase" Cas9 that introduces two separate double-strand breaks, each directed by a separate guide RNA, is described as achieving more accurate genome editing by Ran et al. (2013) *Cell,* 154:1380-1389.

In some embodiments, the methods of targeted modification described herein provide a means for avoiding unwanted epigenetic losses that can arise from tissue culturing modified plant cells (see, e.g., Stroud et al. *eLife* 2013; 2:e00354). Using the methods described herein in the absence of tissue culture, a loss of epigenetic marking may occur in less than 0.01% of the genome. This contrasts with results obtained with plants where tissue culture methods may result in losses of DNA methylation that occur, on average, as determined by bisulfate sequencing, at 1344 places that are on average 334 base pairs long, which means a loss of DNA methylation at an average of 0.1% of the genome (Stroud, 2013). In other words, the loss in marks using the targeted modification techniques described herein without tissue culture is 10 times lower than the loss observed when tissue culture techniques are relied on. In certain embodiments of the novel modified plant cells described herein, the modified plant cell or plant does not have significant losses of methylation compared to a non-modified parent plant cell or plant; in other words, the methylation pattern of the genome of the modified plant cell or plant is not greatly different from the methylation pattern of the genome of the parent plant cell or plant; in embodiments, the difference between the methylation pattern of the genome of the modified plant cell or plant and that of the parent plant cell or plant is less than 0.1%, 0.05%, 0.02%, or 0.01% of the genome, or less than 0.005% of the genome, or less than 0.001% of the genome (see, e. g., Stroud et al. (2013) eLife 2:e00354; doi:10.7554/eLife.0.00354).

CRISPR technology for editing the genes of eukaryotes is disclosed in U.S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U.S. Patent Application Publication 2016/0208243 A1. Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U.S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246). All of the patent publications referenced in this paragraph are incorporated herein by reference in their entirety.

In some embodiments, one or more vectors driving expression of one or more polynucleotides encoding elements of a genome-editing system (e. g., encoding a guide RNA or a nuclease) are introduced into a plant cell or a plant protoplast, whereby these elements, when expressed, result in alteration of a target nucleotide sequence. In embodiments, a vector comprises a regulatory element such as a promoter operably linked to one or more polynucleotides encoding elements of a genome-editing system. In such embodiments, expression of these polynucleotides can be controlled by selection of the appropriate promoter, particularly promoters functional in a plant cell; useful promoters include constitutive, conditional, inducible, and temporally or spatially specific promoters (e. g., a tissue specific promoter, a developmentally regulated promoter, or a cell cycle regulated promoter). In embodiments, the promoter is operably linked to nucleotide sequences encoding multiple guide RNAs, wherein the sequences encoding guide RNAs are separated by a cleavage site such as a nucleotide sequence encoding a microRNA recognition/cleavage site or a self-cleaving ribozyme (see, e. g., Ferré-D'Amaré and Scott (2014) *Cold Spring Harbor Perspectives Biol.,* 2:a003574). In embodiments, the promoter is a pol II promoter operably linked to a nucleotide sequence encoding one or more guide RNAs. In embodiments, the promoter operably linked to one or more polynucleotides encoding elements of a genome-editing system is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and a opaline synthase (NOS) and octapine synthase (OCS) promoter from *Agrobacterium tumefaciens*. In embodiments, the promoter operably linked to one or more polynucleotides encoding elements of a genome-editing system is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the nucleic acid targeting system to germline or reproductive cells (e. g., promoters of genes encoding DNA ligases, recombinases, replicases, or other genes specifically expressed in germline or reproductive cells); in such embodiments, the nuclease-mediated genetic modification (e. g., chromosomal or episomal double-stranded DNA cleavage) is limited only those cells from which DNA is inherited in subsequent generations, which is advantageous where it is desirable that expression of the genome-editing system be limited in order to avoid genotoxicity or other unwanted effects. All of the patent publications referenced in this paragraph are incorporated herein by reference in their entirety.

In some embodiments, elements of a genome-editing system (e.g., an RNA-guided nuclease and a guide RNA) are operably linked to separate regulatory elements on separate vectors. In other embodiments, two or more elements of a genome-editing system expressed from the same or different regulatory elements or promoters are combined in a single vector, optionally with one or more additional vectors providing any additional necessary elements of a genome-editing system not included in the first vector. For example, multiple guide RNAs can be expressed from one vector, with the appropriate RNA-guided nuclease expressed from a second vector. In another example, one or more vectors for the expression of one or more guide RNAs (e. g., crRNAs or sgRNAs) are delivered to a cell (e. g., a plant cell or a plant protoplast) that expresses the appropriate RNA-guided nuclease, or to a cell that otherwise contains the nuclease, such as by way of prior administration thereto of a vector for in vivo expression of the nuclease.

Genome-editing system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In embodiments, the endonuclease and the nucleic acid-targeting guide RNA may be operably linked to and expressed from the same promoter. In embodiments, a single promoter drives expression of a transcript encoding an endonuclease and the guide RNA, embedded within one or more intron sequences (e. g., each in a different intron, two or more in at least one intron, or all in a single intron), which can be plant-derived; such use of introns is especially contemplated when the expression vector is being transformed or transfected into a monocot plant cell or a monocot plant protoplast.

Expression vectors provided herein may contain a DNA segment near the 3' end of an expression cassette that acts as a signal to terminate transcription and directs polyadenylation of the resultant mRNA. Such a 3' element is commonly referred to as a "3'-untranslated region" or "3'-UTR" or a "polyadenylation signal". Useful 3' elements include: *Agrobacterium tumefaciens* nos 3', tml 3', tmr 3', tms 3', ocs 3', and tr7 3' elements disclosed in U.S. Pat. No. 6,090,627, incorporated herein by reference, and 3' elements from plant genes such as the heat shock protein 17, ubiquitin, and fructose-1,6-biphosphatase genes from wheat (*Triticum aestivum*), and the glutelin, lactate dehydrogenase, and beta-tubulin genes from rice (*Oryza sativa*), disclosed in U. S. Patent Application Publication 2002/0192813 A1, incorporated herein by reference.

In certain embodiments, a vector or an expression cassette includes additional components, e. g., a polynucleotide encoding a drug resistance or herbicide gene or a polynucleotide encoding a detectable marker such as green fluorescent protein (GFP) or beta-glucuronidase (gus) to allow convenient screening or selection of cells expressing the vector. In embodiments, the vector or expression cassette includes additional elements for improving delivery to a plant cell or plant protoplast or for directing or modifying expression of one or more genome-editing system elements, for example, fusing a sequence encoding a cell-penetrating peptide, localization signal, transit, or targeting peptide to the RNA-guided nuclease, or adding a nucleotide sequence to stabilize a guide RNA; such fusion proteins (and the polypeptides encoding such fusion proteins) or combination polypeptides, as well as expression cassettes and vectors for their expression in a cell, are specifically claimed. In embodiments, an RNA-guided nuclease (e. g., Cas9, Cpf1, CasY, CasX, C2c1, or C2c3) is fused to a localization signal, transit, or targeting peptide, e. g., a nuclear localization signal (NLS), a chloroplast transit peptide (CTP), or a mitochondrial targeting peptide (MTP); in a vector or an expression cassette, the nucleotide sequence encoding any of these can be located either 5' and/or 3' to the DNA encoding the nuclease. For example, a plant-codon-optimized Cas9 (pco-Cas9) from *Streptococcus pyogenes* and *S. thermophilus* containing nuclear localization signals and codon-optimized for expression in maize is disclosed in PCT/US2015/018104 (published as WO/2015/131101 and claiming priority to U.S. Provisional Patent Application 61/945,700), incorporated herein by reference. In another example, a chloroplast-targeting RNA is appended to the 5' end of an mRNA encoding an endonuclease to drive the accumulation of the mRNA in chloroplasts; see Gomez, et al. (2010) *Plant Signal Behav.*, 5: 1517-1519. In an embodiment, a Cas9 from *Streptococcus pyogenes* is fused to a nuclear localization signal (NLS), such as the NLS from SV40. In an embodiment, a Cas9 from *Streptococcus pyogenes* is fused to a cell-penetrating peptide (CPP), such as octa-arginine or nona-arginine or a homoarginine 12-mer oligopeptide, or a CPP disclosed in the database of cell-penetrating peptides CPPsite 2.0, publicly available at crdd[dot]osdd[dot]net/raghava/cppsite/. In an example, a Cas9 from *Streptococcus pyogenes* (which normally carries a net positive charge) is modified at the N-terminus with a negatively charged glutamate peptide "tag" and at the C-terminus with a nuclear localization signal (NLS); when mixed with cationic arginine gold nanoparticles (ArgNPs), self-assembled nanoassemblies were formed which were shown to provide good editing efficiency in human cells; see Mout et al. (2017) *ACS Nano*, doi:10.1021/acsnano.6b07600. In an embodiment, a Cas9 from *Streptococcus pyogenes* is fused to a chloroplast transit peptide (CTP) sequence. In embodiments, a CTP sequence is obtained from any nuclear gene that encodes a protein that targets a chloroplast, and the isolated or synthesized CTP DNA is appended to the 5' end of the DNA that encodes a nuclease targeted for use in a chloroplast. Chloroplast transit peptides and their use are described in U.S. Pat. Nos. 5,188,642, 5,728,925, and 8,420,888, all of which are incorporated herein by reference in their entirety. Specifically, the CTP nucleotide sequences provided with the sequence identifier (SEQ ID) numbers 12-15 and 17-22 of U.S. Pat. No. 8,420,888 are incorporated herein by reference. In an embodiment, a Cas9 from *Streptococcus pyogenes* is fused to a mitochondrial targeting peptide (MTP), such as a plant MTP sequence; see, e. g., Jores et al. (2016) *Nature Communications*, 7:12036-12051.

Plasmids designed for use in plants and encoding CRISPR genome editing elements (CRISPR nucleases and guide RNAs) are publicly available from plasmid repositories such as Addgene (Cambridge, Mass.; also see "addgene[dot]com") or can be designed using publicly disclosed sequences, e. g., sequences of CRISPR nucleases. In embodiments, such plasmids are used to co-express both CRISPR nuclease mRNA and guide RNA(s); in other embodiments, CRISPR endonuclease mRNA and guide RNA are encoded on separate plasmids. In embodiments, the plasmids are *Agrobacterium* TI plasmids. Materials and methods for preparing expression cassettes and vectors for CRISPR endonuclease and guide RNA for stably integrated and/or transient plant transformation are disclosed in PCT/US2015/018104 (published as WO/2015/131101 and claiming priority to U.S. Provisional Patent Application 61/945, 700), U. S. Patent Application Publication 2015/0082478 A1, and PCT/US2015/038767 (published as WO/2016/007347 and claiming priority to U.S. Provisional Patent Application 62/023,246), all of which are incorporated herein by reference in their entirety. In embodiments, such expression cassettes are isolated linear fragments, or are part of a larger construct that includes bacterial replication elements and selectable markers; such embodiments are useful, e. g., for particle bombardment or nanoparticle delivery or protoplast transformation. In embodiments, the expression cassette is adjacent to or located between T-DNA borders or contained within a binary vector, e. g., for Agrobacterium-mediated transformation. In embodiments, a plasmid encoding a CRISPR nuclease is delivered to cell (such as a plant cell or a plant protoplast) for stable integration of the CRISPR nuclease into the genome of cell, or alternatively for transient expression of the CRISPR nuclease. In embodiments, plasmids encoding a CRISPR nuclease are delivered to a plant cell or a plant protoplast to achieve stable or transient expression of the CRISPR nuclease, and one or multiple guide RNAs (such as a library of individual guide RNAs or multiple pooled guide RNAs) or plasmids encoding the guide RNAs are delivered to the plant cell or plant protoplast individually or in combinations, thus providing libraries or arrays of plant cells or plant protoplasts (or of plant callus or whole plants derived therefrom), in which a variety of genome edits are provided by the different guide RNAs. A pool or arrayed collection of diverse modified plant cells comprising subsets of targeted modifications (e.g., a collection of plant cells or plants where some plants are homozygous and some are heterozygous for one, two, three or more targeted modifications) can be compared to determine the function of modified sequences (e.g., mutated or deleted sequences or genes) or the function of sequences being inserted. In other words, the methods and tools described herein can be used to perform "reverse genetics."

In certain embodiments where the genome-editing system is a CRISPR system, expression of the guide RNA is driven by a plant U6 spliceosomal RNA promoter, which can be native to the genome of the plant cell or from a different species, e. g., a U6 promoter from maize, tomato, or soybean such as those disclosed in PCT/US2015/018104 (published as WO 2015/131101 and claiming priority to U.S. Provisional Patent Application 61/945,700), incorporated herein by reference, or a homologue thereof; such a promoter is operably linked to DNA encoding the guide RNA for directing an endonuclease, followed by a suitable 3' element such as a U6 poly-T terminator. In another embodiment, an expression cassette for expressing guide RNAs in plants is used, wherein the promoter is a plant U3, 7SL (signal recognition particle RNA), U2, or U5 promoter, or chimerics thereof, e. g., as described in PCT/US2015/018104 (published as WO 2015/131101 and claiming priority to U.S. Provisional Patent Application 61/945,700), incorporated herein by reference. When multiple or different guide RNA sequences are used, a single expression construct may be used to correspondingly direct the genome editing activity to the multiple or different target sequences in a cell, such a plant cell or a plant protoplast. In various embodiments, a single vector includes 1, 2, 3, 4, 5, 6, 7, 8, 9, 10, about 15, about 20, or more guide RNA sequences; in other embodiments, 1, 2, 3, 4, 5, 6, 7, 8, 9, 10, about 15, about 20, or more guide RNA sequences are provided on multiple vectors, which can be delivered to one or multiple plant cells or plant protoplasts (e. g., delivered to an array of plant cells or plant protoplasts, or to a pooled population of plant cells or plant protoplasts).

In embodiments, one or more guide RNAs and the corresponding RNA-guided nuclease are delivered together or simultaneously. In other embodiments, one or more guide RNAs and the corresponding RNA-guided nuclease are delivered separately; these can be delivered in separate, discrete steps and using the same or different delivery techniques. In an example, an RNA-guided nuclease is delivered to a cell (such as a plant cell or plant protoplast) by particle bombardment, on carbon nanotubes, or by Agrobacterium-mediated transformation, and one or more guide RNAs is delivered to the cell in a separate step using the same or different delivery technique. In embodiments, an RNA-guided nuclease encoded by a DNA molecule or an mRNA is delivered to a cell with enough time prior to delivery of the guide RNA to permit expression of the nuclease in the cell; for example, an RNA-guided nuclease encoded by a DNA molecule or an mRNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) prior to the delivery of the guide RNA to the plant cell or plant protoplast. In embodiments, whether the RNA-guided nuclease is delivered simultaneously with or separately from an initial dose of guide RNA, succeeding "booster" doses of guide RNA are delivered subsequent to the delivery of the initial dose; for example, a second "booster" dose of guide RNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) subsequent to the delivery of the initial dose of guide RNA to the plant cell or plant protoplast. Similarly, in some embodiments, multiple deliveries of an RNA-guided nuclease or of a DNA molecule or an mRNA encoding an RNA-guided nuclease are used to increase efficiency of the genome modification.

In embodiments, the desired genome modification involves non-homologous recombination, in this case non-homologous end-joining of genomic sequence across one or more introduced double-strand breaks; generally, such embodiments do not require a donor template having homology "arms" (regions of homologous or complimentary sequence to genomic sequence flanking the site of the DSB). In various embodiments described herein, donor polynucleotides encoding sequences for targeted insertion at double-stranded breaks are single-stranded polynucleotides comprising RNA or DNA or both types of nucleotides; or the donor polynucleotides are at least partially double-stranded and comprise RNA, DNA or both types of nucleotides. Other modified nucleotides may also be used.

In other embodiments, the desired genome modification involves homologous recombination, wherein one or more double-stranded DNA break in the target nucleotide sequence is generated by the RNA-guided nuclease and guide RNA(s), followed by repair of the break(s) using a homologous recombination mechanism ("homology-directed repair"). In such embodiments, a donor template that encodes the desired nucleotide sequence to be inserted or knocked-in at the double-stranded break and generally having homology "arms" (regions of homologous or complimentary sequence to genomic sequence flanking the site of the DSB) is provided to the cell (such as a plant cell or plant protoplast); examples of suitable templates include single-stranded DNA templates and double-stranded DNA templates (e. g., in the form of a plasmid). In general, a donor template encoding a nucleotide change over a region of less than about 50 nucleotides is conveniently provided in the form of single-stranded DNA; larger donor templates (e. g., more than 100 nucleotides) are often conveniently provided as double-stranded DNA plasmids.

In certain embodiments directed to the targeted incorporation of sequences by homologous recombination, a donor template has a core nucleotide sequence that differs from the target nucleotide sequence (e. g., a homologous endogenous genomic region) by at least 1, at least 5, at least 10, at least 20, at least 30, at least 40, at least 50, or more nucleotides. This core sequence is flanked by "homology arms" or regions of high sequence identity with the targeted nucleotide sequence; in embodiments, the regions of high identity include at least 10, at least 50, at least 100, at least 150, at least 200, at least 300, at least 400, at least 500, at least 600, at least 750, or at least 1000 nucleotides on each side of the core sequence. In embodiments where the donor template is in the form of a single-stranded DNA, the core sequence is flanked by homology arms including at least 10, at least 20, at least 30, at least 40, at least 50, at least 60, at least 70, at least 80, or at least 100 nucleotides on each side of the core sequence. In embodiments where the donor template is in the form of a double-stranded DNA plasmid, the core sequence is flanked by homology arms including at least 500, at least 600, at least 700, at least 800, at least 900, or at least 1000 nucleotides on each side of the core sequence. In an embodiment, two separate double-strand breaks are introduced into the cell's target nucleotide sequence with a "double nickase" Cas9 (see Ran et al. (2013) Cell, 154: 1380-1389), followed by delivery of the donor template.

Delivery Methods and Agents

Aspects of the invention involve various treatments employed to deliver to a plant cell or protoplast a guide RNA (gRNA), such as a crRNA or sgRNA (or a polynucleotide encoding such), and/or a polynucleotide encoding a sequence for targeted insertion at a double-strand break in a genome. In embodiments, one or more treatments are employed to deliver the gRNA into a plant cell or plant protoplast, e. g., through barriers such as a cell wall or a plasma membrane or nuclear envelope or other lipid bilayer.

Unless otherwise stated, the various compositions and methods described herein for delivering guide RNAs and nucleases to a plant cell or protoplast are also generally useful for delivering donor polynucleotides to the cell. The delivery of donor polynucleotides can be simultaneous with, or separate from (generally after) delivery of the nuclease and guide RNA to the cell. For example, a donor polynucleotide can be transiently introduced into a plant cell or plant protoplast, optionally with the nuclease and/or gRNA; in certain embodiments, the donor template is provided to the plant cell or plant protoplast in a quantity that is sufficient to achieve the desired insertion of the donor polynucleotide sequence but donor polynucleotides do not persist in the plant cell or plant protoplast after a given period of time (e. g., after one or more cell division cycles).

In certain embodiments, a gRNA- or donor polynucleotide, in addition to other agents involved in targeted modifications, can be delivered to a plant cell or protoplast by directly contacting the plant cell or protoplast with a composition comprising the gRNA(s) or donor polynucleotide(s). For example, a gRNA-containing composition in the form of a liquid, a solution, a suspension, an emulsion, a reverse emulsion, a colloid, a dispersion, a gel, liposomes, micelles, an injectable material, an aerosol, a solid, a powder, a particulate, a nanoparticle, or a combination thereof can be applied directly to a plant cell (or plant part or tissue containing the plant cell) or plant protoplast (e. g., through abrasion or puncture or otherwise disruption of the cell wall or cell membrane, by spraying or dipping or soaking or otherwise directly contacting, or by microinjection). In certain embodiments, a plant cell (or plant part or tissue containing the plant cell) or plant protoplast is soaked in a liquid gRNA-containing composition, whereby the gRNA is delivered to the plant cell or plant protoplast. In embodiments, the gRNA-containing composition is delivered using negative or positive pressure, for example, using vacuum infiltration or application of hydrodynamic or fluid pressure. In embodiments, the gRNA-containing composition is introduced into a plant cell or plant protoplast, e. g., by microinjection or by disruption or deformation of the cell wall or cell membrane, for example by physical treatments such as by application of negative or positive pressure, shear forces, or treatment with a chemical or physical delivery agent such as surfactants, liposomes, or nanoparticles; see, e. g., delivery of materials to cells employing microfluidic flow through a cell-deforming constriction as described in US Published Patent Application 2014/0287509, incorporated by reference in its entirety herein. Other techniques useful for delivering the gRNA-containing composition to a plant cell or plant protoplast include: ultrasound or sonication; vibration, friction, shear stress, vortexing, cavitation; centrifugation or application of mechanical force; mechanical cell wall or cell membrane deformation or breakage; enzymatic cell wall or cell membrane breakage or permeabilization; abrasion or mechanical scarification (e. g., abrasion with carborundum or other particulate abrasive or scarification with a file or sandpaper) or chemical scarification (e. g., treatment with an acid or caustic agent); and electroporation. In embodiments, the gRNA-containing composition is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of the plant cell or plant protoplast with a polynucleotide encoding the gRNA; see, e. g., Broothaerts et al. (2005) *Nature*, 433:629-633. Any of these techniques or a combination thereof are alternatively employed on the plant part or tissue or intact plant (or seed) from which a plant cell or plant protoplast is optionally subsequently obtained or isolated; in embodiments, the gRNA-containing composition is delivered in a separate step after the plant cell or plant protoplast has been obtained or isolated.

In embodiments, a treatment employed in delivery of a gRNA to a plant cell or plant protoplast is carried out under a specific thermal regime, which can involve one or more appropriate temperatures, e. g., chilling or cold stress (exposure to temperatures below that at which normal plant growth occurs), or heating or heat stress (exposure to temperatures above that at which normal plant growth occurs), or treating at a combination of different temperatures. In embodiments, a specific thermal regime is carried out on the plant cell or plant protoplast, or on a plant or plant part from which a plant cell or plant protoplast is subsequently obtained or isolated, in one or more steps separate from the gRNA delivery.

In embodiments, a whole plant or plant part or seed, or an isolated plant cell or plant protoplast, or the plant or plant part from which a plant cell or plant protoplast is obtained or isolated, is treated with one or more delivery agents which can include at least one chemical, enzymatic, or physical agent, or a combination thereof. In embodiments, a gRNA-containing composition further includes one or more one chemical, enzymatic, or physical agent for delivery. In embodiments that further include the step of providing an RNA-guided nuclease or a polynucleotide that encodes the RNA-guided nuclease, a gRNA-containing composition including the RNA-guided nuclease or polynucleotide that encodes the RNA-guided nuclease further includes one or more one chemical, enzymatic, or physical agent for delivery. Treatment with the chemical, enzymatic or physical agent can be carried out simultaneously with the gRNA delivery, with the RNA-guided nuclease delivery, or in one or more separate steps that precede or follow the gRNA delivery or the RNA-guided nuclease delivery. In embodiments, a chemical, enzymatic, or physical agent, or a combination of these, is associated or complexed with the polynucleotide composition, with the gRNA or polynucleotide that encodes or is processed to the gRNA, or with the RNA-guided nuclease or polynucleotide that encodes the RNA-guided nuclease; examples of such associations or complexes include those involving non-covalent interactions (e. g., ionic or electrostatic interactions, hydrophobic or hydrophilic interactions, formation of liposomes, micelles, or other heterogeneous composition) and covalent interactions (e. g., peptide bonds, bonds formed using cross-linking agents). In non-limiting examples, a gRNA or polynucleotide that encodes or is processed to the gRNA is provided as a liposomal complex with a cationic lipid; a gRNA or polynucleotide that encodes or is processed to the gRNA is provided as a complex with a carbon nanotube; and an RNA-guided nuclease is provided as a fusion protein between the nuclease and a cell-penetrating peptide. Examples of agents useful for delivering a gRNA or polynucleotide that encodes or is processed to the gRNA or a nuclease or polynucleotide that encodes the nuclease include the various cationic liposomes and polymer nanoparticles reviewed by Zhang et al. (2007) *J. Controlled Release,* 123:1-10, and the cross-linked multilamellar liposomes described in U. S. Patent Application Publication 2014/0356414 A1, incorporated by reference in its entirety herein.

In embodiments, the chemical agent is at least one selected from the group consisting of:

(a) solvents (e. g., water, dimethylsulfoxide, dimethylformamide, acetonitrile, N-pyrrolidine, pyridine, hexamethylphosphoramide, alcohols, alkanes, alkenes, dioxanes, polyethylene glycol, and other solvents miscible or emulsifiable with water or that will dissolve phosphonucleotides in non-aqueous systems);

(b) fluorocarbons (e. g., perfluorodecalin, perfluoromethyldecalin);

(c) glycols or polyols (e. g., propylene glycol, polyethylene glycol);

(d) surfactants, including cationic surfactants, anionic surfactants, non-ionic surfactants, and amphiphilic surfactants, e. g., alkyl or aryl sulfates, phosphates, sulfonates, or carboxylates; primary, secondary, or tertiary amines; quaternary ammonium salts; sultaines, betaines; cationic lipids; phospholipids; tallowamine; bile acids such as cholic acid; long chain alcohols; organosilicone surfactants including nonionic organosilicone surfactants such as trisiloxane ethoxylate surfactants or a silicone polyether copolymer such as a copolymer of polyalkylene oxide modified heptamethyl trisiloxane and allyloxypolypropylene glycol methylether (commercially available as SILWET L77™ brand surfactant having CAS Number 27306-78-1 and EPA Number CAL. REG. NO. 5905-50073-AA, Momentive Performance Materials, Inc., Albany, N.Y.); specific examples of useful surfactants include sodium lauryl sulfate, the Tween series of surfactants, Triton-X100, Triton-X114, CHAPS and CHAPSO, Tergitol-type NP-40, Nonidet P-40;

(e) lipids, lipoproteins, lipopolysaccharides;

(f) acids, bases, caustic agents;

(g) peptides, proteins, or enzymes (e. g., cellulase, pectolyase, maceroenzyme, pectinase), including cell-penetrating or pore-forming peptides (e. g., (BO100)2K8, Genscript; poly-lysine, poly-arginine, or poly-homoarginine peptides; gamma zein, see U. S. Patent Application publication 2011/0247100, incorporated herein by reference in its entirety; transcription activator of human immunodeficiency virus type 1 ("HIV-1 Tat") and other Tat proteins, see, e. g., www[dot]lifetein[dot]com/Cell_Penetrating_Peptides[dot] html and Järver (2012) *Mol. Therapy—Nucleic Acids,* 1:e27, 1-17); octa-arginine or nona-arginine; poly-homoarginine (see Unnamalai et al. (2004) *FEBS Letters,* 566:307-310); see also the database of cell-penetrating peptides CPPsite 2.0 publicly available at crdd[dot]osdd[dot]net/raghava/cppsite/(h)

(h) RNase inhibitors;

(i) cationic branched or linear polymers such as chitosan, poly-lysine, DEAE-dextran, polyvinylpyrrolidone ("PVP"), or polyethylenimine ("PEI", e. g., PEI, branched, MW 25,000, CAS #9002-98-6; PEI, linear, MW 5000, CAS #9002-98-6; PEI linear, MW 2500, CAS #9002-98-6);

(j) dendrimers (see, e. g., U. S. Patent Application Publication 2011/0093982, incorporated herein by reference in its entirety);

(k) counter-ions, amines or polyamines (e. g., spermine, spermidine, putrescine), osmolytes, buffers, and salts (e. g., calcium phosphate, ammonium phosphate);

(l) polynucleotides (e. g., non-specific double-stranded DNA, salmon sperm DNA);

(m) transfection agents (e. g., Lipofectin®, Lipofectamine®, and Oligofectamine®, and Invivofectamine® (all from Thermo Fisher Scientific, Waltham, Mass.), PepFect (see Ezzat et al. (2011) *Nucleic Acids Res.,* 39:5284-5298), Transit® transfection reagents (Mirus Bio, LLC, Madison, Wis.), and poly-lysine, poly-homoarginine, and poly-arginine molecules including octo-arginine and nono-arginine as described in Lu et al. (2010) *J. Agric. Food Chem.,* 58:2288-2294);

(n) antibiotics, including non-specific DNA double-strand-break-inducing agents (e. g., phleomycin, bleomycin, talisomycin); and (o) antioxidants (e. g., glutathione, dithiothreitol, ascorbate).

In embodiments, the chemical agent is provided simultaneously with the gRNA (or polynucleotide encoding the gRNA or that is processed to the gRNA), for example, the polynucleotide composition including the gRNA further includes one or more chemical agent. In embodiments, the gRNA or polynucleotide encoding the gRNA or that is processed to the gRNA is covalently or non-covalently linked or complexed with one or more chemical agent; for example, the gRNA or polynucleotide encoding the gRNA or that is processed to the gRNA can be covalently linked to a peptide or protein (e. g., a cell-penetrating peptide or a pore-forming peptide) or non-covalently complexed with cationic lipids, polycations (e. g., polyamines), or cationic polymers (e. g., PEI). In embodiments, the gRNA or polynucleotide encoding the gRNA or that is processed to the gRNA is complexed with one or more chemical agents to form, e. g., a solution, liposome, micelle, emulsion, reverse emulsion, suspension, colloid, or gel.

In embodiments, the physical agent is at least one selected from the group consisting of particles or nanoparticles (e. g., particles or nanoparticles made of materials such as carbon, silicon, silicon carbide, gold, tungsten, polymers, or ceramics) in various size ranges and shapes, magnetic particles or nanoparticles (e. g., silenceMag Magnetotransfection™ agent, OZ Biosciences, San Diego, Calif.), abrasive or scarifying agents, needles or microneedles, matrices, and grids. In embodiments, particulates and nanoparticulates are useful in delivery of the polynucleotide composition or the nuclease or both. Useful particulates and nanoparticles include those made of metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylenedioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), and composites (e. g., polyvinylcarbazole/graphene, polystyrene/graphene, platinum/graphene, palladium/graphene nanocomposites). In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., polyethylene glycol, thiolated polyethylene glycol), polypeptides or proteins, and detectable labels (e. g., a fluorophore, an antigen, an antibody, or a quantum dot). In various embodiments, such particulates and nanoparticles are neutral, or carry a positive charge, or carry a negative charge. Embodiments of compositions including particulates include those formulated, e. g., as liquids, colloids, dispersions, suspensions, aerosols, gels, and solids. Embodiments include nanoparticles affixed to a surface or support, e. g., an array of carbon nanotubes vertically aligned on a silicon or copper wafer substrate. Embodiments include polynucleotide compositions including particulates (e. g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e. g., instruction manual for the Helios® Gene Gun System, Bio-Rad, Hercules, Calif.; Randolph-Anderson et al. (2015) "Sub-micron gold particles are superior to larger particles for efficient Biolistic® transformation of organelles and some cell types", Bio-Rad US/EG Bulletin 2015), but successful Biolistics delivery using larger (40 nanometer) nanoparticles has been reported in cultured animal cells; see O'Brian and Lummis (2011) *BMC Biotechnol.*, 11:66-71. Other embodiments of useful particulates are nanoparticles, which are generally in the nanometer (nm) size range or less than 1 micrometer, e. g., with a diameter of less than about 1 nm, less than about 3 nm, less than about 5 nm, less than about 10 nm, less than about 20 nm, less than about 40 nm, less than about 60 nm, less than about 80 nm, and less than about 100 nm. Specific, non-limiting embodiments of nanoparticles commercially available (all from Sigma-Aldrich Corp., St. Louis, Mo.) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e. g., with diameters of 0.7-1.1, 1.3-2.3, 0.7-0.9, or 0.7-1.3 nm, or with nanotube bundle dimensions of 2-10 nm by 1-5 micrometers, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include polynucleotide compositions including materials such as gold, silicon, cerium, or carbon, e. g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e. g., carbon nanotubes functionalized with amide, amino, carboxylic acid, sulfonic acid, or polyethylene glycol moeities), and graphene or graphene oxide or graphene complexes; see, for example, Wong et al. (2016) *Nano Lett.*, 16:1161-1172; Giraldo et al. (2014) *Nature Materials*, 13:400-409; Shen et al. (2012) *Theranostics*, 2:283-294; Kim et al. (2011) *Bioconjugate Chem.*, 22:2558-2567; Wang et al. (2010) *J Am. Chem. Soc. Comm.*, 132: 9274-9276; Zhao et al. (2016) *Nanoscale Res. Lett.*, 11:195-203; and Choi et al. (2016) *J. Controlled Release*, 235:222-235. See also, for example, the various types of particles and nanoparticles, their preparation, and methods for their use, e. g., in delivering polynucleotides and polypeptides to cells, disclosed in U. S. Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In embodiments wherein the gRNA (or polynucleotide encoding the gRNA) is provided in a composition that further includes an RNA-guided nuclease (or a polynucleotide that encodes the RNA-guided nuclease), or wherein the method further includes the step of providing an RNA-guided nuclease or a polynucleotide that encodes the RNA-guided nuclease, one or more one chemical, enzymatic, or physical agent can similarly be employed. In embodiments, the RNA-guided nuclease (or polynucleotide encoding the RNA-guided nuclease) is provided separately, e. g., in a separate composition including the RNA-guided nuclease or polynucleotide encoding the RNA-guided nuclease. Such compositions can include other chemical or physical agents (e. g., solvents, surfactants, proteins or enzymes, transfection agents, particulates or nanoparticulates), such as those described above as useful in the polynucleotide composition used to provide the gRNA. For example, porous silica nanoparticles are useful for delivering a DNA recombinase into maize cells; see, e. g., Martin-Ortigosa et al. (2015) *Plant Physiol.*, 164:537-547. In an embodiment, the polynucleotide composition includes a gRNA and Cas9 nuclease, and further includes a surfactant and a cell-penetrating peptide. In an embodiment, the polynucleotide composition includes a plasmid that encodes both an RNA-guided nuclease and at least on gRNA, and further includes a surfactant and carbon nanotubes. In an embodiment, the polynucleotide composition includes multiple gRNAs and an mRNA encoding the RNA-guided nuclease, and further includes gold particles, and the polynucleotide composition is delivered to a plant cell or plant protoplast by Biolistics.

In related embodiments, one or more one chemical, enzymatic, or physical agent can be used in one or more steps separate from (preceding or following) that in which the gRNA is provided. In an embodiment, the plant or plant part from which a plant cell or plant protoplast is obtained or isolated is treated with one or more one chemical, enzymatic, or physical agent in the process of obtaining or isolating the plant cell or plant protoplast. In embodiments, the plant or plant part is treated with an abrasive, a caustic agent, a surfactant such as Silwet L-77 or a cationic lipid, or an enzyme such as cellulase.

In embodiments, a gRNA is delivered to plant cells or plant protoplasts prepared or obtained from a plant, plant part, or plant tissue that has been treated with the polynucleotide compositions (and optionally the nuclease). In embodiments, one or more one chemical, enzymatic, or physical agent, separately or in combination with the polynucleotide composition, is provided/applied at a location in the plant or plant part other than the plant location, part, or tissue from which the plant cell or plant protoplast is obtained or isolated. In embodiments, the polynucleotide composition is applied to adjacent or distal cells or tissues and is transported (e. g., through the vascular system or by cell-to-cell movement) to the meristem from which plant cells or plant protoplasts are subsequently isolated. In embodiments, a gRNA-containing composition is applied by soaking a seed or seed fragment or zygotic or somatic embryo in the gRNA-containing composition, whereby the gRNA is delivered to the seed or seed fragment or zygotic or somatic embryo from which plant cells or plant protoplasts are subsequently isolated. In embodiments, a flower bud or shoot tip is contacted with a gRNA-containing composition, whereby the gRNA is delivered to cells in the flower bud or shoot tip from which plant cells or plant protoplasts are subsequently isolated. In embodiments, a gRNA-containing composition is applied to the surface of a plant or of a part of a plant (e. g., a leaf surface), whereby the gRNA is delivered to tissues of the plant from which plant cells or plant protoplasts are subsequently isolated. In embodiments a whole plant or plant tissue is subjected to particle- or nanoparticle-mediated delivery (e. g., Biolistics or carbon nanotube or nanoparticle delivery) of a gRNA-containing composition, whereby the gRNA is delivered to cells or tissues from which plant cells or plant protoplasts are subsequently isolated.

Methods of Modulating Expression of a Sequence of Interest in a Genome

In one aspect, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. The method permits site-specific integration of heterologous sequence at the site of at least one DSB, and thus at one or more locations in a genome, such as a genome of a plant cell. In embodiments, the genome is that of a nucleus, mitochondrion, or plastid in a plant cell.

By "integration of heterologous sequence" is meant integration or insertion of one or more nucleotides, resulting in a sequence (including the inserted nucleotide(s) as well as at least some adjacent nucleotides of the genomic sequence flanking the site of insertion at the DSB) that is heterologous, i. e., would not otherwise or does not normally occur at the site of insertion. (The term "heterologous" is also used to refer to a given sequence in relationship to another—e. g., the sequence of the polynucleotide donor molecule is heterologous to the sequence at the site of the DSB wherein the polynucleotide is integrated.)

The at least one DSB is introduced into the genome by any suitable technique; in embodiments one or more DSBs is introduced into the genome in a site- or sequence-specific manner, for example, by use of at least one of the group of DSB-inducing agents consisting of: (a) a nuclease capable of effecting site-specific alteration of a target nucleotide sequence, selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease. In embodiments, one or more DSBs is introduced into the genome by use of both a guide RNA (gRNA) and the corresponding RNA-guided nuclease. In an example, one or more DSBs is introduced into the genome by use of a ribonucleoprotein (RNP) that includes both a gRNA (e. g., a single-guide RNA or sgRNA that includes both a crRNA and a tracrRNA) and a Cas9. It is generally desirable that the sequence encoded by the polynucleotide donor molecule is integrated at the site of the DSB at high efficiency. One measure of efficiency is the percentage or fraction of the population of cells that have been treated with a DSB-inducing agent and polynucleotide donor molecule, and in which a sequence encoded by the polynucleotide donor molecule is successfully introduced at the DSB correctly located in the genome. The efficiency of genome editing including integration of a sequence encoded by a polynucleotide donor molecule at a DSB in the genome is assessed by any suitable method such as a heteroduplex cleavage assay or by sequencing, as described elsewhere in this disclosure. In various embodiments, the DSB is induced in the correct location in the genome at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the DSB is induced at the correct location in the genome). In various embodiments, a sequence encoded by the polynucleotide donor molecule is integrated at the site of the DSB at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the polynucleotide molecule is integrated at the site of the DSB in the correct location in the genome).

Apart from the CRISPR-type nucleases, other nucleases capable of effecting site-specific alteration of a target nucleotide sequence include zinc-finger nucleases (ZFNs), transcription activator-like effector nucleases (TAL-effector nucleases or TALENs), Argonaute proteins, and a meganuclease or engineered meganuclease. Zinc finger nucleases (ZFNs) are engineered proteins comprising a zinc finger DNA-binding domain fused to a nucleic acid cleavage domain, e. g., a nuclease. The zinc finger binding domains provide specificity and can be engineered to specifically recognize any desired target DNA sequence. For a review of the construction and use of ZFNs in plants and other organisms, see, e. g., Urnov et al. (2010) *Nature Rev. Genet.*, 11:636-646. The zinc finger DNA binding domains are derived from the DNA-binding domain of a large class of eukaryotic transcription factors called zinc finger proteins (ZFPs). The DNA-binding domain of ZFPs typically contains a tandem array of at least three zinc "fingers" each recognizing a specific triplet of DNA. A number of strategies can be used to design the binding specificity of the zinc finger binding domain. One approach, termed "modular assembly", relies on the functional autonomy of individual zinc fingers with DNA. In this approach, a given sequence is targeted by identifying zinc fingers for each component triplet in the sequence and linking them into a multifinger peptide. Several alternative strategies for designing zinc finger DNA binding domains have also been developed.

These methods are designed to accommodate the ability of zinc fingers to contact neighboring fingers as well as nucleotides bases outside their target triplet. Typically, the engineered zinc finger DNA binding domain has a novel binding specificity, compared to a naturally-occurring zinc finger protein. Modification methods include, for example, rational design and various types of selection. Rational design includes, for example, the use of databases of triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, e. g., U.S. Pat. Nos. 6,453,242 and 6,534,261, both incorporated herein by reference in their entirety. Exemplary selection methods (e. g., phage display and yeast two-hybrid systems) are well known and described in the literature. In addition, enhancement of binding specificity for zinc finger binding domains has been described in U.S. Pat. No. 6,794,136, incorporated herein by reference in its entirety. In addition, individual zinc finger domains may be linked together using any suitable linker sequences. Examples of linker sequences are publicly known, e. g., see U.S. Pat. Nos. 6,479,626; 6,903,185; and 7,153,949, incorporated herein by reference in their entirety. The nucleic acid cleavage domain is non-specific and is typically a restriction endonuclease, such as FokI. This endonuclease must dimerize to cleave DNA. Thus, cleavage by FokI as part of a ZFN requires two adjacent and independent binding events, which must occur in both the correct orientation and with appropriate spacing to permit dimer formation. The requirement for two DNA binding events enables more specific targeting of long and potentially unique recognition sites. FokI variants with enhanced activities have been described; see, e. g., Guo et al. (2010) *J. Mol. Biol.*, 400:96-107.

Transcription activator like effectors (TALEs) are proteins secreted by certain *Xanthomonas* species to modulate gene expression in host plants and to facilitate the colonization by and survival of the bacterium. TALEs act as transcription factors and modulate expression of resistance genes in the plants. Recent studies of TALEs have revealed the code linking the repetitive region of TALEs with their target DNA-binding sites. TALEs comprise a highly conserved and repetitive region consisting of tandem repeats of mostly 33 or 34 amino acid segments. The repeat monomers differ from each other mainly at amino acid positions 12 and 13. A strong correlation between unique pairs of amino acids at positions 12 and 13 and the corresponding nucleotide in the TALE-binding site has been found. The simple relationship between amino acid sequence and DNA recognition of the TALE binding domain allows for the design of DNA binding domains of any desired specificity. TALEs can be linked to a non-specific DNA cleavage domain to prepare genome editing proteins, referred to as TAL-effector nucleases or TALENs. As in the case of ZFNs, a restriction endonuclease, such as FokI, can be conveniently used. For a description of the use of TALENs in plants, see Mahfouz et al. (2011) *Proc. Natl. Acad. Sci. USA*, 108:2623-2628 and Mahfouz (2011) *GM Crops*, 2:99-103.

Argonauts are proteins that can function as sequence-specific endonucleases by binding a polynucleotide (e. g., a single-stranded DNA or single-stranded RNA) that includes sequence complementary to a target nucleotide sequence) that guides the Argonaut to the target nucleotide sequence and effects site-specific alteration of the target nucleotide sequence; see, e. g., U. S. Patent Application Publication 2015/0089681, incorporated herein by reference in its entirety.

Another method of effecting targeted changes to a genome is the use of triple-forming peptide nucleic acids (PNAs) designed to bind site-specifically to genomic DNA via strand invasion and the formation of PNA/DNA/PNA triplexes (via both Watson-Crick and Hoogsteen binding) with a displaced DNA strand. PNAs consist of a charge neutral peptide-like backbone and nucleobases. The nucleobases hybridize to DNA with high affinity. The triplexes then recruit the cell's endogenous DNA repair systems to initiate site-specific modification of the genome. The desired sequence modification is provided by single-stranded 'donor DNAs' which are co-delivered as templates for repair. See, e. g., Bahal R et al (2016) *Nature Communications*, Oct. 26, 2016.

In related embodiments, zinc finger nucleases, TALENs, and Argonautes are used in conjunction with other functional domains. For example, the nuclease activity of these nucleic acid targeting systems can be altered so that the enzyme binds to but does not cleave the DNA. Examples of functional domains include transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes; inhibitor of histone modifying enzymes, histone methyltransferases, histone demethylases, histone kinases, histone phosphatases, histone ribosylases, histone deribosylases, histone ubiquitinases, histone deubiquitinases, histone biotinases and histone tail proteases. Non-limiting examples of functional domains include a transcriptional activation domain, a transcription repression domain, and an SHH1, SUVH2, or SUVH9 polypeptide capable of reducing expression of a target nucleotide sequence via epigenetic modification; see, e. g., U. S. Patent Application Publication 2016/0017348, incorporated herein by reference in its entirety. Genomic DNA may also be modified via base editing using a fusion between a catalytically inactive Cas9 (dCas9) is fused to a cytidine deaminase which convert cytosine (C) to uridine (U), thereby effecting a C to T substitution; see Komor et al. (2016) *Nature,* 533:420-424.

In embodiments, the guide RNA (gRNA) has a sequence of between 16-24 nucleotides in length (e. g., 16, 17, 18, 19, 20, 21, 22, 23, or 24 nucleotides in length). Specific embodiments include gRNAs of 19, 20, or 21 nucleotides in length and having 100% complementarity to the target nucleotide sequence. In many embodiments the gRNA has exact complementarity (i. e., perfect base-pairing) to the target nucleotide sequence; in certain other embodiments the gRNA has less than 100% complementarity to the target nucleotide sequence. The design of effective gRNAs for use in plant genome editing is disclosed in U. S. Patent Application Publication 2015/0082478 A1, the entire specification of which is incorporated herein by reference. In embodiments where multiple gRNAs are employed, the multiple gRNAs can be delivered separately (as separate RNA molecules or encoded by separate DNA molecules) or in combination, e. g., as an RNA molecule containing multiple gRNA sequences, or as a DNA molecule encoding an RNA molecule containing multiple gRNA sequences; see, for example, U. S. Patent Application Publication 2016/0264981 A1, the entire specification of which is incorporated herein by reference, which discloses RNA molecules including multiple RNA sequences (such as gRNA sequences) separated by tRNA cleavage sequences. In other embodiments, a DNA molecule encodes multiple gRNAs which are separated by other types of cleavable transcript, for example, small RNA (e. g., miRNA, siRNA, or ta-siRNA) recognition sites which can be cleaved by the corresponding small RNA, or dsRNA-forming regions which can be cleaved by a Dicer-type ribonuclease, or sequences which are recognized by RNA nucleases such as Cys4 ribonuclease from *Pseudomonas aeruginosa*; see, e. g., U.S. Pat. No. 7,816,581, the entire specification of which is incorporated herein by reference, which discloses in FIG. 27 and elsewhere in the specification pol II promoter-driven DNA constructs encoding RNA transcripts that are released by cleavage. Efficient Cas9-mediated gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). In other embodiments, self-cleaving ribozyme sequences can be used to separate multiple gRNA sequences within a transcript.

Thus, in certain embodiments wherein the nuclease is a Cas9-type nuclease, the gRNA can be provided as a polynucleotide composition including: (a) a CRISPR RNA (crRNA) that includes the gRNA together with a separate tracrRNA, or (b) at least one polynucleotide that encodes a crRNA and a tracrRNA (on a single polynucleotide or on separate polynucleotides), or (c) at least one polynucleotide that is processed into one or more crRNAs and a tracrRNA. In other embodiments wherein the nuclease is a Cas9-type nuclease, the gRNA can be provided as a polynucleotide composition including a CRISPR RNA (crRNA) that includes the gRNA, and the required tracrRNA is provided in a separate composition or in a separate step, or is otherwise provided to the cell (for example, to a plant cell or plant protoplast that stably or transiently expresses the tracrRNA from a polynucleotide encoding the tracrRNA). In other embodiments wherein the nuclease is a Cas9-type nuclease, the gRNA can be provided as a polynucleotide composition comprising: (a) a single guide RNA (sgRNA) that includes the gRNA, or (b) a polynucleotide that encodes a sgRNA, or (c) a polynucleotide that is processed into a sgRNA. Cpf1-mediated gene editing does not require a tracrRNA; thus, in embodiments wherein the nuclease is a Cpf1-type nuclease, the gRNA is provided as a polynucleotide composition comprising (a) a CRISPR RNA (crRNA) that includes the gRNA, or (b) a polynucleotide that encodes a crRNA, or (c) a polynucleotide that is processed into a crRNA. In embodiments, the gRNA-containing composition optionally includes an RNA-guided nuclease, or a polynucleotide that encodes the RNA-guided nuclease. In other embodiments, an RNA-guided nuclease or a polynucleotide that encodes the RNA-guided nuclease is provided in a separate step. In some embodiments of the method, a gRNA is provided to a cell (e. g., a plant cell or plant protoplast) that includes an RNA-guided nuclease or a polynucleotide that encodes an RNA-guided nuclease, e. g., an RNA-guided nuclease selected from the group consisting of an RNA-guided DNA endonuclease, a type II Cas nuclease, a Cas9, a type V Cas nuclease, a Cpf1, a CasY, a CasX, a C2c1, a C2c3, an engineered RNA-guided nuclease, and a codon-optimized RNA-guided nuclease; in an example, the cell (e. g., a plant cell or plant protoplast) stably or transiently expresses the RNA-guided nuclease. In embodiments, the polynucleotide that encodes the RNA-guided nuclease is, for example, DNA that encodes the RNA-guided nuclease and is stably integrated in the genome of a plant cell or plant protoplast, DNA or RNA that encodes the RNA-guided nuclease and is transiently present in or introduced into a plant cell or plant protoplast; such DNA or RNA can be introduced, e. g., by using a vector such as a plasmid or viral vector or as an mRNA, or as vector-less DNA or RNA introduced directly into a plant cell or plant protoplast.

In embodiments that further include the step of providing to a cell (e. g., a plant cell or plant protoplast) an RNA-guided nuclease or a polynucleotide that encodes the RNA-guided nuclease, the RNA-guided nuclease is provided simultaneously with the gRNA-containing composition, or in a separate step that precedes or follows the step of providing the gRNA-containing composition. In embodiments, the gRNA-containing composition further includes an RNA-guided nuclease or a polynucleotide that encodes the RNA-guided nuclease. In other embodiments, there is provided a separate composition that includes an RNA-guided nuclease or a polynucleotide that encodes the RNA-guided nuclease. In embodiments, the RNA-guided nuclease is provided as a ribonucleoprotein (RNP) complex, e. g., a preassembled RNP that includes the RNA-guided nuclease complexed with a polynucleotide including the gRNA or encoding a gRNA, or a preassembled RNP that includes a polynucleotide that encodes the RNA-guided nuclease (and optionally encodes the gRNA, or is provided with a separate polynucleotide including the gRNA or encoding a gRNA), complexed with a protein. In embodiments, the RNA-guided nuclease is a fusion protein, i. e., wherein the RNA-guided nuclease (e. g., Cas9, Cpf1, CasY, CasX, C2c1, or C2c3) is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In embodiments, the RNA-guided nuclease or a polynucleotide that encodes the RNA-guided nuclease is provided as a complex with a cell-penetrating peptide or other transfecting agent. In embodiments, the RNA-guided nuclease or a polynucleotide that encodes the RNA-guided nuclease is complexed with, or covalently or non-covalently bound to, a further element, e. g., a carrier molecule, an antibody, an antigen, a viral movement protein, a polymer, a detectable label (e. g., a moiety detectable by fluorescence, radioactivity, or enzymatic or immunochemical reaction), a quantum dot, or a particulate or nanoparticulate. In embodiments, the RNA-guided nuclease or a polynucleotide that encodes the RNA-guided nuclease is provided in a solution, or is provided in a liposome, micelle, emulsion, reverse emulsion, suspension, or other mixed-phase composition.

An RNA-guided nuclease can be provided to a cell (e. g., a plant cell or plant protoplast) by any suitable technique. In embodiments, the RNA-guided nuclease is provided by directly contacting a plant cell or plant protoplast with the RNA-guided nuclease or the polynucleotide that encodes the RNA-guided nuclease. In embodiments, the RNA-guided nuclease is provided by transporting the RNA-guided nuclease or a polynucleotide that encodes the RNA-guided nuclease into a plant cell or plant protoplast using a chemical, enzymatic, or physical agent as provided in detail in the paragraphs following the heading "Delivery Methods and Delivery Agents". In embodiments, the RNA-guided nuclease is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of a plant cell or plant protoplast with a polynucleotide encoding the RNA-guided nuclease; see, e. g., Broothaerts et al. (2005) *Nature*, 433:629-633. In an embodiment, the RNA-guided nuclease is provided by transcription in a plant cell or plant protoplast of a DNA that encodes the RNA-guided nuclease and is stably integrated in the genome of the plant cell or plant protoplast or that is provided to the plant cell or plant protoplast in the form of a plasmid or expression vector (e. g., a viral vector) that encodes the RNA-guided nuclease (and optionally encodes one or more gRNAs, crRNAs, or sgRNAs, or is optionally provided with a separate plasmid or vector that encodes one or more gRNAs, crRNAs, or sgRNAs). In embodiments, the RNA-guided nuclease is provided to the plant cell or plant protoplast as a polynucleotide that encodes the RNA-guided nuclease, e. g., in the form of an mRNA encoding the nuclease.

Where a polynucleotide is concerned (e. g., a crRNA that includes the gRNA together with a separate tracrRNA, or a crRNA and a tracrRNA encoded on a single polynucleotide or on separate polynucleotides, or at least one polynucleotide that is processed into one or more crRNAs and a tracrRNA, or a sgRNA that includes the gRNA, or a polynucleotide that encodes a sgRNA, or a polynucleotide that is processed into a sgRNA, or a polynucleotide that encodes the RNA-guided nuclease), embodiments of the polynucleotide include: (a) double-stranded RNA; (b) single-stranded RNA; (c) chemically modified RNA; (d) double-stranded DNA; (e) single-stranded DNA; (f) chemically modified DNA; or (g) a combination of (a)-(f). Where expression of a polynucleotide is involved (e. g., expression of a crRNA from a DNA encoding the crRNA, or expression and translation of a RNA-guided nuclease from a DNA encoding the nuclease), in some embodiments it is sufficient that expression be transient, i. e., not necessarily permanent or stable in the cell. Certain embodiments of the polynucleotide further include additional nucleotide sequences that provide useful functionality; non-limiting examples of such additional nucleotide sequences include an aptamer or riboswitch sequence, nucleotide sequence that provides secondary structure such as stem-loops or that provides a sequence-specific site for an enzyme (e. g., a sequence-specific recombinase or endonuclease site), T-DNA (e. g., DNA sequence encoding a gRNA, crRNA, tracrRNA, or sgRNA is enclosed between left and right T-DNA borders from *Agrobacterium* spp. or from other bacteria that infect or induce tumours in plants), a DNA nuclear-targeting sequence, a regulatory sequence such as a promoter sequence, and a transcript-stabilizing sequence. Certain embodiments of the polynucleotide include those wherein the polynucleotide is complexed with, or covalently or non-covalently bound to, a non-nucleic acid element, e. g., a carrier molecule, an antibody, an antigen, a viral movement protein, a cell-penetrating or pore-forming peptide, a polymer, a detectable label, a quantum dot, or a particulate or nanoparticulate.

In embodiments, the at least one DSB is introduced into the genome by at least one treatment selected from the group consisting of: (a) bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection with a DSB-inducing agent; (b) Biolistics or particle bombardment with a DSB-inducing agent; (c) treatment with at least one chemical, enzymatic, or physical agent as provided in detail in the paragraphs following the heading "Delivery Methods and Delivery Agents"; and (d) application of heat or cold, ultrasonication, centrifugation, positive or negative pressure, cell wall or membrane disruption or deformation, or electroporation. It is generally desirable that introduction of the at least one DSB into the genome (i. e., the "editing" of the genome) is achieved with sufficient efficiency and accuracy to ensure practical utility. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. Accuracy is indicated by the absence of, or minimal occurrence of, off-target introduction of a DSB (i. e., at other than the intended site in the genome).

The location where the at least one DSB is inserted varies according to the desired result, for example whether the intention is to simply disrupt expression of the sequence of interest, or to add functionality (such as placing expression of the sequence of interest under inducible control). Thus, the location of the DSB is not necessarily within or directly adjacent to the sequence of interest. In embodiments, the at least one DSB in a genome is located: (a) within the sequence of interest, (b) upstream of (i. e., 5' to) the sequence of interest, or (c) downstream of (i. e., 3' to) the sequence of interest. In embodiments, a sequence encoded by the polynucleotide (such as a double-stranded DNA, a single-stranded DNA, a single-stranded DNA/RNA hybrid, or a double-stranded DNA/RNA hybrid) donor molecule, when integrated into the genome, is functionally or operably linked (e. g., linked in a manner that modifies the transcription or the translation of the sequence of interest or that modifies the stability of a transcript including that of the sequence of interest) to the sequence of interest. In embodiments, a sequence encoded by the polynucleotide donor molecule is integrated at a location 5' to and operably linked to the sequence of interest, wherein the integration location is selected to provide a specifically modulated (upregulated or downregulated) level of expression of the sequence of interest. For example, a sequence encoded by the polynucleotide donor molecule is integrated at a specific location in the promoter region of a protein-encoding gene that results in a desired expression level of the protein; in an embodiment, the appropriate location is determined empirically by integrating a sequence encoded by the polynucleotide donor molecule at about 50, about 100, about 150, about 200, about 250, about 300, about 350, about 400, about 450, and about 500 nucleotides 5' to (upstream of) the start codon of the coding sequence, and observing the relative expression levels of the protein for each integration location.

In embodiments, the donor polynucleotide sequence of interest includes coding (protein-coding) sequence, non-coding (non-protein-coding) sequence, or a combination of coding and non-coding sequence. Embodiments include a plant nuclear sequence, a plant plastid sequence, a plant mitochondrial sequence, a sequence of a symbiont, pest, or pathogen of a plant, and combinations thereof. Embodiments include exons, introns, regulatory sequences including promoters, other 5' elements and 3' elements, and genomic loci encoding non-coding RNAs including long non-coding RNAs (lncRNAs), microRNAs (miRNAs), and trans-acting siRNAs (ta-siRNAs). In embodiments, multiple sequences are altered, for example, by delivery of multiple gRNAs to the plant cell or plant protoplast; the multiple sequences can be part of the same gene (e. g., different locations in a single coding region or in different exons or introns of a protein-coding gene) or different genes. In embodiments, the sequence of an endogenous genomic locus is altered to delete, add, or modify a functional non-coding sequence; in non-limiting examples, such functional non-coding sequences include, e. g., a miRNA, siRNA, or ta-siRNA recognition or cleavage site, a splice site, a recombinase recognition site, a transcription factor binding site, or a transcriptional or translational enhancer or repressor sequence.

In embodiments, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of two or more DSBs in a genome. In embodiments, the sequence of the polynucleotide donor molecule that is integrated into each of the two or more DSBs is (a) identical, or (b) different, for each of the DSBs. In embodiments, the change in expression of a sequence of interest in genome is manifested as the expression of an altered or edited sequence of interest; in non-limiting examples, the method is used to integrate sequence-specific recombinase recognition site sequences at two DSBs in a genome, whereby, in the presence of the corresponding site-specific DNA recombinase, the genomic sequence flanked on either side by the integrated recombinase recognition sites is excised from the genome (or in some instances is inverted); such an approach is useful, e. g., for deletion of larger lengths of genomic sequence, for example, deletion of all or part of an exon or of one or more protein domains. In other embodiments, at least two DSBs are introduced into a genome by one or more nucleases in such a way that genomic sequence is deleted between the DSBs (leaving a deletion with blunt ends, overhangs or a combination of a blunt end and an overhang), and a sequence encoded by at least one polynucleotide donor molecule is integrated between the DSBs (i. e., a sequence encoded by at least one individual polynucleotide donor molecule is integrated at the location of the deleted genomic sequence), wherein the genomic sequence that is deleted is coding sequence, non-coding sequence, or a combination of coding and non-coding sequence; such embodiments provide the advantage of not requiring a specific PAM site at or very near the location of a region wherein a nucleotide sequence change is desired. In an embodiment, at least two DSBs are introduced into a genome by one or more nucleases in such a way that genomic sequence is deleted between the DSBs (leaving a deletion with blunt ends, overhangs or a combination of a blunt end and an overhang), and at least one sequence encoded by a polynucleotide donor molecule is integrated between the DSBs (i. e., at least one individual sequence encoded by a polynucleotide donor molecule is integrated at the location of the deleted genomic sequence). In an embodiment, two DSBs are introduced into a genome, resulting in excision or deletion of genomic sequence between the sites of the two DSBs, and a sequence encoded by a polynucleotide donor molecule integrated into the genome at the location of the deleted genomic sequence (that is, a sequence encoded by an individual polynucleotide donor molecule is integrated between the two DSBs). Generally, the polynucleotide donor molecule with the sequence to be integrated into the genome is selected in terms of the presence or absence of terminal overhangs to match the type of DSBs introduced. In an embodiment, two blunt-ended DSBs are introduced into a genome, resulting in excision or deletion of genomic sequence between the sites of the two blunt-ended DSBs, and a sequence encoded by a blunt-ended double-stranded DNA or blunt-ended double-stranded DNA/RNA hybrid or a single-stranded DNA or a single-stranded DNA/RNA hybrid donor molecule is integrated into the genome between the two blunt-ended DSBs. In another embodiment, two DSBs are introduced into a genome, wherein the first DSB is blunt-ended and the second DSB has an overhang, resulting in deletion of genomic sequence between the two DSBs, and a sequence encoded by a double-stranded DNA or double-stranded DNA/RNA hybrid donor molecule that is blunt-ended at one terminus and that has an overhang on the other terminus (or, alternatively, a single-stranded DNA or a single-stranded DNA/RNA hybrid molecule) is integrated into the genome between the two DSBs; in an alternative embodiment, two DSBs are introduced into a genome, wherein both DSBs have overhangs but of different overhang lengths (different number of unpaired nucleotides), resulting in deletion of genomic sequence between the two DSBs, and a sequence encoded by a double-stranded DNA or double-stranded DNA/RNA hybrid donor molecule that has overhangs at each terminus, wherein the overhangs are of unequal lengths (or, alternatively, a single-stranded DNA or a single-stranded DNA/RNA hybrid donor molecule), is integrated into the genome between the two DSBs; embodiments with such DSB asymmetry (i. e., a combination of DSBs having a blunt end and an overhang, or a combination of DSBs having overhangs of unequal lengths) provide the opportunity for controlling directionality or orientation of the inserted polynucleotide, e. g., by selecting a double-stranded DNA or double-stranded DNA/RNA hybrid donor molecule having one blunt end and one terminus with unpaired nucleotides, such that the polynucleotide is integrated preferably in one orientations. In another embodiment, two DSBs, each having an overhang, are introduced into a genome, resulting in excision or deletion of genomic sequence between the sites of the two DSBs, and a sequence encoded by a double-stranded DNA or double-stranded DNA/RNA hybrid donor molecule that has an overhang at each terminus (or, alternatively, a single-stranded DNA or a single-stranded DNA/RNA hybrid donor molecule) is integrated into the genome between the two DSBs. The length of genomic sequence that is deleted between two DSBs and the length of a sequence encoded by the polynucleotide donor molecule that is integrated in place of the deleted genomic sequence can be, but need not be equal. In embodiments, the distance between any two DSBs (or the length of the genomic sequence that is to be deleted) is at least 10, at least 15, at least 20, at least 25, at least 30, at least 40, at least 50, at least 60, at least 70, at least 80, or at least 100 nucleotides; in other embodiments the distance between any two DSBs (or the length of the genomic sequence that is to be deleted) is at least 100, at least 150, at least 200, at least 300, at least 400, at least 500, at least 600, at least 750, or at least 1000 nucleotides. In embodiments where more than two DSBs are introduced into genomic sequence, it is possible to effect different deletions of genomic sequence (for example, where three DSBs are introduced, genomic sequence can be deleted between the first and second DSBs, between the first and third DSBs, and between the second and third DSBs). In some embodiments, a sequence encoded by more than one polynucleotide donor molecule (e. g., multiple copies of a sequence encoded by a polynucleotide donor molecule having a given sequence, or multiple sequences encoded by polynucleotide donor molecules with two or more different sequences) is integrated into the genome. For example, different sequences encoded by individual polynucleotide donor molecules can be individually integrated at a single locus where genomic sequence has been deleted between two DSBs, or at multiple locations where genomic sequence has been deleted (e. g., where more than two DSBs have been introduced into the genome). In embodiments, at least one exon is replaced by integrating a sequence encoded by at least one polynucleotide molecule where genomic sequence is deleted between DSBs that were introduced by at least one sequence-specific nuclease into intronic sequence flanking the at least one exon; an advantage of this approach over an otherwise similar method (i. e., differing by having the DSBs introduced into coding sequence instead of intronic sequence) is the avoidance of inaccuracies (nucleotide changes, deletions, or additions at the nuclease cleavage sites) in the resulting exon sequence or messenger RNA.

In embodiments, the methods described herein are used to delete or replace genomic sequence, which can be a relatively large sequence (e. g., all or part of at least one exon or of a protein domain) resulting in the equivalent of an alternatively spliced transcript. Additional related aspects include compositions and reaction mixtures including a plant cell or a plant protoplast and at least two guide RNAs, wherein each guide RNA is designed to effect a DSB in intronic sequence flanking at least one exon; such compositions and reaction mixtures optionally include at least one sequence-specific nuclease capable of being guided by at least one of the guide RNAs to effect a DSB in genomic sequence, and optionally include a polynucleotide donor molecule that is capable of being integrated (or having its sequence integrated) into the genome at the location of at least one DSB or at the location of genomic sequence that is deleted between the DSBs.

Donor Polynucleotide Molecules:

Embodiments of the polynucleotide donor molecule having a sequence that is integrated at the site of at least one double-strand break (DSB) in a genome include double-stranded DNA, a single-stranded DNA, a single-stranded DNA/RNA hybrid, and a double-stranded DNA/RNA hybrid. In embodiments, a polynucleotide donor molecule that is a double-stranded (e. g., a dsDNA or dsDNA/RNA hybrid) molecule is provided directly to the plant protoplast or plant cell in the form of a double-stranded DNA or a double-stranded DNA/RNA hybrid, or as two single-stranded DNA (ssDNA) molecules that are capable of hybridizing to form dsDNA, or as a single-stranded DNA molecule and a single-stranded RNA (ssRNA) molecule that are capable of hybridizing to form a double-stranded DNA/RNA hybrid; that is to say, the double-stranded polynucleotide molecule is not provided indirectly, for example, by expression in the cell of a dsDNA encoded by a plasmid or other vector. In various non-limiting embodiments of the method, the polynucleotide donor molecule that is integrated (or that has a sequence that is integrated) at the site of at least one double-strand break (DSB) in a genome is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the DSB in the genome has no unpaired nucleotides at the cleavage site, and the polynucleotide donor molecule that is integrated (or that has a sequence that is integrated) at the site of the DSB is a blunt-ended double-stranded DNA or blunt-ended double-stranded DNA/RNA hybrid molecule, or alternatively is a single-stranded DNA or a single-stranded DNA/RNA hybrid molecule. In another embodiment, the DSB in the genome has one or more unpaired nucleotides at one or both sides of the cleavage site, and the polynucleotide donor molecule that is integrated (or that has a sequence that is integrated) at the site of the DSB is a double-stranded DNA or double-stranded DNA/RNA hybrid molecule with an overhang or "sticky end" consisting of unpaired nucleotides at one or both termini, or alternatively is a single-stranded DNA or a single-stranded DNA/RNA hybrid molecule; in embodiments, the polynucleotide donor molecule DSB is a double-stranded DNA or double-stranded DNA/RNA hybrid molecule that includes an overhang at one or at both termini, wherein the overhang consists of the same number of unpaired nucleotides as the number of unpaired nucleotides created at the site of a DSB by a nuclease that cuts in an off-set fashion (e. g., where a Cpf1 nuclease effects an off-set DSB with 5-nucleotide overhangs in the genomic sequence, the polynucleotide donor molecule that is to be integrated (or that has a sequence that is to be integrated) at the site of the DSB is double-stranded and has 5 unpaired nucleotides at one or both termini). Generally, one or both termini of the polynucleotide donor molecule contain no regions of sequence homology (identity or complementarity) to genomic regions flanking the DSB; that is to say, one or both termini of the polynucleotide donor molecule contain no regions of sequence that is sufficiently complementary to permit hybridization to genomic regions immediately adjacent to the location of the DSB. In embodiments, the polynucleotide donor molecule contains no homology to the locus of the DSB, that is to say, the polynucleotide donor molecule contains no nucleotide sequence that is sufficiently complementary to permit hybridization to genomic regions immediately adjacent to the location of the DSB. In an embodiment, the polynucleotide donor molecule that is integrated at the site of at least one double-strand break (DSB) includes between 2-20 nucleotides in one (if single-stranded) or in both strands (if double-stranded), e. g., 2, 3, 4, 5, 6, 7, 8, 9, 10, 11, 12, 13, 14, 15, 16, 17, 18, 19, or 20 nucleotides on one or on both strands, each of which can be base-paired to a nucleotide on the opposite strand (in the case of a perfectly base-paired double-stranded polynucleotide molecule). In embodiments, the polynucleotide donor molecule is at least partially double-stranded and includes 2-20 base-pairs, e. g., 2, 3, 4, 5, 6, 7, 8, 9, 10, 11, 12, 13, 14, 15, 16, 17, 18, 19, or 20 base-pairs; in embodiments, the polynucleotide donor molecule is double-stranded and blunt-ended and consists of 2-20 base-pairs, e. g., 2, 3, 4, 5, 6, 7, 8, 9, 10, 11, 12, 13, 14, 15, 16, 17, 18, 19, or 20 base-pairs; in other embodiments, the polynucleotide donor molecule is double-stranded and includes 2-20 base-pairs, e. g., 2, 3, 4, 5, 6, 7, 8, 9, 10, 11, 12, 13, 14, 15, 16, 17, 18, 19, or 20 base-pairs and in addition has at least one overhang or "sticky end" consisting of at least one additional, unpaired nucleotide at one or at both termini. Non-limiting examples of such relatively small polynucleotide donor molecules of 20 or fewer base-pairs (if double-stranded) or 20 or fewer nucleotides (if single-stranded) include polynucleotide donor molecules that have at least one strand including a transcription factor recognition site sequence (e. g., such as the sequences of transcription factor recognition sites provided in the working Examples), or that have at least one strand including a small RNA recognition site, or that have at least one strand including a recombinase recognition site. In an embodiment, the polynucleotide donor molecule that is integrated (or that has a sequence that is integrated) at the site of at least one double-strand break (DSB) in a genome is a blunt-ended double-stranded DNA or a blunt-ended double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at about 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides (see, e. g., the various modifications of internucleotide linkages, bases, and sugars described in Verma and Eckstein (1998) *Annu. Rev. Biochem.*, 67:99-134); in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety (e. g., fluorescein or rhodamine or a fluorescent nucleoside analogue) or other detectable label (e. g., biotin or an isotope). In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In another embodiment, the polynucleotide donor molecule contains secondary structure that provides stability or acts as an aptamer. Other related embodiments include double-stranded DNA/RNA hybrid molecules, single-stranded DNA/RNA hybrid donor molecules, and single-stranded DNA donor molecules (including single-stranded, chemically modified DNA donor molecules), which in analogous procedures are integrated (or have a sequence that is integrated) at the site of a double-strand break.

In embodiments of the method, the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes nucleotide sequence(s) on one or on both strands that provide a desired functionality when the polynucleotide is integrated into the genome. In various non-limiting embodiments of the method, the sequence encoded by a donor polynucleotide that is inserted at the site of at least one double-strand break (DSB) in a genome includes at least one sequence selected from the group consisting of:

(a) DNA encoding at least one stop codon, or at least one stop codon on each strand, or at least one stop codon within each reading frame on each strand;

(b) DNA encoding heterologous primer sequence (e. g., a sequence of about 18 to about 22 contiguous nucleotides, or of at least 18 contiguous nucleotides, that can be used to initiate DNA polymerase activity at the site of the DSB);

(c) DNA encoding a unique identifier sequence (e. g., a sequence that when inserted at the DSB creates a heterologous sequence that can be used to identify the presence of the insertion);

(d) DNA encoding a transcript-stabilizing sequence;

(e) DNA encoding a transcript-destabilizing sequence;

(f) a DNA aptamer or DNA encoding an RNA aptamer or amino acid aptamer; and (g) DNA that includes or encodes a sequence recognizable by a specific binding agent.

In an embodiment, the sequence encoded by the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes DNA encoding at least one stop codon, or at least one stop codon on each strand, or at least one stop codon within each reading frame on each strand. Such sequence encoded by a polynucleotide donor molecule, when integrated at a DSB in a genome can be useful for disrupting the expression of a sequence of interest, such as a protein-coding gene. An example of such a polynucleotide donor molecule is a double-stranded DNA, a single-stranded DNA, a single-stranded DNA/RNA hybrid, or a double-stranded DNA/RNA hybrid donor molecule, of at least 18 contiguous base-pairs if double-stranded or at least 11 contiguous nucleotides if single-stranded, and encoding at least one stop codon in each possible reading frame on either strand. Another example of such a polynucleotide donor molecule is a double-stranded DNA or double-stranded DNA/RNA hybrid donor molecule wherein each strand includes at least 18 and fewer than 200 contiguous base-pairs, wherein the number of base-pairs is not divisible by 3, and wherein each strand encodes at least one stop codon in each possible reading frame in the 5' to 3' direction. Another example of such a polynucleotide donor molecule is a single-stranded DNA or single-stranded DNA/RNA hybrid donor molecule wherein each strand includes at least 11 and fewer than about 300 contiguous nucleotides, wherein the number of base-pairs is not divisible by 3, and wherein the polynucleotide donor molecule encodes at least one stop codon in each possible reading frame in the 5' to 3' direction.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB). Heterologous primer sequence can further include nucleotides of the genomic sequence directly flanking the site of the DSB.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a unique identifier sequence (e. g., a sequence that when inserted at the DSB creates a heterologous sequence that can be used to identify the presence of the insertion)

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a transcript-stabilizing sequence. In an example, sequence of a double-stranded or single-stranded DNA or a DNA/RNA hybrid donor molecule encoding a 5' terminal RNA-stabilizing stem-loop (see, e. g., Suay (2005) *Nucleic Acids Rev.,* 33:4754-4761) is integrated at a DSB located 5' to the sequence for which improved transcript stability is desired. In another embodiment, the polynucleotide donor molecule that is integrated (or that has a sequence that is integrated) at the site of at least one double-strand break (DSB) in a genome includes nucleotides encoding a transcript-destabilizing sequence such as the SAUR destabilizing sequences described in detail in U. S. Patent Application Publication 2007/0011761, incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a DNA aptamer or DNA encoding an RNA aptamer or amino acid aptamer. Nucleic acid (DNA or RNA) aptamers are single- or double-stranded nucleotides that bind specifically to molecules or ligands which include small molecules (e. g., secondary metabolites such as alkaloids, terpenes, flavonoids, and other small molecules, as well as larger molecules such as polyketides and non-ribosomal proteins), proteins, other nucleic acid molecules, and inorganic compounds. Introducing an aptamer at a specific location in the genome is useful, e. g., for adding binding specificity to an enzyme or for placing expression of a transcript or activity of an encoded protein under ligand-specific control. In an example, the polynucleotide donor molecule encodes a poly-histidine "tag" which is integrated at a DSB downstream of a protein or protein subunit, enabling the protein expressed from the resulting transcript to be purified by affinity to nickel, e. g., on nickel resins; in an embodiments, the polynucleotide donor molecule encodes a 6×-His tag, a 10×-His tag, or a 10×-His tag including one or more stop codons following the histidine-encoding codons, where the last is particularly useful when integrated downstream of a protein or protein subunit lacking a stop codon (see, e. g., parts[dot]igem[dot]org/Part: BBa_K844000). In embodiments, the polynucleotide donor molecule encodes a riboswitch, wherein the riboswitch includes both an aptamer which changes its conformation in the presence or absence of a specific ligand, and an expression-controlling region that turns expression on or off, depending on the conformation of the aptamer. See, for example, the regulatory RNA molecules containing ligand-specific aptamers described in U. S. Patent Application Publication 2013/0102651 and the various riboswitches described in U. S. Patent Application Publication 2005/0053951, both of which publications are incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent. Non-limiting embodiments of specific binding agents include nucleic acids, peptides or proteins, non-peptide/non-nucleic acid ligands, inorganic molecules, and combinations thereof; specific binding agents also include macromolecular assemblages such as lipid bilayers, cell components or organelles, and even intact cells or organisms. In embodiments, the specific binding agent is an aptamer or riboswitch, or alternatively is recognized by an aptamer or a riboswitch. In an embodiment, the invention provides a method of changing expression of a sequence of interest in a genome, comprising integrating a polynucleotide molecule at the site of a DSB in a genome, wherein the polynucleotide donor molecule includes a sequence recognizable by a specific binding agent, wherein the integrated sequence encoded by the polynucleotide donor molecule is functionally or operably linked to a sequence of interest, and wherein contacting the integrated sequence encoded by the polynucleotide donor molecule with the specific binding agent results in a change of expression of the sequence of interest; in embodiments, sequences encoded by different polynucleotide donor molecules are integrated at multiple DSBs in a genome.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent, wherein:

(a) the sequence recognizable by a specific binding agent includes an auxin response element (AuxRE) sequence, the specific binding agent is an auxin, and the change of expression is upregulation; see, e. g., Walker and Estelle (1998) *Curr. Opinion Plant Biol.,* 1:434-439;

(b) the sequence recognizable by a specific binding agent includes at least one D1-4 sequence (CCTCGTGTCTC, SEQ ID NO:328; see Ulmasov et al. (1997) *Plant Cell,* 9:1963-1971), the specific binding agent is an auxin, and the change of expression is upregulation;

(c) the sequence recognizable by a specific binding agent includes at least one DR5 sequence (CCTTTTGTCTC, SEQ ID NO:329; see Ulmasov et al. (1997) *Plant Cell,* 9:1963-1971), the specific binding agent is an auxin, and the change of expression is upregulation;

(d) the sequence recognizable by a specific binding agent includes at least one m5-DR5 sequence (CCTTTTGTCNC, wherein N is A, C, or G, SEQ ID NO:330; see Ulmasov et al. (1997) *Plant Cell,* 9:1963-1971), the specific binding agent is an auxin, and the change of expression is upregulation;

(e) the sequence recognizable by a specific binding agent includes at least one P3 sequence (TGTCTC, SEQ ID NO:331), the specific binding agent is an auxin, and the change of expression is upregulation;

(f) the sequence recognizable by a specific binding agent includes a small RNA recognition site sequence, the specific binding agent is the corresponding small RNA (e. g., an siRNA, a microRNA (miRNA), a trans-acting siRNA as described in U.S. Pat. No. 8,030,473, or a phased sRNA as described in U.S. Pat. No. 8,404,928; both of these cited patents are incorporated by reference herein), and the change of expression is downregulation (non-limiting examples are given below, under the heading "Small RNAs");

(g) the sequence recognizable by a specific binding agent includes a microRNA (miRNA) recognition site sequence, the specific binding agent is the corresponding mature miRNA, and the change of expression is downregulation (non-limiting examples are given below, under the heading "Small RNAs");

(h) the sequence recognizable by a specific binding agent includes a microRNA (miRNA) recognition sequence for an engineered miRNA, the specific binding agent is the corresponding engineered mature miRNA, and the change of expression is downregulation;

(i) the sequence recognizable by a specific binding agent includes a transposon recognition sequence, the specific binding agent is the corresponding transposon, and the change of expression is upregulation or downregulation;

(j) the sequence recognizable by a specific binding agent includes an ethylene-responsive element binding-factor-associated amphiphilic repression (EAR) motif (LxLxL, SEQ ID NO:332 or DLNxxP, SEQ ID NO:333) sequence (see, e. g., Ragale and Rozwadowski (2011) *Epigenetics,* 6:141- 146), the specific binding agent is ERF (ethylene-responsive element binding factor) or co-repressor (e. g., TOPLESS (TPL)), and the change of expression is downregulation;

(k) the sequence recognizable by a specific binding agent includes a splice site sequence (e. g., a donor site, a branching site, or an acceptor site; see, for example, the splice sites and splicing signals publicly available at the ERIS database, lemur[dot]amu[dot]edu[dot]pl/share/ERISdb/home.html), the specific binding agent is a spliceosome, and the change of expression is expression of an alternatively spliced transcript (in some cases, this can include deletion of a relatively large genomic sequence, such as deletion of all or part of an exon or of a protein domain);

(l) the sequence recognizable by a specific binding agent includes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase) (non-limiting examples are given below, under the heading "Recombinases and Recombinase Recognition Sites");

(m) the sequence recognizable by a specific binding agent includes sequence encoding an RNA or amino acid aptamer or an RNA riboswitch, the specific binding agent is the corresponding ligand, and the change in expression is upregulation or downregulation;

(n) the sequence recognizable by a specific binding agent is a hormone responsive element (e. g., a nuclear receptor, or a hormone-binding domain thereof), the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation (non-limiting examples are given below, under the heading "Transcription Factors").

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a nucleotide sequence that encodes an RNA molecule or an amino acid sequence that is recognizable by a specific binding agent. In embodiments, the polynucleotide donor molecule includes a nucleotide sequence that binds specifically to a ligand or that encodes an RNA molecule or an amino acid sequence that binds specifically to a ligand. In embodiments, the polynucleotide donor molecule encodes at least one stop codon on each strand, or encodes at least one stop codon within each reading frame on each strand.

In embodiments, the polynucleotide (such as a double-stranded DNA, a single-stranded DNA, a single-stranded DNA/RNA hybrid, or a double-stranded DNA/RNA hybrid) donor molecule includes at least partially self-complementary sequence, such that the polynucleotide donor molecule encodes a transcript that is capable of forming at least partially double-stranded RNA. In embodiments, the at least partially double-stranded RNA is capable of forming secondary structure containing at least one stem-loop (i. e., a substantially or perfectly double-stranded RNA "stem" region and a single-stranded RNA "loop" connecting opposite strands of the dsRNA stem. In embodiments, the at least partially double-stranded RNA is cleavable by a Dicer or other ribonuclease. In embodiments, the at least partially double-stranded RNA includes an aptamer or a riboswitch; see, e. g., the RNA aptamers described in U. S. Patent Application Publication 2013/0102651, which is incorporated herein by reference.

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes or encodes a nucleotide sequence that is responsive to a specific change in the physical environment (e. g., a change in light intensity or quality, a change in temperature, a change in pressure, a change in osmotic concentration, a change in day length, or addition or removal of a ligand or specific binding agent), wherein exposing the integrated polynucleotide sequence to the specific change in the physical environment results in a change of expression of the sequence of interest. In embodiments, the polynucleotide donor molecule includes a nucleotide sequence encoding an RNA molecule or an amino acid sequence that is responsive to a specific change in the physical environment. In a non-limiting example, the polynucleotide donor molecule encodes an amino acid sequence that is responsive to light, oxygen, redox status, or voltage, such as a Light-Oxygen-Voltage (LOV) domain (see, e. g., Peter et al. (2010) *Nature Communications,* doi:10.1038/ncomms1121) or a PAS domain (see, e. g., Taylor and Zhulin (1999) *Microbiol. Mol. Biol. Reviews,* 63:479-506), proteins containing such domains, or sub-domains or motifs thereof (see, e. g., the photochemically active 36-residue N-terminal truncation of the VVD protein described by Zoltowski et al. (2007) *Science,* 316:1054-1057). In a non-limiting embodiment, integration of a LOV domain at the site of a DSB within or adjacent to a protein-coding region is used to create a heterologous fusion protein that can be photoactivated.

Small RNAs:

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA recognition site sequence that is recognized by a corresponding mature small RNA. Small RNAs include siRNAs, microRNAs (miRNAs), trans-acting siRNAs (tasiRNAs) as described in U.S. Pat. No. 8,030,473, and phased small RNAs (phased sRNAs) as described in U.S. Pat. No. 8,404,928. All mature small RNAs are single-stranded RNA molecules, generally between about 18 to about 26 nucleotides in length, which are produced from longer, completely or substantially double-stranded RNA (dsRNA) precursors. For example, siRNAs are generally processed from perfectly or near-perfectly double-stranded RNA precursors, whereas both miRNAs and phased sRNAs are processed from larger precursors that contain at least some mismatched (non-base-paired) nucleotides and often substantial secondary structure such as loops and bulges in the otherwise largely double-stranded RNA precursor. Precursor molecules include naturally occurring precursors, which are often expressed in a specific (e. g., cell- or tissue-specific, temporally specific, developmentally specific, or inducible) expression pattern. Precursor molecules also include engineered precursor molecules, designed to produce small RNAs (e. g., artificial or engineered siRNAs or miRNAs) that target specific sequences; see, e. g., U.S. Pat. Nos. 7,691,995 and 7,786,350, which are incorporated herein by reference in their entirety. Thus, in embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA precursor sequence designed to be processed in vivo to at least one corresponding mature small RNA. In embodiments, the polynucleotide donor molecule that is integrated (or that has a sequence that is integrated) at the site of at least one double-strand break (DSB) in a genome includes DNA that includes or encodes an engineered small RNA precursor sequence that is based on a naturally occurring "scaffold" precursor sequence but wherein the nucleotides of the encoded mature small RNA are designed to target a specific gene of interest that is different from the gene targeted by the natively encoded small RNA; in embodiments, the "scaffold" precursor sequence is one identified from the genome of a plant or a pest or pathogen of a plant; see, e. g., U.S. Pat. No. 8,410,334, which discloses transgenic expression of engineered invertebrate miRNA precursors in a plant, and which is incorporated herein by reference in its entirety.

Regardless of the pathway that generates the mature small RNA, the mechanism of action is generally similar; the mature small RNA binds in a sequence-specific manner to a small RNA recognition site located on an RNA molecule (such as a transcript or messenger RNA), and the resulting duplex is cleaved by a ribonuclease. The integration of a recognition site for a small RNA at the site of a DSB results in cleavage of the transcript including the integrated recognition site when and where the mature small RNA is expressed and available to bind to the recognition site. For example, a recognition site sequence for a mature siRNA or miRNA that is endogenously expressed only in male reproductive tissue of a plant can be integrated into a DSB, whereby a transcript containing the recognition site sequence is cleaved only where the mature siRNA or miRNA is expressed (i. e., in male reproductive tissue); this is useful, e. g., to prevent expression of a protein in male reproductive tissue such as pollen, and can be used in applications such as to induce male sterility in a plant or to prevent pollen development or shedding. Similarly, a recognition site sequence for a mature siRNA or miRNA that is endogenously expressed only in the roots of a plant can be integrated into a DSB, whereby a transcript containing the recognition site sequence is cleaved only in roots; this is useful, e. g., to prevent expression of a protein in roots. Non-limiting examples of useful small RNAs include: miRNAs having tissue-specific expression patterns disclosed in U.S. Pat. No. 8,334,430, miRNAs having temporally specific expression patterns disclosed in U.S. Pat. No. 8,314,290, miRNAs with stress-responsive expression patterns disclosed in U.S. Pat. No. 8,237,017, siRNAs having tissue-specific expression patterns disclosed in U.S. Pat. No. 9,139,838, and various miRNA recognition site sequences and the corresponding miRNAs disclosed in U. S. Patent Application Publication 2009/0293148. All of the patent publications referenced in this paragraph are incorporated herein by reference in their entirety. In embodiments, multiple edits in a genome are employed to obtain a desired phenotype or trait in plant. In an embodiment, one or more edits (addition, deletion, or substitution of one or more nucleotides) of an endogenous nucleotide sequence is made to provide a general phenotype; addition of at least one small RNA recognition site by insertion of the recognition site sequence at a DSB that is functionally linked to the edited endogenous nucleotide sequence achieves more specific control of expression of the edited endogenous nucleotide sequence. In an example, an endogenous plant 5-enolpyruvylshikimate-3-phosphate synthase (EPSPS) is edited to provide a glyphosate-resistant EPSPS; for example, suitable changes include the amino acid substitutions Threonine-102-Isoleucine (T102I) and Proline-106-Serine (P106S) in the maize EPSPS sequence identified by Genbank accession number X63374 (see, for example U.S. Pat. No. 6,762,344, incorporated herein by reference). In another example, an endogenous plant acetolactate synthase (ALS) is edited to increase resistance of the enzyme to various herbicides (e. g., sulfonylurea, imidazolinone, tirazolopyrimidine, pyrimidinylthiobenzoate, sulfonylamino-carbonyltriazolinone); for example, suitable changes include the amino acid substitutions G115, A116, P191, A199, K250, M345, D370, V565, W568, and F572 to the Nicotiana tabacum ALS enzyme as described in U.S. Pat. No. 5,605,011, which is incorporated herein by reference. The edited herbicide-tolerant enzyme, combined with integration of at least one small RNA recognition site for a small RNA (e. g., an siRNA or a miRNA) expressed only in a specific tissue (for example, miRNAs specifically expressed in male reproductive tissue or female reproductive tissue, e. g., the miRNAs disclosed in Table 6 of U.S. Pat. No. 8,334,430 or the siRNAs disclosed in U.S. Pat. No. 9,139,838, both incorporated herein by reference) at a DSB functionally linked to (e. g., in the 3' untranslated region of) the edited herbicide-tolerant enzyme results in expression of the edited herbicide-tolerant enzyme being restricted to tissues other than those in which the small RNA is endogenously expressed, and those tissues in which the small RNA is expressed will not be resistant to herbicide application; this approach is useful, e. g., to provide male-sterile or female-sterile plants.

In other embodiments, the sequence of an endogenous genomic locus encoding one or more small RNAs (e. g., miRNAs, siRNAs, ta-siRNAs) is altered in order to express a small RNA having a sequence that is different from that of the endogenous small RNA and is designed to target a new sequence of interest (e. g., a sequence of a plant pest, plant pathogen, symbiont of a plant, or symbiont of a plant pest or pathogen). For example, the sequence of an endogenous or native genomic locus encoding a miRNA precursor can be altered in the mature miRNA and the miR* sequences, while maintaining the secondary structure in the resulting altered miRNA precursor sequence to permit normal processing of the transcript to a mature miRNA with a different sequence from the original, native mature miRNA sequence; see, for example, U.S. Pat. Nos. 7,786,350 and 8,395,023, both of which are incorporated by reference in their entirety herein, and which teach methods of designing engineered miRNAs. In embodiments, the sequence of an endogenous genomic locus encoding one or more small RNAs (e. g., miRNAs, siRNAs, ta-siRNAs) is altered in order to express one or more small RNA cleavage blockers (see, e. g., U.S. Pat. No. 9,040,774, which is incorporated by reference in its entirety herein). In embodiments, the sequence of an endogenous genomic locus is altered to encode a small RNA decoy (e. g., U.S. Pat. No. 8,946,511, which is incorporated by reference in its entirety herein). In embodiments, the sequence of an endogenous genomic locus that natively contains a small RNA (e. g., miRNA, siRNA, or ta-siRNA) recognition or cleavage site is altered to delete or otherwise mutate the recognition or cleavage site and thus decouple the genomic locus from small RNA regulation.

Recombinases and Recombinase Recognition Sites:

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase). The term "recombinase recognition site sequence" refers to the DNA sequences (usually a pair of sequences) that are recognized by a site-specific (i. e., sequence-specific) recombinase in a process that allows the excision (or, in some cases, inversion or translocation) of the DNA located between the sequence-specific recombination sites. For instance, Cre recombinase recognizes either loxP recombination sites or lox511 recombination sites which are heterospecific, which means that loxP and lox511 do not recombine together (see, e. g., Odell et al. (1994) *Plant Physiol.*, 106:447-458); FLP recombinase recognizes frt recombination sites (see, e. g., Lyznik et al. (1996) *Nucleic Acids Res.*, 24:3784-3789); R recombinase recognizes Rs recombination sites (see, e. g., Onouchi et al. (1991) *Nucleic Acids Res.*, 19:6373-6378); Dre recombinase recognizes rox sites (see, e. g., U.S. Pat. No. 7,422,889, incorporated herein by reference); and Gin recombinase recognizes gix sites (see, e. g., Maeser et al. (1991) *Mol. Gen. Genet.*, 230:170-176). In a non-limiting example, a pair of polynucleotides encoding loxP recombinase recognition site sequences encoded by a pair of polynucleotide donor molecules are integrated at two separate DSBs; in the presence of the corresponding site-specific DNA recombinase Cre, the genomic sequence flanked on either side by the integrated loxP recognition sites is excised from the genome (for loxP sequences that are integrated in the same orientation relative to each other within the genome) or is inverted (for loxP sites that are integrated in an inverted orientation relative to each other within the genome) or is translocated (for loxP sites that are integrated on separate DNA molecules); such an approach is useful, e. g., for deletion or replacement of larger lengths of genomic sequence, for example, deletion or replacement of one or more protein domains. In embodiments, the recombinase recognition site sequences that are integrated at two separate DSBs are heterospecific, e., will not recombine together; for example, Cre recombinase recognizes either loxP recombination sites or lox511 recombination sites which are heterospecific relative to each other, which means that a loxP site and a lox511 site will not recombine together but only with another recombination site of its own type.

Integration of recombinase recognition sites is useful in plant breeding; in an embodiment, the method is used to provide a first parent plant having recombinase recognition site sequences heterologously integrated at two separate DSBs; crossing this first parent plant to a second parent plant that expresses the corresponding recombinase results in progeny plants in which the genomic sequence flanked on either side by the heterologously integrated recognition sites is excised from (or in some cases, inverted in) the genome. This approach is useful, e. g., for deletion of relatively large regions of DNA from a genome, for example, for excising DNA encoding a selectable or screenable marker that was introduced using transgenic techniques. Examples of heterologous arrangements or integration patterns of recombinase recognition sites and methods for their use, particularly in plant breeding, are disclosed in U.S. Pat. No. 8,816,153 (see, for example, the Figures and working examples), the entire specification of which is incorporated herein by reference.

Transcription Factors:

In an embodiment, the sequence encoded by the donor polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a transcription factor binding sequence, the specific binding agent is the corresponding transcription factor (or more specifically, the DNA-binding domain of the corresponding transcription factor), and the change in expression is upregulation or downregulation (depending on the type of transcription factor involved). In an embodiment, the transcription factor is an activating transcription factor or activator, and the change in expression is upregulation or increased expression increased expression (e.g., increased expression of at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or greater) of a sequence of interest to which the transcription factor binding sequence, when integrated at a DSB in the genome, is operably linked. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more. In another embodiment, the transcription factor is a repressing transcription factor or repressor, and the change in expression is downregulation or decreased expression (e.g., decreased expression by at least 1%, 5%, 10%, 15%, 20%, 25%, 30%, 35%, 40%, 50%, 60%, 70%, 80%, 90%, 95%, 99% or more) of a sequence of interest to which the transcription factor binding sequence when integrated at a DSB in the genome, is operably linked. Embodiments of transcription factors include hormone receptors, e. g., nuclear receptors, which include both a hormone-binding domain and a DNA-binding domain; in embodiments, the polynucleotide donor molecule that is integrated (or that has a sequence that is integrated) at the site of at least one double-strand break (DSB) in a genome includes or encodes a hormone-binding domain of a nuclear receptor or a DNA-binding domain of a nuclear receptor. Various non-limiting examples of transcription factor binding sequences and transcription factors are provided in the working Examples. In embodiments, the sequence recognizable by a specific binding agent is a transcription factor binding sequence selected from those publicly disclosed at arabidopsis[dot]med[dot]ohio-state[dot]edu/AtcisDB/bindingsites[dot]html and neomorph[dot]salk[dot]edu/dap_web/pages/index[dot]php.

To summarize, the methods described herein permit sequences encoded by donor polynucleotides to be inserted, in a non-multiplexed or multiplexed manner, into a plant cell genome for the purpose of modulating gene expression in a number of distinct ways. Gene expression can be modulated up or down, for example, by tuning expression through the insertion of enhancer elements and transcription start sequences (e.g., nitrate response elements and auxin binding elements). Conditional transcription factor binding sites can be added or modified to allow additional control. Similarly, transcript stabilizing and/or destabilizing sequences can be inserted using the methods herein. Via the targeted insertion of stop codons, RNAi cleavage sites, or sites for recombinases, the methods described herein allow the transcription of particular sequences to be selectively turned off (likewise, the targeted removal of such sequences can be used to turn gene transcription on).

The plant genome targeting methods disclosed herein also enable transcription rates to be adjusted by the modification (optimization or de-optimization) of core promoter sequences (e.g., TATAA boxes). Proximal control elements (e.g., GC boxes; CAAT boxes) can likewise be modified. Enhancer or repressor motifs can be inserted or modified. Three-dimensional structural barriers in DNA that inhibit RNA polymerase can be created or removed via the targeted insertion of sequences, or by the modification of existing sequences. Where intron mediated enhancement is known to affect transcript rate, the relevant rate-affecting sequences can be optimized or de-optimized (by insertion of additional sequences or modification of existing sequences) to further enhance or diminish transcription. Through the insertion or modification of sequences using the targeting methods described herein (including multiplexed targeting methods), mRNA stability and processing can be modulated (thereby modulating gene expression). For example, mRNA stabilizing or destabilizing motifs can be inserted, removed or modified; mRNA splicing donor/acceptor sites can be inserted, removed or modified and, in some instance, create the possibility of increased control over alternate splicing. Similarly, miRNA binding sites can be added, removed or modified using the methods described herein. Epigenetic regulation of transcription can also be adjusted according to the methods described herein (e.g., by increasing or decreasing the degree of methylation of DNA, or the degree of methylation or acetylation of histones). Epigenetic regulation using the tools and methods described herein can be combined with other methods for modifying genetic sequences described herein, for the purpose of modifying a trait of a plant cell or plant, or for creating populations of modified cells and cells from which desired phenotypes can be selected.

The plant genome targeting methods described herein can also be used to modulate translation efficiency by, e.g., modifying codon usage towards or away from a particular plant cell's bias. Similarly, through the use of the targeting methods described herein, KOZAK sequences can be optimized or deoptimized, mRNA folding and structures affecting initiation of translation can be altered, and upstream reading frames can be created or destroyed. Through alteration of coding sequences using the targeted genome modification methods described herein, the abundance and/or activity of translated proteins can be adjusted. For example, the amino acid sequences in active sites or functional sites of proteins can be modified to increase or decrease the activity of the protein as desired; in addition, or alternatively, protein stabilizing or destabilizing motifs can be added or modified. All of the gene expression and activity modification schemes described herein can be utilized in various combinations to fine-tune gene expression and activity. Using the multiplexed targeting methods described herein, a plurality of specific targeted modifications can be achieved in a plant cell without intervening selection or sequencing steps.

Modified Plant Cells Comprising Specifically Targeted and Modified Genomes

Another aspect of the invention includes the cell, such as a plant cell, provided by the methods disclosed herein. In an embodiment, a plant cell thus provided includes in its genome a heterologous DNA sequence that includes: (a) nucleotide sequence of a polynucleotide (such as a double-stranded DNA, a single-stranded DNA, a single-stranded DNA/RNA hybrid, or a double-stranded DNA/RNA hybrid) molecule integrated at the site of a DSB in a genome; and (b) genomic nucleotide sequence adjacent to the site of the DSB. In embodiments, the methods disclosed herein for integrating a sequence encoded by a polynucleotide donor molecule into the site of a DSB are applied to a plant cell (e. g., a plant cell or plant protoplast isolated from a whole plant or plant part or plant tissue, or an isolated plant cell or plant protoplast in suspension or plate culture); in other embodiments, the methods are applied to non-isolated plant cells in situ or in planta, such as a plant cell located in an intact or growing plant or in a plant part or tissue. The methods disclosed herein for integrating a sequence encoded by a polynucleotide donor molecule into the site of a DSB are also useful in introducing heterologous sequence at the site of a DSB induced in the genome of other photosynthetic eukaryotes (e. g., green algae, red algae, diatoms, brown algae, and dinoflagellates). In embodiments, the plant cell or plant protoplast is capable of division and further differentiation. In embodiments, the plant cell or plant protoplast is obtained or isolated from a plant or part of a plant selected from the group consisting of a plant tissue, a whole plant, an intact nodal bud, a shoot apex or shoot apical meristem, a root apex or root apical meristem, lateral meristem, intercalary meristem, a seedling (e. g., a germinating seed or small seedling or a larger seedling with one or more true leaves), a whole seed (e. g., an intact seed, or a seed with part or all of its seed coat removed or treated to make permeable), a halved seed or other seed fragment, a zygotic or somatic embryo (e. g., a mature dissected zygotic embryo, a developing zygotic or somatic embryo, a dry or rehydrated or freshly excised zygotic embryo), pollen, microspores, epidermis, flower, and callus.

In some embodiments, the method includes the additional step of growing or regenerating a plant from a plant cell containing the heterologous DNA sequence of the polynucleotide donor molecule integrated at the site of a DSB and genomic nucleotide sequence adjacent to the site of the DSB, wherein the plant includes at least some cells that contain the heterologous DNA sequence of the polynucleotide donor molecule integrated at the site of a DSB and genomic nucleotide sequence adjacent to the site of the DSB. In embodiments, callus is produced from the plant cell, and plantlets and plants produced from such callus. In other embodiments, whole seedlings or plants are grown directly from the plant cell without a callus stage. Thus, additional related aspects are directed to whole seedlings and plants grown or regenerated from the plant cell or plant protoplast containing sequence encoded by a polynucleotide (such as a double-stranded DNA, a single-stranded DNA, a single-stranded DNA/RNA hybrid, or a double-stranded DNA/RNA hybrid) donor molecule heterologously integrated at the site of a DSB, as well as the seeds of such plants; embodiments include whole seedlings and plants grown or regenerated from the plant cell or plant protoplast containing sequence encoded by a polynucleotide donor molecule heterologously integrated at the site of two or more DSBs, as well as the seeds of such plants. In embodiments, the grown or regenerated plant exhibits a phenotype associated with the sequence encoded by a polynucleotide donor molecule heterologously integrated at the site of a DSB. In embodiments, the grown or regenerated plant includes in its genome two or more genetic modifications that in combination provide at least one phenotype of interest, wherein at least one of the two or more genetic modifications includes the sequence encoded by a polynucleotide donor molecule heterologously integrated at the site of a DSB in the genome, or wherein the two or more genetic modifications include sequence encoded by at least one polynucleotide donor heterologously integrated at two or more DSBs in the genome, or wherein the two or more genetic modifications include sequences encoded by multiple polynucleotides donor molecules heterologously integrated at different DSBs in the genome. In embodiments, a heterogeneous population of plant cells or plant protoplasts, at least some of which include sequence encoded by at least one polynucleotide donor molecule heterologously integrated at the site of a DSB, is provided by the method; related aspects include a plant having a phenotype of interest associated with sequence encoded by the polynucleotide donor molecule heterologously integrated at the site of a DSB, provided by either regeneration of a plant having the phenotype of interest from a plant cell or plant protoplast selected from the heterogeneous population of plant cells or plant protoplasts, or by selection of a plant having the phenotype of interest from a heterogeneous population of plants grown or regenerated from the population of plant cells or plant protoplasts. Examples of phenotypes of interest include (but are not limited to) herbicide resistance; improved tolerance of abiotic stress (e. g., tolerance of temperature extremes, drought, or salt) or biotic stress (e. g., resistance to bacterial or fungal pathogens); improved utilization of nutrients or water; synthesis of new or modified amounts of lipids, carbohydrates, proteins or other chemicals, including medicinal compounds; improved flavour or appearance; improved photosynthesis; improved storage characteristics (e. g., resistance to bruising, browning, or softening); increased yield; altered morphology (e. g., floral architecture or colour, plant height, branching, root structure); and changes in flowering time. In an embodiment, a heterogeneous population of plant cells or plant protoplasts (or seedlings or plants grown or regenerated therefrom) is exposed to conditions permitting expression of the phenotype of interest; e. g., selection for herbicide resistance can include exposing the population of plant cells or plant protoplasts (or seedlings or plants) to an amount of herbicide or other substance that inhibits growth or is toxic, allowing identification and selection of those resistant plant cells or plant protoplasts (or seedlings or plants) that survive treatment. In certain embodiments, a proxy measurement can be taken of an aspect of a modified plant or plant cell, where the measurement is indicative of a desired phenotype or trait. For example, the modification of one or more targeted sequences in a genome may provide a measurable change in a molecule (e.g., a detectable change in the structure of a molecule, or a change in the amount of the molecule that is detected, or the presence or absence of a molecule) that can be used as a biomarker for a presence of a desired phenotype or trait. The proper insertion of an enhancer for increasing expression of an enzyme, for example, may be determined by detecting lower levels of the enzyme's substrate.

In some embodiments, modified plants are produced from cells modified according to the methods described herein without a tissue culturing step. In certain embodiments, the modified plant cell or plant does not have significant losses of methylation compared to a non-modified parent plant cell or plant. For example, the modified plant lacks significant losses of methylation in one or more promoter regions relative to the parent plant cell or plant. Similarly, in certain embodiments, an modified plant or plant cell obtained using the methods described herein lacks significant losses of methylation in protein coding regions relative to the parent cell or parent plant before modification using the modifying methods described herein.

Also contemplated are new heterogeneous populations, arrays, or libraries of plant cells and plants created by the introduction of targeted modifications at one more locations in the genome. Plant compositions of the invention include succeeding generations or seeds of modified plants that are grown or regenerated from plant cells or plant protoplasts modified according to the methods herein, as well as parts of those plants (including plant parts used in grafting as scions or rootstocks), or products (e. g., fruits or other edible plant parts, cleaned grains or seeds, edible oils, flours or starches, proteins, and other processed products) made from these plants or their seeds. Embodiments include plants grown or regenerated from the plant cells or plant protoplasts, wherein the plants contain cells or tissues that do not have sequence encoded by the polynucleotide donor molecule heterologously integrated at the site of a DSB, e. g., grafted plants in which the scion or rootstock contains sequence encoded by the polynucleotide donor molecule heterologously integrated at the site of a DSB, or chimeric plants in which some but not all cells or tissues contain sequence encoded by the polynucleotide donor molecule heterologously integrated at the site of a DSB. Plants in which grafting is commonly useful include many fruit trees and plants such as many citrus trees, apples, stone fruit (e. g., peaches, apricots, cherries, and plums), avocados, tomatoes, eggplant, cucumber, melons, watermelons, and grapes as well as various ornamental plants such as roses. Grafted plants can be grafts between the same or different (generally related) species. Additional related aspects include (a) a hybrid plant provided by crossing a first plant grown or regenerated from a plant cell or plant protoplast with sequence encoded by at least one polynucleotide donor molecule heterologously integrated at the site of a DSB, with a second plant, wherein the hybrid plant contains sequence encoded by the polynucleotide donor molecule heterologously integrated at the site of a DSB, and (b) a hybrid plant provided by crossing a first plant grown or regenerated from a plant cell or plant protoplast with sequence encoded by at least one polynucleotide donor molecule heterologously integrated at multiple DSB sites, with a second plant, wherein the hybrid plant contains sequence encoded by at least one polynucleotide donor molecule heterologously integrated at the site of at least one DSB; also contemplated is seed produced by the hybrid plant. Also envisioned as related aspects are progeny seed and progeny plants, including hybrid seed and hybrid plants, having the regenerated plant as a parent or ancestor. In embodiments, the plant cell (or the regenerated plant, progeny seed, and progeny plant) is diploid or polyploid. In embodiments, the plant cell (or the regenerated plant, progeny seed, and progeny plant) is haploid or can be induced to become haploid; techniques for making and using haploid plants and plant cells are known in the art, see, e. g., methods for generating haploids in *Arabidopsis thaliana* by crossing of a wild-type strain to a haploid-inducing strain that expresses altered forms of the centromere-specific histone CENH3, as described by Maruthachalam and Chan in "How to make haploid *Arabidopsis thaliana*", a protocol publicly available at www[dot]openwetware[dot]org/images/d/d3/Haploid_Arabidopsis_protocol[dot]pdf; Ravi et al. (2014) *Nature Communications*, 5:5334, doi:10.1038/ncomms6334). Examples of haploid cells include but are not limited to plant cells obtained from haploid plants and plant cells obtained from reproductive tissues, e. g., from flowers, developing flowers or flower buds, ovaries, ovules, megaspores, anthers, pollen, and microspores. In embodiments where the plant cell is haploid, the method can further include the step of chromosome doubling (e. g., by spontaneous chromosomal doubling by meiotic non-reduction, or by using a chromosome doubling agent such as colchicine, oryzalin, trifluralin, pronamide, nitrous oxide gas, anti-microtubule herbicides, anti-microtubule agents, and mitotic inhibitors) in the plant cell containing heterologous DNA sequence (i. e. sequence of the polynucleotide donor molecule integrated at the site of a DSB in the genome and genomic nucleotide sequence adjacent to the site of the DSB) to produce a doubled haploid plant cell or plant protoplast that is homozygous for the heterologous DNA sequence; yet other embodiments include regeneration of a doubled haploid plant from the doubled haploid plant cell or plant protoplast, wherein the regenerated doubled haploid plant is homozygous for the heterologous DNA sequence. Thus, aspects of the invention are related to the haploid plant cell or plant protoplast having the heterologous DNA sequence of the polynucleotide donor molecule integrated at the site of a DSB and genomic nucleotide sequence adjacent to the site of the DSB, as well as a doubled haploid plant cell or plant protoplast or a doubled haploid plant that is homozygous for the heterologous DNA sequence. Another aspect of the invention is related to a hybrid plant having at least one parent plant that is a doubled haploid plant provided by the method. Production of doubled haploid plants by these methods provides homozygosity in one generation, instead of requiring several generations of self-crossing to obtain homozygous plants; this may be particularly advantageous in slow-growing plants, such as fruit and other trees, or for producing hybrid plants that are offspring of at least one doubled-haploid plant.

Plants and plant cells that may be modified according to the methods described herein are of any species of interest, including dicots and monocots, but especially rice species (including hybrid species).

The rice cells and derivative plants and seeds disclosed herein can be used for various purposes useful to the consumer or grower. The intact plant itself may be desirable, e. g., plants grown as cover crops or as ornamentals. In other embodiments, processed products are made from the plant or its seeds, such as extracted proteins, oils, sugars, and starches, fermentation products, animal feed or human food, wood and wood products, pharmaceuticals, and various industrial products. Thus, further related aspects of the invention include a processed or commodity product made from a plant or seed or plant part that includes at least some cells that contain the heterologous DNA sequence including the sequence encoded by the polynucleotide donor molecule integrated at the site of a DSB and genomic nucleotide sequence adjacent to the site of the DSB. Commodity products include, but are not limited to, harvested leaves, roots, shoots, tubers, stems, fruits, seeds, or other parts of a plant, meals, oils (edible or inedible), fiber, extracts, fermentation or digestion products, crushed or whole grains or seeds of a plant, wood and wood pulp, or any food or non-food product. Detection of a heterologous DNA sequence that includes: (a) nucleotide sequence encoded by a polynucleotide donor molecule integrated at the site of a DSB in a genome; and (b) genomic nucleotide sequence adjacent to the site of the DSB in such a commodity product is de facto evidence that the commodity product contains or is derived from a plant cell, plant, or seed of this invention.

In another aspect, the invention provides a heterologous nucleotide sequence including: (a) nucleotide sequence encoded by a polynucleotide donor molecule integrated by the methods disclosed herein at the site of a DSB in a genome, and (b) genomic nucleotide sequence adjacent to the site of the DSB. Related aspects include a plasmid, vector, or chromosome including such a heterologous nucleotide sequence, as well as polymerase primers for amplification (e. g., PCR amplification) of such a heterologous nucleotide sequence.

Compositions and Reaction Mixtures

In one aspect, the invention provides a composition including: (a) a cell; and (b) a polynucleotide (such as a double-stranded DNA, a single-stranded DNA, a single-stranded DNA/RNA hybrid, or a double-stranded DNA/RNA hybrid) donor molecule that is capable of being integrated (or having its sequence integrated) (preferably by non-homologous end-joining (NHEJ)) at one or more double-strand breaks in a genome in the cell. In many embodiments of the composition, the cell is a plant cell, e. g., an isolated plant cell or a plant protoplast, or a plant cell in a plant, plant part, plant tissue, or callus. In certain embodiments, the cell is that of a photosynthetic eukaryote (e. g., green algae, red algae, diatoms, brown algae, and dinoflagellates).

In various embodiments of the composition, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the composition includes a plant cell that includes at least one double-strand break (DSB) in its genome. Alternatively, the composition includes a plant cell in which at least one DSB will be induced in its genome, for example, by providing at least one DSB-inducing agent to the plant cell, e. g., either together with the polynucleotide (such as a double-stranded DNA, a single-stranded DNA, a single-stranded DNA/RNA hybrid, or a double-stranded DNA/RNA hybrid) donor molecule or separately. Thus, the composition optionally further includes at least one DSB-inducing agent. In embodiments, the composition optionally further includes at least one chemical, enzymatic, or physical delivery agent, or a combination thereof; such delivery agents and methods for their use are described in detail in the paragraphs following the heading "Delivery Methods and Delivery Agents". In embodiments, the DSB-inducing agent is at least one of the group consisting of:

(a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;

(b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease.

In embodiments, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) a Cas9, a Cpf1, a CasY, a CasX, a C2c1, or a C2c3 nuclease; and (d) at least one guide RNA. In an embodiment, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) at least one ribonucleoprotein including a CRISPR nuclease and a guide RNA.

In embodiments of the composition, the polynucleotide donor molecule is double-stranded and blunt-ended, or is double stranded and has an overhang or "sticky end" consisting of unpaired nucleotides (e. g., 1, 2, 3, 4, 5, or 6 unpaired nucleotides) at one terminus or both termini; in other embodiments, the polynucleotide donor molecule is a single-stranded DNA or a single-stranded DNA/RNA hybrid. In an embodiment, the polynucleotide donor molecule is a double-stranded DNA or DNA/RNA hybrid molecule that is blunt-ended or that has an overhang at one terminus or both termini, and that has about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule is a double-stranded DNA, a single-stranded DNA, a single-stranded DNA/RNA hybrid, or a double-stranded DNA/RNA hybrid, and includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule includes chemically modified nucleotides; in embodiments, the naturally occurring phosphodiester backbone of the polynucleotide molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety or other detectable label. In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. Other related embodiments include single- or double-stranded DNA/RNA hybrid donor molecules. Additional description of the polynucleotide donor molecule is found above in the paragraphs following the heading "Polynucleotide Molecules".

In embodiments of the composition, the polynucleotide donor molecule includes:

(a) a nucleotide sequence that is recognizable by a specific binding agent;

(b) a nucleotide sequence encoding an RNA molecule or an amino acid sequence that is recognizable by a specific binding agent;

(c) a nucleotide sequence that encodes an RNA molecule or an amino acid sequence that binds specifically to a ligand;

(d) a nucleotide sequence that is responsive to a specific change in the physical environment; or (e) a nucleotide sequence encoding an RNA molecule or an amino acid sequence that is responsive to a specific change in the physical environment;

(f) a nucleotide sequence encoding at least one stop codon on each strand;

(g) a nucleotide sequence encoding at least one stop codon within each reading frame on each strand; or (h) at least partially self-complementary sequence, such that the polynucleotide molecule encodes a transcript that is capable of forming at least partially double-stranded RNA; or (i) a combination of any of (a)-(h).

Additional description relating to these various embodiments of nucleotide sequences included in the polynucleotide donor molecule is found in the section headed "Methods of changing expression of a sequence of interest in a genome".

In another aspect, the invention provides a reaction mixture including: (a) a plant cell having a double-strand break (DSB) at least one locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB (preferably by non-homologous end-joining (NHEJ)), with a length of between about 18 to about 300 base-pairs (or nucleotides, if single-stranded), or between about 30 to about 100 base-pairs (or nucleotides, if single-stranded); wherein sequence encoded by the polynucleotide donor molecule, if integrated at the DSB, forms a heterologous insertion (that is to say, resulting in a concatenated nucleotide sequence that is a combination of the sequence of the polynucleotide molecule and at least some of the genomic sequence adjacent to the site of DSB, wherein the concatenated sequence is heterologous, e., would not otherwise or does not normally occur at the site of insertion). In embodiments, the product of the reaction mixture includes a plant cell in which sequence encoded by the polynucleotide donor molecule has been integrated at the site of the DSB.

In many embodiments of the reaction mixture, the cell is a plant cell, e. g., an isolated plant cell or a plant protoplast, or a plant cell in a plant, plant part, plant tissue, or callus. In various embodiments of the reaction mixture, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the reaction mixture includes a plant cell that includes at least one double-strand break (DSB) in its genome. Alternatively, the reaction mixture includes a plant cell in which at least one DSB will be induced in its genome, for example, by providing at least one DSB-inducing agent to the plant cell, e. g., either together with a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB, or separately. Thus, the reaction mixture optionally further includes at least one DSB-inducing agent. In embodiments, the reaction mixture optionally further includes at least one chemical, enzymatic, or physical delivery agent, or a combination thereof; such delivery agents and methods for their use are described in detail in the paragraphs following the heading "Delivery Methods and Delivery Agents". In embodiments, the DSB-inducing agent is at least one of the group consisting of:

(a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;

(b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease.

In embodiments, the reaction mixture includes (a) a plant cell; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) a Cas9, a Cpf1, a CasY, a CasX, a C2c1, or a C2c3 nuclease; and (d) at least one guide RNA. In an embodiment, the reaction mixture includes (a) a plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including a CRISPR nuclease and a guide RNA. In an embodiment, the reaction mixture includes (a) plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including Cas9 and an sgRNA.

In embodiments of the reaction mixture, the polynucleotide (such as a double-stranded DNA, a single-stranded DNA, a single-stranded DNA/RNA hybrid, or a double-stranded DNA/RNA hybrid) donor molecule includes:

(a) a nucleotide sequence that is recognizable by a specific binding agent;

(b) a nucleotide sequence encoding an RNA molecule or an amino acid sequence that is recognizable by a specific binding agent;

(c) a nucleotide sequence that encodes an RNA molecule or an amino acid sequence that binds specifically to a ligand;

(d) a nucleotide sequence that is responsive to a specific change in the physical environment; or (e) a nucleotide sequence encoding an RNA molecule or an amino acid sequence that is responsive to a specific change in the physical environment;

(f) a nucleotide sequence encoding at least one stop codon on each strand;

(g) a nucleotide sequence encoding at least one stop codon within each reading frame on each strand; or (h) at least partially self-complementary sequence, such that the polynucleotide molecule encodes a transcript that is capable of forming at least partially double-stranded RNA; or (i) a combination of any of (a)-(h).

Additional description relating to these various embodiments of nucleotide sequences included in the polynucleotide donor molecule is found in the section headed "Methods of changing expression of a sequence of interest in a genome".

Polynucleotides for Disrupting Gene Expression

In another aspect, the invention provides a polynucleotide (such as a double-stranded DNA, a single-stranded DNA, a single-stranded DNA/RNA hybrid, or a double-stranded DNA/RNA hybrid) molecule for disrupting gene expression, including double-stranded polynucleotides containing at least 18 base-pairs and encoding at least one stop codon in each possible reading frame on each strand and single-stranded polynucleotides containing at least 11 contiguous nucleotides and encoding at least one stop codon in each possible reading frame on the strand. Such a stop-codon-containing polynucleotide, when integrated or inserted at the site of a DSB in a genome, disrupts or hinders translation of an encoded amino acid sequence. In embodiments, the polynucleotide is a double-stranded DNA or double-stranded DNA/RNA hybrid molecule including at least 18 contiguous base-pairs and encoding at least one stop codon in each possible reading frame on either strand; in embodiments, the polynucleotide is a double-stranded DNA or double-stranded DNA/RNA hybrid molecule that is blunt-ended; in other embodiments, the polynucleotide is a double-stranded DNA or double-stranded DNA/RNA hybrid molecule that has one or more overhangs or unpaired nucleotides at one or both termini. In embodiments, the polynucleotide is double-stranded and includes between about 18 to about 300 nucleotides on each strand. In embodiments, the polynucleotide is a single-stranded DNA or a single-stranded DNA/RNA hybrid molecule including at least 11 contiguous nucleotides and encoding at least one stop codon in each possible reading frame on the strand. In embodiments, the polynucleotide is single-stranded and includes between 11 and about 300 contiguous nucleotides in the strand.

In embodiments, the polynucleotide for disrupting gene expression further includes a nucleotide sequence that provides a useful function when integrated into the site of a DSB in a genome. For example, in various non-limiting embodiments the polynucleotide further includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription at the site of the DSB, or sequence having secondary structure (e. g., double-stranded stems or stem-loops) or than encodes a transcript having secondary structure (e. g., double-stranded RNA that is cleavable by a Dicer-type ribonuclease).

In an embodiment, the polynucleotide for disrupting gene expression is a double-stranded DNA or a double-stranded DNA/RNA hybrid molecule, wherein each strand of the polynucleotide includes at least 18 and fewer than 200 contiguous base-pairs, wherein the number of base-pairs is not divisible by 3, and wherein each strand encodes at least one stop codon in each possible reading frame in the 5' to 3' direction. In an embodiment, the polynucleotide is a double-stranded DNA or a double-stranded DNA/RNA hybrid molecule, wherein the polynucleotide includes at least one phosphorothioate modification.

Related aspects include larger polynucleotides such as a plasmid, vector, or chromosome including the polynucleotide for disrupting gene expression, as well as polymerase primers for amplification of the polynucleotide for disrupting gene expression.

Methods of Identifying the Locus of a Double-Stranded Break

In another aspect, the invention provides a method of identifying the locus of at least one double-stranded break (DSB) in genomic DNA in a cell (such as a plant cell or plant protoplast) including the genomic DNA, the method including: (a) contacting the genomic DNA having a DSB with a polynucleotide (such as a double-stranded DNA, a single-stranded DNA, a single-stranded DNA/RNA hybrid, or a double-stranded DNA/RNA hybrid) molecule, wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; and (b) using at least part of the sequence encoded by the polynucleotide molecule as a target for PCR primers to allow amplification of DNA in the locus of the double-stranded break. In embodiments, the genomic DNA is that of a nucleus, mitochondrion, or plastid. In embodiments, the DSB locus is identified by amplification using primers specific for DNA sequence encoded by the polynucleotide molecule alone; in other embodiments, the DSB locus is identified by amplification using primers specific for a combination of DNA sequence encoded by the polynucleotide donor molecule and genomic DNA sequence flanking the DSB. Such identification using a heterologously integrated DNA sequence (i. e., that encoded by the polynucleotide molecule) is useful, e. g., to distinguish a cell (such as a plant cell or plant protoplast) containing sequence encoded by the polynucleotide molecule integrated at the DSB from a cell that does not. Identification of an edited genome from a non-edited genome is important for various purposes, e. g., for commercial or regulatory tracking of cells or biological material such as plants or seeds containing an edited genome.

In a related aspect, the invention provides a method of identifying the locus of double-stranded breaks (DSBs) in genomic DNA in a pool of cells (such as a pool of plant cells or plant protoplasts), wherein the pool of cells includes cells having genomic DNA with sequence encoded by a polynucleotide (such as a double-stranded DNA, a single-stranded DNA, a single-stranded DNA/RNA hybrid, or a double-stranded DNA/RNA hybrid) donor molecule inserted at the locus of the double stranded breaks; wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; wherein the sequence encoded by the polynucleotide molecule is used as a target for PCR primers to allow amplification of DNA in the region of the double-stranded breaks. In embodiments, the genomic DNA is that of a nucleus, mitochondrion, or plastid. In embodiments, the pool of cells is a population of plant cells or plant protoplasts, wherein the population of plant cells or plant protoplasts include multiple different DSBs (e. g., induced by different guide RNAs) in the genome. In embodiments, each DSB locus is identified by amplification using primers specific for DNA sequence encoded by the polynucleotide molecule alone; in other embodiments, each DSB locus is identified by amplification using primers specific for a combination of DNA sequence encoded by the polynucleotide molecule and genomic DNA sequence flanking the DSB. Such identification using a heterologously integrated DNA sequence (i. e., sequence encoded by the polynucleotide molecule) is useful, e. g., to identify a cell (such as a plant cell or plant protoplast) containing sequence encoded by the polynucleotide molecule integrated at a DSB from a cell that does not.

In embodiments, the pool of cells is a pool of isolated plant cells or plant protoplasts in liquid or suspension culture, or cultured in or on semi-solid or solid media. In embodiments, the pool of cells is a pool of plant cells or plant protoplasts encapsulated in a polymer or other encapsulating material, enclosed in a vesicle or liposome, or embedded in or attached to a matrix or other solid support (e. g., beads or microbeads, membranes, or solid surfaces). In embodiments, the pool of cells is a pool of plant cells or plant protoplasts encapsulated in a polysaccharide (e. g., pectin, agarose). In embodiments, the pool of cells is a pool of plant cells located in a plant, plant part, or plant tissue, and the cells are optionally isolated from the plant, plant part, or plant tissue in a step following the integration of a polynucleotide at a DSB.

In embodiments, the polynucleotide donor molecule that is integrated (or has sequence that is integrated) at the DSB is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the polynucleotide donor molecule that is integrated (or has sequence that is integrated) at the DSB is a double-stranded DNA or double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides; in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labelled with a fluorescent moiety or other detectable label. In an embodiment, the polynucleotide donor molecule is double-stranded and is perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In related embodiments, the polynucleotide donor molecule that is integrated at the DSB is a single-stranded DNA or a single-stranded DNA/RNA hybrid. Additional description of the polynucleotide donor molecule is found above in the paragraphs following the heading "Polynucleotide Molecules".

In embodiments, the polynucleotide (such as a double-stranded DNA, a single-stranded DNA, a single-stranded DNA/RNA hybrid, or a double-stranded DNA/RNA hybrid) donor molecule that is integrated at the DSB includes a nucleotide sequence that, if integrated (or has sequence that is integrated) at the DSB, forms a heterologous insertion that is not normally found in the genome. In embodiments, sequence encoded by the polynucleotide molecule that is integrated at the DSB includes a nucleotide sequence that does not normally occur in the genome containing the DSB; this can be established by sequencing of the genome, or by hybridization experiments. In certain embodiments, sequence encoded by the polynucleotide molecule, when integrated at the DSB, not only permits identification of the locus of the DSB, but also imparts a functional trait to the cell including the genomic DNA, or to an organism including the cell; in non-limiting examples, sequence encoded by the polynucleotide molecule that is integrated at the DSB includes at least one of the nucleotide sequences selected from the group consisting of:

(a) DNA encoding at least one stop codon, or at least one stop codon on each strand, or at least one stop codon within each reading frame on each strand;

(b) DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB);

(c) DNA encoding a unique identifier sequence (e. g., a sequence that when inserted at the DSB creates a heterologous sequence that can be used to identify the presence of the insertion);

(d) DNA encoding a transcript-stabilizing sequence;

(e) DNA encoding a transcript-destabilizing sequence;

(f) a DNA aptamer or DNA encoding an RNA aptamer or amino acid aptamer; and (g) DNA that includes or encodes a sequence recognizable by a specific binding agent.

Methods of Identifying the Nucleotide Sequence of a Locus in the Genome that is Associated with a Phenotype In another aspect, the invention provides a method of identifying the nucleotide sequence of a locus in the genome that is associated with a phenotype, the method including the steps of:

(a) providing to a population of cells (such as plant cells or plant protoplasts) having the genome:
  (i) multiple different guide RNAs (gRNAs) to induce multiple different double strand breaks (DSBs) in the genome, wherein each DSB is produced by an RNA-guided nuclease guided to a locus on the genome by one of the gRNAs, and
  (ii) polynucleotide (such as a double-stranded DNA, a single-stranded DNA, a single-stranded DNA/RNA hybrid, or a double-stranded DNA/RNA hybrid) donor molecules having a defined nucleotide sequence, wherein the polynucleotide molecules are capable of being integrated (or have sequence that is integrated) into the DSBs by non-homologous end-joining (NHEJ);
  whereby when sequence encoded by at least some of the polynucleotide molecules are inserted into at least some of the DSBs, a genetically heterogeneous population of cells is produced;

(b) selecting from the genetically heterogeneous population of cells a subset of cells that exhibit a phenotype of interest;

(c) using a pool of PCR primers that bind to sequence encoded by the polynucleotide molecules to amplify from the subset of cells DNA from the locus of a DSB into which sequence encoded by one of the polynucleotide molecules has been inserted; and (d) sequencing the amplified DNA to identify the locus associated with the phenotype of interest.

In embodiments, the cells are plant cells or plant protoplasts or algal cells. In embodiments, the genetically heterogeneous population of cells undergoes one or more doubling cycles; for example, the population of cells is provided with growth conditions that should normally result in cell division, and at least some of the cells undergo one or more doublings. In embodiments, the genetically heterogeneous population of cells is subjected to conditions permitting expression of the phenotype of interest. In embodiments, the cells are provided in a single pool or population (e. g., in a single container); in other embodiments, the cells are provided in an arrayed format (e. g., in microwell plates or in droplets in a microfluidics device or attached individually to particles or beads).

In embodiments, the RNA-guided nuclease or a polynucleotide that encodes the RNA-guided nuclease is exogenously provided to the population of cells. In embodiments, each gRNA is provided as a polynucleotide composition including: (a) a CRISPR RNA (crRNA) that includes the gRNA, or a polynucleotide that encodes a crRNA, or a polynucleotide that is processed into a crRNA; or (b) a single guide RNA (sgRNA) that includes the gRNA, or a polynucleotide that encodes a sgRNA, or a polynucleotide that is processed into a sgRNA In embodiments, the multiple guide RNAs are provided as ribonucleoproteins (e. g., Cas9 nuclease molecules complexed with different gRNAs to form different RNPs). In embodiments, each gRNA is provided as a ribonucleoprotein (RNP) including the RNA-guided nuclease and an sgRNA. In embodiments, multiple guide RNAs are provided, as well as a single polynucleotide donor molecule having a sequence to be integrated at the resulting DSBs; in other embodiments, multiple guide RNAs are provided, as well as different polynucleotide donor molecules having a sequence to be integrated at the resulting multiple DSBs.

In another embodiment, a detection method is provided for identifying a plant as having been subjected to genomic modification according to a targeted modification method described herein, where that modification method yields a low frequency of off-target mutations. The detection method comprises a step of identifying the off-target mutations (e.g., an insertion of a non-specific sequence, a deletion, or an indel resulting from the use of the targeting agents, or insertions of part or all of a sequence encoded by one or more polynucleotide donor molecules at one or more coding or non-coding loci in a genome). In a related embodiment, the detection method is used to track of movement of a plant cell or plant or product thereof through a supply chain. The presence of such an identified mutation in a processed product or commodity product is de facto evidence that the product contains or is derived from a plant cell, plant, or seed of this invention. In related embodiments, the presence of the off-target mutations are identified using PCR, a chip-based assay, probes specific for the donor sequences, or any other technique known in the art to be useful for detecting the presence of particular nucleic acid sequences.

EXAMPLES

Example 1

This example illustrates techniques for preparing a plant cell or plant protoplast useful in compositions and methods of the invention, for example, in providing a reaction mixture including a plant cell having a double-strand break (DSB) at least one locus in its genome. More specifically this non-limiting example describes techniques for preparing isolated, viable plant protoplasts from monocot and dicot plants.

The following mesophyll protoplast preparation protocol (modified from one publicly available at molbio[dot]mgh [dot]harvard.edu/sheenweb/protocols_reg[dot]html) is generally suitable for use with monocot plants such as maize (*Zea mays*) and rice (*Oryza sativa*):

Prepare an enzyme solution containing 0.6 molar mannitol, 10 millimolar MES pH 5.7, 1.5% cellulase R10, and 0.3% macerozyme R10. Heat the enzyme solution at 50-55 degrees Celsius for 10 minutes to inactivate proteases and accelerate enzyme solution and cool it to room temperature before adding 1 millimolar $CaCl_2$), 5 millimolar β-mercaptoethanol, and 0.1% bovine serum albumin. Pass the enzyme solution through a 0.45 micrometer filter. Prepare a washing solution containing 0.6 molar mannitol, 4 millimolar MES pH 5.7, and 20 millimolar KCl.

Obtain second leaves of the monocot plant (e. g., maize or rice) and cut out the middle 6-8 centimeters. Stack ten leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of washing buffer. Measure the concentration of protoplasts using a hemocytometer and adjust the concentration to $2 \times 10^5$ protoplasts/milliliter with washing buffer.

The following mesophyll protoplast preparation protocol (modified from one described by Niu and Sheen (2012) *Methods Mol. Biol.*, 876:195-206, doi: 10.1007/978-1-61779-809-2_16) is generally suitable for use with dicot plants such as *Arabidopsis thaliana* and brassicas such as kale (*Brassica oleracea*).

Prepare an enzyme solution containing 0.4 M mannitol, 20 millimolar KCl, 20 millimolar MES pH 5.7, 1.5% cellulase R10, and 0.4% macerozyme R10. Heat the enzyme solution at 50-55 degrees Celsius for 10 minutes to inactivate proteases and accelerate enzyme solution, and then cool it to room temperature before adding 10 millimolar $CaCl_2$, 5 millimolar β-mercaptoethanol, and 0.1% bovine serum albumin. Pass the enzyme solution through a 0.45 micrometer filter. Prepare a "W5" solution containing 154 millimolar NaCl, 125 millimolar $CaCl_2$, 5 millimolar KCl, and 2 millimolar MES pH 5.7. Prepare a "MMg solution" solution containing 0.4 molar mannitol, 15 millimolar $MgCl_2$, and 4 millimolar MES pH 5.7.

Obtain second or third pair true leaves of the dicot plant (e. g., a *brassica* such as kale) and cut out the middle section. Stack 4-8 leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri dish with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of MMg solution. Measure the concentration of protoplasts using a hemocytometer and adjust the concentration to 2×10'5 protoplasts/milliliter with MMg solution.

Example 2

This example illustrates culture conditions effective in improving viability of plant cells or plant protoplasts. More specifically, this non-limiting example describes media and culture conditions for improving viability of isolated plant protoplasts.

Table 1 provides the compositions of different liquid basal media suitable for culturing plant cells or plant protoplasts; final pH of all media was adjusted to 5.8 if necessary.

TABLE 1

| | Concentration mg/L unless otherwise noted) | | | | |
|---|---|---|---|---|---|
| Component | SH | 8p | PIM | P2 | YPIMB- |
| Casamino acids | | 250 | | | |
| Coconut water | | 20000 | | | |
| Ascorbic acid | | 2 | | | |
| biotin | | | 0.01 | | 0.01 |
| Cholicalciferol (Vitamin D-3) | | | 0.01 | | |
| choline chloride | | 1 | | | |
| Citric acid | | 40 | | | |
| Cyanocobalamin (Vitamin B-12) | | 0.02 | | | |
| D-calcium pantothenate | | 1 | | | |
| D-Cellobiose | | 250 | | | |
| D-Fructose | | 250 | | | |
| D-Mannose | | 250 | | | |
| D-Ribose | | 250 | | | |
| D-Sorbitol | | 250 | | | |
| D-Xylose | | 250 | | | |
| folic acid | | 0.4 | 0.2 | | |
| Fumaric acid | | 40 | | | |
| L-Malic acid | | 40 | | | |
| L-Rhamnose | | 250 | | | |
| p-Aminobenzoic acid | | 0.02 | | | |
| Retinol (Vitamin A) | | 0.01 | | | |
| Riboflavin | | 0.2 | | | |
| Sodium pyruvate | | 20 | | | |
| 2,4-D | 0.5 | 0.2 | 1 | 5 | 1 |
| 6-benzylaminopurine (BAP) | | | | | 1 |
| Indole-3-butyric acid (IBA) | | | 2.5 | | |

TABLE 1-continued

| | Concentration mg/L unless otherwise noted) | | | | |
|---|---|---|---|---|---|
| Component | SH | 8p | PIM | P2 | YPIMB- |
| Kinetin | 0.1 | | | | |
| Naphthaleneacetic acid (NAA) | | 1 | | | |
| parachlorophenoxyacetate (pCPA) | | 2 | | | |
| Thidiazuron | | | 0.022 | | |
| Zeatin | | 0.5 | | | |
| AlCl3 | | | 0.03 | | |
| Bromocresol purple | | | 8 | | |
| CaCl$_2$•2H$_2$O | 200 | 600 | 440 | 200 | 440 |
| CoCl$_2$•6H$_2$O | 0.1 | 0.025 | | 0.1 | |
| CuSO$_4$•5H$_2$O | 0.2 | 0.025 | 0.03 | 0.2 | 0.03 |
| D-Glucose | | 68400 | 40000 | | 40000 |
| D-Mannitol | 52000 | 250 | 60000 | 52000 | 60000 |
| FeSO$_4$•7H$_2$O | 15 | 27.8 | 15 | 15 | 15 |
| H$_3$BO$_3$ | 5 | 3 | 1 | 5 | 1 |
| KCl | | 300 | | | |
| KH$_2$PO$_4$ | | 170 | 170 | | 170 |
| KI | 1 | 0.75 | 0.01 | 1 | 0.01 |
| KNO$_3$ | 2500 | 1900 | 505 | 2500 | 505 |
| MES pH 5.8 (mM) | | | 3.586 | 25 | 25 |
| MgSO$_4$•7H$_2$O | 400 | 300 | 370 | 400 | 370 |
| MnSO$_4$•H$_2$O | 10 | 10 | 0.1 | 10 | 0.1 |
| Na$_2$EDTA | 20 | 37.3 | 20 | 20 | 20 |
| Na$_2$MoO$_4$•2H$_2$O | 0.1 | 0.25 | | 0.1 | |
| NH$_4$H$_2$PO$_4$ | | 300 | | 300 | |
| NH$_4$NO$_3$ | | 600 | 160 | | 160 |
| NiCl$_2$•6H$_2$O | | | 0.03 | | |
| Sucrose | 30000 | 2500 | | 30000 | |
| ZnSO$_4$•7H$_2$O | 1 | 2 | 1 | 1 | 1 |
| Tween-80 (microliter/L) | | | 10 | | 10 |
| Inositol | 1000 | 100 | 100 | 1000 | 100 |
| Nicotinamide | | 1 | | | |
| Nicotinic acid | 5 | | 1 | 5 | 1 |
| Pyridoxine•HCl | 0.5 | 1 | 1 | 0.5 | 1 |
| Thiamine•HCl | 5 | 1 | 1 | 5 | 1 |

*Sources for basal media:
SH - Schenk and Hildebrandt, *Can. J. Bot.* 50:199 (1971).
8p - Kao and Michayluk, *Planta* 126:105 (1975).
P2 - SH but with hormones from Potrykus et al., *Mol. Gen. Genet.* 156:347 (1977).
PIM - Chupeau et al., The Plant Cell 25:2444 (2013).

Example 3

This example illustrates culture conditions effective in improving viability of plant cells or plant protoplasts. More specifically, this non-limiting example describes methods for encapsulating isolated plant protoplasts.

When protoplasts are encapsulated in alginate or pectin, they remain intact far longer than they would in an equivalent liquid medium. In order to encapsulate protoplasts, a liquid medium ("calcium base") is prepared that is in all other respects identical to the final desired recipe with the exception that the calcium (usually CaCl2.2H2O) is increased to 80 millimolar. A second medium ("encapsulation base") is prepared that has no added calcium but contains 10 g/L of the encapsulation agent, e. g., by making a 20 g/L solution of the encapsulation agent and adjusting its pH with KOH or NaOH until it is about 5.8, making a 2×solution of the final medium (with no calcium), then combining these two solutions in a 1:1 ratio. Encapsulation agents include alginate (e. g., alginic acid from brown algae, catalogue number A0682, Sigma-Aldrich, St. Louis, Mo.) and pectin (e. g., pectin from citrus peel, catalogue number P9136, Sigma-Aldrich, St. Louis, Mo.; various pectins including non-amidated low-methoxyl pectin, catalogue number 1120-50 from Modernist Pantry, Portsmouth, N.H.). The solutions, including the encapsulation base solution, is filter-sterilized through a series of filters, with the final filter being a 0.2-micrometer filter. Protoplasts are pelleted by gentle centrifugation and resuspended in the encapsulation base; the resulting suspension is added dropwise to the calcium base, upon which the protoplasts are immediately encapsulated in solid beads.

Example 4

This example illustrates culture conditions effective in improving viability of plant cells or plant protoplasts. More specifically, this non-limiting example describes observations of effects on protoplast viability obtained by adding non-conventionally high levels of divalent cations to culture media.

Typical plant cell or plant protoplast media contain between about 2 to about 4 millimolar calcium cations and between about 1-1.5 millimolar magnesium cations. In the course of experiments varying and adding components to media, it was discovered that the addition of non-conventionally high levels of divalent cations had a surprisingly beneficial effect on plant cell or plant protoplast viability. Beneficial effects on plant protoplast viability begin to be seen when the culture medium contains about 30 millimolar calcium cations (e. g., as calcium chloride) or about 30 millimolar magnesium cations (e. g., as magnesium chloride). Even higher levels of plant protoplast viability were observed with increasing concentrations of calcium or magnesium cations, i. e., at about 40 millimolar or about 50 millimolar calcium or magnesium cations. The result of several titration experiments indicated that greatest improvement in protoplast viability was seen using media containing between about 50 to about 100 millimolar calcium cations or 50 to about 100 millimolar magnesium cations; no negative effects on protoplast viability or physical appearance was observed at these high cation levels. This was observed in multiple experiments using protoplasts obtained from several plant species including maize (multiple germplasms, e. g., B73, A188, B104, HiIIA, HiIIB, BMS), rice, wheat, soy, kale, and strawberry; improved protoplast viability was observed in both encapsulated protoplasts and non-encapsulated protoplasts. Addition of potassium chloride at the same levels had no effect on protoplast viability. It is possible that inclusion of slightly lower (but still non-conventionally high) levels of divalent cations (e. g., about 10 millimolar, about 15 millimolar, about 20 millimolar, or about 25 millimolar calcium cations or magnesium cations) in media is beneficial for plant cells or plant protoplasts of additional plant species.

Example 5

This example illustrates culture conditions effective in improving viability of plant cells or plant protoplasts. More specifically, this non-limiting example describes observations of effects on maize, soybean, and strawberry protoplast viability obtained by adding non-conventionally high levels of divalent cations to culture media.

Separate suspensions of maize B73, winter wheat, soy, and strawberry protoplasts ($2\times10^5$ cells per milliliter) were prepared in YPIM B— liquid medium containing calcium chloride at 0, 50, or 100 millimolar. One-half milliliter aliquots of the suspensions were dispensed into a 24-well microtiter plate.

Viability at day 8 of culture was judged by visualization under a light microscope. At this point, the viability of the maize protoplasts in the 0, 50, and 100 millimolar calcium conditions was 10%, 30%, and 80%, respectively. There were no large differences observed at this time point for protoplasts of the other species.

Viability at day 13 was judged by Evans blue staining and visualization under a light microscope. At this point, the viability of the maize protoplasts in the 0, 50, and 100 millimolar calcium conditions was 0%, 0%, and 10%, respectively; viability of the soybean protoplasts in the 0, 50, and 100 millimolar calcium conditions was 0%, 50%, and 50%, respectively; and viability of the maize protoplasts in the 0 and 50 millimolar calcium conditions was 0% and 50%, respectively (viability was not measured for the 100 millimolar condition). These results demonstrate that culture conditions including calcium cations at 50 or 100 millimolar improved viability of both monocot and dicot protoplasts over a culture time of ~13 days.

Example 6

This example illustrates a method of delivery of an effector molecule to a plant cell or plant protoplast to effect a genetic change, in this case introduction of a double-strand break in the genome. More specifically, this non-limiting example describes a method of delivering a guide RNA (gRNA) in the form of a ribonucleoprotein (RNP) to isolated plant protoplasts.

The following delivery protocol (modified from one publicly available at molbio[dot]mgh[dot]harvard.edu/sheen-web/protocols_reg[dot]html) is generally suitable for use with monocot plants such as maize (*Zea mays*) and rice (*Oryza sativa*):

Prepare a polyethylene glycol (PEG) solution containing 40% PEG 4000, 0.2 molar mannitol, and 0.1 molar $CaCl_2$). Prepare an incubation solution containing 170 milligram/liter $KH_2PO_4$, 440 milligram/liter $CaCl_2.2H_2O$, 505 milligram/liter $KNO_3$, 160 milligram/liter $NH_4NO_3$, 370 milligram/liter $MgSO_4.7H_2O$, 0.01 milligram/liter KI, 1 milligram/liter H3B03, 0.1 milligram/liter $MnSO_4.4H_2O$, 1 milligram/liter $ZnSO_4.7H_2O$, 0.03 milligram/liter $CuSO_4.5H_2O$, 1 milligram/liter nicotinic acid, 1 milligram/liter thiamine HCl, 1 milligram/liter pyridoxine HCl, 0.2 milligram/liter folic acid, 0.01 milligram/liter biotin, 1 milligram/liter D-Ca-pantothenate, 100 milligram/liter myo-inositol, 40 grams/liter glucose, 60 grams/liter mannitol, 700 milligram/liter MES, 10 microliter/liter Tween 80, 1 milligram/liter 2,4-D, and 1 milligram/liter 6-benzylaminopurine (BAP); adjust pH to 5.6.

Prepare a crRNA:tracrRNA or guide RNA (gRNA) complex by mixing equal amounts of CRISPR crRNA and tracrRNA (obtainable e. g., as custom-synthesized Alt-R™ CRISPR crRNA and tracrRNA oligonucleotides from Integrated DNA Technologies, Coralville, Iowa): mix 6 microliters of 100 micromolar crRNA and 6 microliters of 100 micromolar tracrRNA, heat at 95 degrees Celsius for 5 minutes, and then cool the crRNA:tracrRNA complex to room temperature. To the cooled gRNA solution, add 10 micrograms Cas9 nuclease (Aldevron, Fargo, N. Dak.) and incubate 5 minutes at room temperature to allow the ribonucleoprotein (RNP) complex to form. Add the RNP solution to 100 microliters of monocot protoplasts (prepared as described in Example 1) in a microfuge tube; add 5 micrograms salmon sperm DNA (VWR Cat. No.: 95037-160) and an equal volume of the PEG solution. Mix gently by tapping. After 5 minutes, dilute with 880 microliters of washing buffer and mix gently by inverting the tube. Centrifuge 1 minute at 1200 rpm and then remove the supernatant. Resuspend the protoplasts in 1 milliliter incubation solution and transfer to a multi-well plate. The efficiency of genome editing is assessed by any suitable method such as heteroduplex cleavage assay or by sequencing, as described elsewhere in this disclosure.

The following delivery protocol (modified from one described by Niu and Sheen (2012) *Methods Mol. Biol.,* 876:195-206, doi:10.1007/978-1-61779-809-2_16) is generally suitable for use with dicot plants such as *Arabidopsis thaliana* and brassicas such as kale (*Brassica oleracea*):

Prepare a polyethylene glycol (PEG) solution containing 40% PEG 4000, 0.2 molar mannitol, and 0.1 molar $CaCl_2$). Prepare an incubation solution containing 170 milligram/liter $KH_2PO_4$, 440 milligram/liter $CaCl_2.2H_2O$, 505 milligram/liter $KNO_3$, 160 milligram/liter $NH_4NO_3$, 370 milligram/liter $MgSO_4.7H_2O$, 0.01 milligram/liter KI, 1 milligram/liter H3B03, 0.1 milligram/liter $MnSO_4.4H_2O$, 1 milligram/liter $ZnSO_4.7H_2O$, 0.03 milligram/liter $CuSO_4.5H_2O$, 1 milligram/liter nicotinic acid, 1 milligram/liter thiamine HCl, 1 milligram/liter pyridoxine HCl, 0.2 milligram/liter folic acid, 0.01 milligram/liter biotin, 1 milligram/liter D-Ca-pantothenate, 100 milligram/liter myo-inositol, 40 grams/liter glucose, 60 grams/liter mannitol, 700 milligram/liter MES, 10 microliter/liter Tween 80, 1 milligram/liter 2,4-D, and 1 milligram/liter 6-benzylaminopurine (BAP); adjust pH to 5.6.

Prepare a crRNA:tracrRNA or guide RNA (gRNA) complex by mixing equal amounts of CRISPR crRNA and tracrRNA (obtainable e. g., as custom-synthesized Alt-R™ CRISPR crRNA and tracrRNA oligonucleotides from Integrated DNA Technologies, Coralville, Iowa): mix 6 microliters of 100 micromolar crRNA and 6 microliters of 100 micromolar tracrRNA, heat at 95 degrees Celsius for 5 minutes, and then cool the crRNA:tracrRNA complex to room temperature. To the cooled gRNA solution, add 10 micrograms Cas9 nuclease (Aldevron, Fargo, N. Dak.) and incubate 5 minutes at room temperature to allow the ribonucleoprotein (RNP) complex to form. Add the RNP solution to 100 microliters of dicot protoplasts (prepared as described in Example 1) in a microfuge tube; add 5 micrograms salmon sperm DNA (VWR Cat. No.: 95037-160) and an equal volume of the PEG solution. Mix gently by tapping. After 5 minutes, dilute with 880 microliters of washing buffer and mix gently by inverting the tube. Centrifuge 1 minute at 1200 rpm and then remove the supernatant. Resuspend the protoplasts in 1 milliliter incubation solution and transfer to a multi-well plate. The efficiency of genome editing is assessed by any suitable method such as heteroduplex cleavage assay or by sequencing, as described elsewhere in this disclosure.

The above protocols for delivery of gRNAs as RNPs to plant protoplasts are adapted for delivery of guide RNAs alone to monocot or dicot protoplasts that express Cas9 nuclease by transient or stable transformation; in this case, the guide RNA complex is prepared as before and added to the protoplasts, but no Cas9 nuclease and no salmon sperm DNA is added. The remainder of the procedures are identical.

Example 7

This example illustrates genome editing in plants and further illustrates a method of delivering gene-editing effector molecules into a plant cell. This example describes introducing at least one double-strand break (DSB) in a genome in a plant cell or plant protoplast, by delivering at least one effector molecules to the plant cell or plant protoplast using at least one physical agent, such as a particulate, microparticulate, or nanoparticulate. More specifically, this non-limiting example illustrates introducing at least one double-strand break (DSB) in a genome in a plant cell or plant protoplast by contacting the plant cell or plant protoplast with a composition including at least one sequence-specific nuclease and at least one physical agent, such as at least one nanocarrier. Embodiments include those wherein the nanocarrier comprises metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylene-dioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), composites (e. g., polyvinylcarbazole/graphene, polystyrene/graphene, platinum/graphene, palladium/graphene nanocomposites), a polynucleotide, a poly (AT), a polysaccharide (e. g., dextran, chitosan, pectin, hyaluronic acid, and hydroxyethylcellulose), a polypeptide, or a combination of these. In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., poly-ethylene glycol, thiolated polyethylene glycol), polypeptides or proteins, and detectable labels (e. g., a fluorophore, an antigen, an antibody, or a quantum dot). Embodiments include those wherein the nanocarrier is a nanotube, a carbon nanotube, a multi-walled carbon nanotube, or a single-walled carbon nanotube. Specific nanocarrier embodiments contemplated herein include the single-walled carbon nanotubes, cerium oxide nanoparticles ("nanoceria"), and modifications thereof (e. g., with cationic, anionic, or lipid coatings) described in Giraldo et al. (2014) *Nature Materials*, 13:400-409; the single-walled carbon nanotubes and heteropolymer complexes thereof described in Zhang et al. (2013) *Nature Nanotechnol.*, 8:959-968 (doi:10.1038/NNANO.2013.236); the single-walled carbon nanotubes and heteropolymer complexes thereof described in Wong et al. (2016) *Nano Lett.*, 16:1161-1172; and the various carbon nanotube preparations described in US Patent Application Publication US 2015/0047074 and International Patent Application PCT/US2015/050885 (published as WO 2016/044698 and claiming priority to U.S. Provisional Patent Application 62/052,767), all of which patent applications are incorporated in their entirety by reference herein. See also, for example, the various types of particles and nanoparticles, their preparation, and methods for their use, e. g., in delivering polynucleotides and polypeptides to cells, disclosed in US Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In these examples, single-walled carbon nanotubes (SWCNT) and modifications thereof are prepared as described in Giraldo et al. (2014) *Nature Materials*, 13:400-409; Zhang et al. (2013) *Nature Nanotechnol.*, 8:959-968; Wong et al. (2016) *Nano Lett.*, 16:1161-1172; US Patent Application Publication US 2015/0047074; and International Patent Application PCT/US2015/050885 (published as WO 2016/044698). In an initial experiment, a DNA plasmid encoding green fluorescent protein (GFP) as a reporter is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. Efficiency of the SWCNT delivery of GFP across the plant cell wall and the cellular localization of the GFP signal is evaluated by microscopy.

In another experiment, plasmids encoding Cas9 and at least one guide RNA (gRNA), such as those described in Example 6, are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, RNA encoding Cas9 and at least one guide RNA (gRNA), such as those described in Example 6, are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, a ribonucleoprotein (RNP), prepared by complexation of Cas9 nuclease and at least one guide RNA (gRNA), is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

One of skill in the art would recognize that the above general compositions and procedures can be modified or combined with other reagents and treatments, such as those described in detail in the paragraphs following the heading "Delivery Methods and Delivery Agents". In addition, the single-walled carbon nanotubes (SWCNT) and modifications thereof prepared as described in Giraldo et al. (2014) *Nature Materials,* 13:400-409; Zhang et al. (2013) *Nature Nanotechnol.,* 8:959-968; Wong et al. (2016) *Nano Lett.,* 16:1161-1172; US Patent Application Publication US 2015/0047074; and International Patent Application PCT/US2015/050885 (published as WO 2016/044698) can be used to prepare complexes with other polypeptides or polynucleotides or a combination of polypeptides and polynucleotides (e. g., with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases).

Example 8

This example illustrates genome editing in plants and further illustrates a method of delivering gene-editing effector molecules into a plant cell. More specifically, this non-limiting example describes introducing at least one double-strand break (DSB) in a genome in a plant cell or plant protoplast, by contacting the plant cell or plant protoplast with a composition including a sequence-specific nuclease complexed with a gold nanoparticle.

In embodiments, at least one double-strand break (DSB) is introduced in a genome in a plant cell or plant protoplast, by contacting the plant cell or plant protoplast with a composition that includes a charge-modified sequence-specific nuclease complexed to a charge-modified gold nanoparticle, wherein the complexation is non-covalent, e. g., through ionic or electrostatic interactions. In an embodiment, a sequence-specific nuclease having at least one region bearing a positive charge forms a complex with a negatively-charged gold particle; in another embodiment, a sequence-specific nuclease having at least one region bearing a negative charge forms a complex with a positively-charged gold particle. Any suitable method can be used for modifying the charge of the nuclease or the nanoparticle, for instance, through covalent modification to add functional groups, or non-covalent modification (e. g., by coating a nanoparticle with a cationic, anionic, or lipid coating). In embodiments, the sequence-specific nuclease is a type II Cas nuclease having at least one modification selected from the group consisting of: (a) modification at the N-terminus with at least one negatively charged moiety; (b) modification at the N-terminus with at least one moiety carrying a carboxylate functional group; (c) modification at the N-terminus with at least one glutamate residue, at least one aspartate residue, or a combination of glutamate and aspartate residues; (d) modification at the C-terminus with a localization signal, transit, or targeting peptide; (e) modification at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with at least one negatively charged moiety and modified at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with a polyglutamate peptide and modified at the C-terminus with a nuclear localization signal (NLS). In embodiments, the gold nanoparticle has at least one modification selected from the group consisting of: (a) modification with positively charged moieties; (b) modification with at least one moiety carrying a positively charged amine; (c) modification with at least one polyamine; (d) modification with at least one lysine residue, at least one histidine residue, at least one arginine residue, at least one guanidine, or a combination thereof. Specific embodiments include those wherein: (a) the sequence-specific nuclease is a type II Cas nuclease modified at the N-terminus with at least one negatively charged moiety and modified at the C-terminus with a nuclear localization signal (NLS), a chloroplast transit peptide (CTP), or a mitochondrial targeting peptide (MTP); and the gold nanoparticle is modified with at least one positively charged moiety; (b) the type II Cas nuclease is a Cas9 from *Streptococcus pyogenes* modified at the N-terminus with a polyglutamate peptide and modified at the C-terminus with a nuclear localization signal (NLS); and the gold nanoparticle is modified with at least one at least one lysine residue, at least one histidine residue, at least one arginine residue, at least one guanidine, or a combination thereof; (c) the type II Cas nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is modified with at least one at least one lysine residue, at least one histidine residue, at least one arginine residue, at least one guanidine, or a combination thereof. In a specific embodiment, at least one double-strand break (DSB) is introduced in a genome in a plant cell or plant protoplast, by contacting the plant cell or plant protoplast with a composition including a sequence-specific nuclease complexed with a gold nanoparticle, wherein the sequence-specific nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is in the form of cationic arginine gold nanoparticles (ArgNPs), and wherein when the modified Cas9 and the ArgNPs are mixed, self-assembled nanoassemblies are formed as described in Mout et al. (2017) *ACS Nano*, doi:10.1021/acsnano.6b07600. Other embodiments contemplated herein include the various nanoparticle-protein complexes (e. g., amine-bearing nanoparticles complexed with carboxylate-bearing proteins) described in International Patent Application PCT/US2016/015711, published as International Patent Application Publication WO2016/123514, which claims priority to U.S. Provisional Patent Applications 62/109,389, 62/132,798, and 62/169,805, all of which patent applications are incorporated in their entirety by reference herein.

In embodiments, the sequence-specific nuclease is an RNA-guided DNA endonuclease, such as a type II Cas nuclease, and the composition further includes at least one guide RNA (gRNA) for an RNA-guided nuclease, or a DNA encoding a gRNA for an RNA-guided nuclease. The method effects the introduction of at least one double-strand break (DSB) in a genome in a plant cell or plant protoplast; in embodiments, the genome is that of the plant cell or plant protoplast; in embodiments, the genome is that of a nucleus, mitochondrion, plastid, or endosymbiont in the plant cell or plant protoplast. In embodiments, the at least one double-strand break (DSB) is introduced into coding sequence, non-coding sequence, or a combination of coding and non-coding sequence. In embodiments, the plant cell or plant protoplast is a plant cell in an intact plant or seedling or plantlet, a plant tissue, seed, embryo, meristem, germline cells, callus, or a suspension of plant cells or plant protoplasts.

In embodiments, at least one dsDNA molecule is also provided to the plant cell or plant protoplast, and is integrated at the site of at least one DSB or at the location where genomic sequence is deleted between two DSBs. Embodiments include those wherein: (a) the at least one DSB is two blunt-ended DSBs, resulting in deletion of genomic sequence between the two blunt-ended DSBs, and wherein the dsDNA molecule is blunt-ended and is integrated into the genome between the two blunt-ended DSBs; (b) the at least one DSB is two DSBs, wherein the first DSB is blunt-ended and the second DSB has an overhang, resulting in deletion of genomic sequence between the two DSBs, and wherein the dsDNA molecule is blunt-ended at one terminus and has an overhang on the other terminus, and is integrated into the genome between the two DSBs; (c) the at least one DSB is two DSBs, each having an overhang, resulting in deletion of genomic sequence between the two DSBs, and wherein the dsDNA molecule has an overhang at each terminus and is integrated into the genome between the two DSBs.

In a non-limiting example, self-assembled green fluorescent protein (GFP)/cationic arginine gold nanoparticles (ArgNPs), nanoassemblies are prepared as described in International Patent Application Publication WO2016/123514. The GFP/ArgNP nanoassemblies are delivered to maize protoplasts and to kale protoplasts prepared as described in Example 1, and to protoplasts prepared from the Black Mexican Sweet (BMS) maize cell line. Efficiency of transfection or delivery is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are co-incubated with plant cells in suspension culture. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are further prepared for Biolistics or particle bombardment and thus delivered to plant cells from suspension cultures transferred to semi-solid or solid media, as well as to rice embryogenic callus. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are delivered by infiltration (e. g., using mild positive pressure or negative pressure) into leaves of *Arabidopsis thaliana* plants. Efficiency of transfection or delivery across the plant cell wall is assessed by fluorescence microscopy at time points after transfection (30 minutes, 1 hour, 3 hours, 6 hours, and overnight).

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered to maize protoplasts or to kale protoplasts prepared as described in Example 1, and to protoplasts prepared from the Black Mexican Sweet (BMS) maize cell line. In one variation of the procedure, the Cas9/ArgNP nanoassemblies are co-delivered with at least one guide RNA (such as those described in Examples, 4, 5, 8, 9, 10, 12, and 13) to the protoplasts. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the protoplasts. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are co-incubated with plant cells in suspension culture. In one variation of the procedure, the Cas9/ArgNP nanoassemblies are co-delivered with at least one guide RNA (such as those described in Examples, 4, 5, 8, 9, 10, 12, and 13) to the plant cells in suspension culture. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells in suspension culture. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are further prepared for Biolistics or particle bombardment and thus delivered to plant cells from suspension cultures transferred to semi-solid or solid media, as well as to rice embryogenic callus. In one variation of the procedure, the Cas9/ArgNP nanoassemblies are co-delivered with at least one guide RNA (such as those described in Examples, 4, 5, 8, 9, 10, 12, and 13) to the plant cells or callus. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells or callus. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) *ACS Nano*, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered by infiltration (e. g., using mild positive pressure or negative pressure) into leaves of *Arabidopsis thaliana* plants. In one variation of the procedure, the Cas9/ArgNP nanoassemblies are co-delivered with at least one guide RNA (such as those described in Examples, 4, 5, 8, 9, 10, 12, and 13) to the *Arabidopsis* leaves. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the *Arabidopsis* leaves. Efficiency of editing is assessed by any suitable method such as a heteroduplex cleavage assay or by sequencing, as described elsewhere in this disclosure.

One of skill in the art would recognize that alternatives to the above compositions and procedures can be used to edit plant cells and intact plants, tissues, seeds, and callus. In embodiments, nanoassemblies are made using other sequence-specific nucleases (e. g., zinc-finger nucleases (ZFNs), transcription activator-like effector nucleases (TAL-effector nucleases or TALENs), Argonaute proteins, or a meganuclease or engineered meganuclease) which can be similarly charge-modified. In embodiments, nanoassemblies are made using other nanoparticles (e. g., nanoparticles made of materials such as carbon, silicon, silicon carbide, gold, tungsten, polymers, ceramics, iron oxide, or cobalt ferrite) which can be similarly charge-modified in order to form non-covalent complexes with the charge-modified sequence-specific nuclease. Similar nanoassemblies including other polypeptides (e. g., phosphatases, hydrolases, oxidoreductases, transferases, lyases, recombinases, polymerases, ligases, and isomerases) or polynucleotides or a combination of polypeptides and polynucleotides are made using similar charge modification methods to enable non-covalent complexation with charge-modified nanoparticles. For example, similar nanoassemblies are made by complexing charge-modified nanoparticles with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases.

Example 9

As described herein, microinjection techniques can be used as an alternative to the methods for delivering targeting agents to protoplasts as described, e.g., in certain Examples above. Microinjection is typically used to target specific cells in isolated embryo sacs or the shoot apical meristem. See, e.g., U.S. Pat. No. 6,300,543, incorporated by reference herein. For example, an injector attached to a Naraskige manipulator on a dissecting microscope is adequate for injecting relatively large cells (e.g., the egg/synergids/zygote and the central cell). For smaller cells, such as those of the embryo or shoot apical meristem, a compound, inverted microscope with an attached Naraskige manipulator can be used. Injection pipette diameter and bevel are also important. Use a high quality pipette puller and beveler to prepare needles with adequate strength, flexibility and pore diameter. These will vary depending on the cargo being delivered to cells. The volume of fluid to be microinjected must be exceedingly small and must be carefully controlled. An Eppendorf Transjector yields consistent results (Laurie et al., 1999).

The genetic cargo can be RNA, DNA, protein or a combination thereof. The cargo can be designed to change one aspect of the target genome or many. The concentration of each cargo component will vary depending on the nature of the manipulation. Typical cargo volumes can vary from 2-20 nanoliters. After microinjection the treated plant parts are maintained on an appropriate media alone (e.g., sterile MS medium with 10% sucrose) or supplemented with a feeder culture. Plantlets are transferred to fresh MS media every two weeks and to larger containers as they grow. Plantlets with a well-developed root system are transferred to soil and maintained in high-humidity for 5 days to acclimate. Plants are gradually exposed to the air and cultivated to reproductive maturity.

Microinjection of Corn Embryos:

The cobs and tassels are immediately bagged when they appear to prevent pollination. To obtain zygote-containing maize embryo sacs, hand pollination of silks is performed when the silks are 6-10 cm long, the pollinated ears are bagged and tassels removed, and then ears are harvested at 16 hours later. After removing husks and silks, the cobs are cut transversely into 3 cm segments. The segments are surface sterilized in 70% ethanol and then rinsed in sterile distilled, deionized water. Ovaries are then removed and prepared for sectioning. The initial preparation may include mechanical removal of the ovarian wall, but this may not be required.

Once the ovaries have been removed, they are attached to a Vibratome sectioning block, an instrument designed to produce histological sections without chemical fixation or embedment. The critical attachment step is accomplished using a commercial adhesive such as Locktite cement. Normally 2-3 pairs of ovaries are attached on each sterile sectioning block with the adaxial ovarian surface facing upwards and perpendicular to the longitudinal axis of the rectangular sectioning block (Laurie et al., *In Vitro Cell Dev Biol.*, 35: 320-325, 1999). Ovarian sections (or "nucellar slabs") are obtained at a thickness of 200 to 400 micrometers. Ideal section thickness is 200 micrometers. The embryo sac will remain viable if it is not cut. The sections are collected with fine forceps and evaluated on a dissecting microscope with basal illumination. Sections with an intact embryo sac are placed on semi-solid Murashige-Skoog (MS) culture medium (Campenot et al., 1992) containing 15% sucrose and 0.1 mg/L benzylaminopurine. Sterile Petriplates containing semi-solid MS medium and nucellar slabs are then placed in an incubator maintained at 26° C. These can be monitored visually by removing plates from the incubator and examining the nucellar slabs with a dissecting microscope in a laminar flow hood.

Microinjection of Soy Embryonic Axes:

Mature soybean seeds are surface sterilized using chlorine gas. The gas is cleared by air flow in a sterile, laminar flow hood. Seeds are wetted with 70% ethanol for 30 seconds and rinsed with sterile distilled, deionized water then incubated in sterile distilled, deionized water for 30 minutes to 12 hours. The embryonic axes are carefully removed from the cotyledons and placed in MS media with the radicle oriented downwards and the apex exposed to air. The embryonic leaves are carefully removed with fine tweezers to expose the shoot apical meristem.

Microinjection of Rice:

Rice tissues that are appropriate for genome editing manipulation include embryogenic callus, exposed shoot apical meristems and 1 DAP embryos. There are many approaches to producing embryogenic callus (for example, Tahir 2010 (doi:10.1007/978-1-61737-988-8_21); Ge et al., 2006 (doi:10.1007/s00299-005-0100-7)). Shoot apical meristem explants can be prepared using a variety of methods in the art (see, e.g., Sticklen and Oraby, 2005 (doi:10.1079/IVP2004616); Baskaran and Dasgupta, 2012 (doi:10.1007/s13562-011-0078-x)). This work describes how to prepare and nurture material that is adequate for microinjection.

To prepare 1 DAP embryos for microinjection, Indica or japonica rice are cultivated under ideal conditions in a greenhouse with supplemental lighting with a 13-hour day, day/night temperatures of 30°/20° C., relative humidity between 60-80%, and adequate fertigation using Hoagland's solution or an equivalent. The 1 DAP zygotes are identified and prepped essentially as described in Zhang et al., 1999, *Plant Cell Reports* (doi:10.1007/s002990050722). The dissected ovaries with exposed zygotes are placed on the appropriate solid support medium and oriented for easy access using a microinjection needle. Injection and subsequent growth is carried out as described above in this Example.

Example 10

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA) and a nuclease to effect a DSB in the genome of a plant, and integration of sequence encoded by a double-stranded DNA (dsDNA) at the site of the DSB, wherein the dsDNA molecule includes a sequence recognizable by a specific binding agent, and wherein contacting the integrated sequence encoded by dsDNA molecule with the specific binding agent results in a change of expression of a sequence of interest. In this particular example, the sequence recognizable by a specific binding agent includes a recombinase recognition site sequence, the specific binding agent is a site-specific recombinase, and the change of expression is upregulation or downregulation or expression of a transcript having an altered sequence (for example, expression of a transcript that has had a region of DNA excised, inverted, or translocated by the recombinase).

The loxP ("locus of cross-over") recombinase recognition site and its corresponding recombinase Cre, were originally identified in the P1 bacteriophage. The wild-type loxP 34 base-pair sequence is ATAACTTCGTATA GCATACATTATACGAAGTTAT (SEQ ID NO:7) and includes two 13 base-pair palindromic sequences flanking an 8 base-pair spacer sequence; the spacer sequence, shown in underlined font, is asymmetric and provides directionality to the loxP site. Other useful loxP variants or recombinase recognition site sequence that function with Cre recombinase are provided in Table 2.

loxP sites is inverted. If the loxP sites are on separate DNA molecules, translocation of genomic sequence adjacent to the loxP site occurs. Examples of heterologous arrangements or integration patterns of recombinase recognition sites and methods for their use, particularly in plant breeding, are disclosed in U.S. Pat. No. 8,816,153 (see, for example, the Figures and working examples), the entire specification of which is incorporated herein by reference.

One of skill in the art would recognize that the details provided here are applicable to other recombinases and their corresponding recombinase recognition site sequences, such as, but not limited to, FLP recombinase and frt recombinase recognition site sequences, R recombinase and Rs recombinase recognition site sequences, Dre recombinase and rox recombinase recognition site sequences, and Gin recombinase and gix recombinase recognition site sequences.

TABLE 2

| SEQ ID NO: | Cre recombinase recognition site | Sequence |
| --- | --- | --- |
| 7 | LoxP (wild-type 1) | ATAACTTCGTATAGCATACATTATACGAAGTTAT |
| 8 | LoxP (wild-type 2) | ATAACTTCGTATAATGTATGCTATACGAAGTTAT |
| 9 | Canonical LoxP | ATAACTTCGTATANNNTANNNTATACGAAGTTAT |
| 10 | Lox 511 | ATAACTTCGTATAATGTATACTATACGAAGTTAT |
| 11 | Lox 5171 | ATAACTTCGTATAATGTGTACTATACGAAGTTAT |
| 12 | Lox 2272 | ATAACTTCGTATAAAGTATCCTATACGAAGTTAT |
| 13 | M2 | ATAACTTCGTATAAGAAACCATATACGAAGTTAT |
| 14 | M3 | ATAACTTCGTATATAATACCATATACGAAGTTAT |
| 15 | M7 | ATAACTTCGTATAAGATAGAATATACGAAGTTAT |
| 16 | M11 | ATAACTTCGTATAAGATAGAATATACGAAGTTAT |
| 17 | Lox 71 | TACCGTTCGTATANNNTANNNTATACGAAGTTAT |
| 18 | Lox 66 | ATAACTTCGTATANNNTANNNTATACGAACGGTA |

Cre recombinase catalyzes the recombination between two compatible (non-heterospecific) loxP sites, which can be located either on the same or on separate DNA molecules. Thus, in embodiments of the invention, polynucleotide (such as double-stranded DNA, single-stranded DNA, single-stranded DNA/RNA hybrid, or double-stranded DNA/RNA hybrid) molecules including compatible recombinase recognition sites sequence are integrated at the site of two or more double-strand breaks (DSBs) in a genome, which can be on the same or on separate DNA molecules (such as chromosomes). Depending on the number of recombinase recognition sites, where these are integrated, and in what orientation, various results are achieved, such as expression of a transcript that has had a region of DNA excised, inverted, or translocated by the recombinase. For example, in the case where one pair of loxP sites (or any pair of compatible recombinase recognition sites) are integrated at the site of DSBs in the genome, if the loxP sites are on the same DNA molecule and integrated in the same orientation, the genomic sequence flanked by the loxP sites is excised, resulting in a deletion of that portion of the genome. If the loxP sites are on the same DNA molecule and integrated in opposite orientation, the genomic sequence flanked by the Example 11

This example illustrates a method of identifying a nucleotide sequence associated with a phenotype of interest. More specifically, this non-limiting example describes delivering a guide RNA (gRNA) in the form of a ribonucleoprotein (RNP) to isolated plant protoplasts, followed by screening to identify the protoplasts in which the target nucleotide sequence has been altered by the introduction of a double-strand break.

Rice (*Oryza sativa*) protoplasts were prepared according to the protocol described in Example 1. Multiple guide RNAs are prepared as described in Example 6 using crRNAs with the sequences provided in Table 3, complexed with a tracrRNA to form the gRNA (crRNA:tracrRNA) complex; the targeted nucleotide sequences are OsADH1 (alcohol dehydrogenase 1) and OsLsi2 (a silicon or arsenic efflux exporter). Both the crRNAs and tracrRNA were purchased from Integrated DNA Technologies, Coralville, Iowa Ribonucleoprotein (RNP) complexes were then prepared as described in Example 6 using the gRNAs and Cas9 nuclease (Aldevron, Fargo, N. Dak.).

TABLE 3

| crRNA | crRNA sequence | SEQ ID NO |
| --- | --- | --- |
| OsADH1-1 | GCACUUGAUCACCUU CC CUGGUUUUAGAGCUAUGCU | 1654 |
| OsADH1-2 | UC CAC CUC CUCGAU CA CCAGGUUUUAGAGCUAUGCU | 1655 |
| OsADH1-3 | GGCCUCCCAGAAGUAGACGUGUUUUAGAGCUAUGCU | 1656 |
| OsADH1-4 | GGGAAGGUGAUCAAGUGCAAGUUUUAGAGCUAUGCU | 1657 |
| OsADH1-5 | GCCACCGUCGAACCCUUUGGGUUUUAGAGCUAUGCU | 1658 |
| OsADH1-6 | GUAAAUGGGCUUCCCGUUGAGUUUUAGAGCUAUGCU | 1659 |
| OsADH1-7 | GACAGACUCCCGUGUUCCCUGUUUUAGAGCUAUGCU | 1660 |

TABLE 3-continued

| crRNA | crRNA sequence | SEQ ID NO |
|---|---|---|
| OsADH1-8 | GUGAAUUCAGGAGCUGGAGGGUUUUAGAGCUAUGCU | 1661 |
| OsADH1-9 | GUACUUGCUGAGAUGACCAAGUUUUAGAGCUAUGCU | 1662 |
| OsADH1-10 | GCAACAUGUGUGAUCUGCUCGUUUUAGAGCUAUGCU | 1663 |
| OsLsi2-1 | UGGCCGGGAGGAUUCCCAUGGUUUUAGAGCUAUGCU | 1664 |
| OsLsi2-2 | AUGGUUCAUGCAGUGCACGGGUUUUAGAGCUAUGCU | 1665 |
| OsLsi2-3 | GCUCGAGGACGAACUCGGUGGUUUUAGAGCUAUGCU | 1666 |
| OsLsi2-4 | AUGUACUGGAGGGAGCUGGGGUUUUAGAGCUAUGCU | 1667 |
| OsLsi2-5 | UAGAAUGUAUAAUUACCCGUGUUUUAGAGCUAUGCU | 1668 |
| OsLsi2-6 | CGGGCCUCCCGGGAGCCAUCGUUUUAGAGCUAUGCU | 1669 |
| OsLsi2-7 | CAAGCACCUGGGGCGUCUGCGUUUUAGAGCUAUGCU | 1670 |
| OsLsi2-8 | GAGAUCAGAUCUUGCCGAUGGUUUUAGAGCUAUGCU | 1671 |
| OsLsi2-9 | GAAGGUGAUCUUGCUAUUGAGUUUUAGAGCUAUGCU | 1672 |
| OsLsi2-10 | GAAGAUGAGUGAGCUUGCGUGUUUUAGAGCUAUGCU | 1673 |

Arrayed screens can be conveniently carried out with protoplasts in multi-well (e. g., 24- or 96-well) plates. In this example, the protoplasts (25 microliters/well) were distributed in a 24-well plate treated with 5 microliters/well of an individual RNP complex according to the protocols described in Example 2. An HBT-sGFP plasmid was used as a transfection control (2 wells) and Cas9 protein without a guide RNA was used as a null control (2 wells); two technical replicas were performed.

In embodiments where editing of a target nucleotide sequence is expected to provide an observable phenotype, the phenotype can be used to select the plant cells or protoplasts having the edited sequence. Optionally, the plant cells or plant protoplasts are grown or cultured under conditions that permit expression of the phenotype, allowing selection of the plant cells or plant protoplasts that exhibit the phenotype. For example, rice cells or protoplasts in which the ADH1 gene is disrupted or altered by editing can be exposed to low concentrations of allyl alcohol; cells wherein one or both copies of the ADH1 gene has been disrupted will have increased susceptibility to allyl alcohol toxicity. In another example, rice cells or protoplasts in which the Lsi gene is disrupted or altered by editing are expected to have decreased arsenic content.

Pooled screens are carried out in a similar fashion, except that editing is carried out with multiple guide RNAs (e. g., in the form of multiple RNPs) provided to a complement of plant protoplasts.

Example 12

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule, at the site of at least one double-strand break (DSB) in a genome. This example further demonstrates integration of sequence encoded by double-stranded DNA, single-stranded DNA, and double-stranded DNA/RNA hybrid polynucleotides at a DSB in genomic sequence. More specifically, this non-limiting example illustrates using a ribonucleoprotein (RNP) including a guide RNA (gRNA) and a nuclease to effect a DSB in the genome of a monocot plant, and integration of sequence encoded by a polynucleotide donor molecule including a sequence recognizable by a specific binding agent, and wherein contacting the integrated sequence encoded by the polynucleotide donor molecule with the specific binding agent results in a change of expression of a sequence of interest. In this particular example, sequence encoded by a polynucleotide encoding an upstream open reading frame ("uORF", a small open reading frame (ORF) located in the 5' untranslated region upstream of, and controlling translation of, the main open reading frame of an mRNA) is integrated at a DSB upstream of (5' to) the coding sequence of the reporter gene luciferase. Translation of the uORF typically inhibits downstream translation of the main ORF, possibly by blocking ribosome access to the main ORF; in the presence of a microbe-associated molecular pattern (MAMP) molecule, inhibition by the uORF is lifted and the main ORF is translated.

The TBF1 transcription factor (TL1 binding factor, which binds to the TL1 cis element) is a key gene in plant defense systems, and both the transcription and translation of TBF1 is tightly controlled. Plants lacking a functional TBF1 have a compromised immune response to salicylic acid and to the microbe-associated molecular pattern (MAMP), elf18. Two uORFs are located 5' to the translation initiation codon of TBF1; both have an inhibitory effect on TBF1 translation which is alleviated with immune induction (induction of a defense response to pathogens), with the effect of uORF2 epistatic to that of uORF1; see Pajerowska-Mukhtar et al. (2012) Current Biol., 22:103-112. Both uORFs are highly enriched in aromatic amino acids, especially phenylalanine; uORF2 (At4g36988) is well-conserved among TBF1 homologues in other plant species. In addition to uORFs, another genetic element identified as important in translational control of TBF1 is a "R-motif", an mRNA consensus sequence consisting largely of purines, which interacts with poly-A-binding proteins; see Xu et al. (2017) Nature, 545:487-490, doi:10.1038/nature22371. Genes containing R-motifs and uORFS located upstream of the main ORF, show increased translation of the endogenous gene's main ORF in the presence of pathogen signals. Heterologous insertion of one or more of these immune-responsive elements (R-motifs and uORFs) upstream of an endogenous gene's main ORF provides a way to "tune" the translation level of an endogenous gene (even in the absence of pathogen signals (where translation is expected to be repressed). This approach can be employed in modifying endogenous genes to provide plants having enhanced expression of a gene when pathogen signals are present, without the growth or yield penalty potential in constitutive translation of the endogenous gene in question.

The following procedures are carried out to investigate the translational regulation potential of uORF sequences heterologously integrated upstream of a gene's main open reading frame. The rice (Oryza sativa) TBF1 gene (Os09g28354, see signal[dot]salk[dot]edu/cgi-bin/RiceGE?GENE=Os09g28340) contains a uORF similar to AtTBF1 (Xu et al. (2017) *Nature*, 545:491-494, doi: 10.1038/nature22372) but does not have an obvious purine-rich R-motif. A 5' UTR region of the rice (Os) TBF1 gene is provided in SEQ ID NO:1674 (AAGCGGAGGTCCG-GAGGAGGAAGCGGCGAGAGAAGCTCAGCTAGGC-AGGGCGACGGGCAGAAACGCGACCACGGCAACA-AACCCCGCCGCGCGCCCACCGTGCCGGTTA-CATGGGAGT AGAGGCGGGCGGCGGCTGCGGTGG-GAGGGCGGTAGTCACCGGATTC-TACGTCTGGGGCTGG GAGTTCCTCACCGCCCTCCTGCTCTTCTCGGCCAC-CACCTCCTACTAGCTATACACACCCATC TCACCAT-AACACACATACATAGATAGATAGATAGATAGATA-CATACACACAAACATAAGTA GCTAGGTAGAGAAAGAGATCATAGCGTTAGGT-GATCGATCG); this region includes: an upstream ORF (OsTBF1 uORF2, SEQ ID NO:1675 (ATGG-GAGTAGAGGCGGGCGGCGGCTGCGGTGG-GAGGGCGGTAGTCACCGGATTCTACGTCT GGGGCTGGGAGTTCCT-CACCGCCCTCCTGCTCTTCTCGGCCACCACCTCC-TACTAG), located at nucleotide positions 113-229 of SEQ ID NO:1674), Cas9 nuclease PAM motifs at nucleotide positions 69-71 and 126-128 of SEQ ID NO:1674, with the corresponding gRNA-specific target sequences at nucleotide positions 72-91 and 106-125 of SEQ ID NO:1674.

The rice (*Oryza sativa*) NPR1 gene (Os01g0194300, see, e. g., ensemble[dot]gramene[dot]org/Oryza_sativa/Gene/Summary?g=OS01G0194300; r=1:5060605-5065209; t=OS01T0194300-01) and its orthologues are involved in salicylic acid-induced broad-spectrum pathogen resistance in plants. A 5' region of the rice (Os) NPR1 gene is provided in SEQ ID NO:1676 (GAGGCCTCCTCCT-CGCCTCGCCTCGCCACGCCGCGCCGCGACGCGAC-GCGCCGTGGTCAGCTGGTCGCCGGTGCGGGTGC-GGGTGCGCA); this region includes a Cas9 nuclease PAM motif at nucleotide positions 51-53 of SEQ ID NO:1676, with a corresponding gRNA-specific target sequence at nucleotide positions 54-73 of SEQ ID NO:1676. In the presence of MAMP signals (e. g., the bacterial flagellin peptide fragment "flg22"), the OsTBF1 uORF2 sequence heterologously integrated upstream (e. g., at a double-strand break effected by Cas9 nuclease and a gRNA targeting nucleotide positions 54-73 of SEQ ID NO:1676) of the main NPR1 ORF is expected to induce NPR1-mediated broad-spectrum resistance to pathogens. Similar strategies to provide plants having improved resistance to pathogens includes integration of a uORF sequence upstream of the main ORF of other defense-related genes, such as the R genes (e. g., NB-LRR genes).

Various experiments investigating the ability of the OsTBF1 5' UTR sequence (SEQ ID NO:1674, including the uORF2 sequence SEQ ID NO:1675) to regulate translation are performed. In a first experiment, the OsTBF1 5' UTR sequence (SEQ ID NO:1674, including the uORF2 sequence SEQ ID NO:1675) is inserted 3' to a 35S promoter and 5' to a luciferase (LUC) reporter gene. A control construct comprises the 35S promoter driving expression of LUC. The two constructs are individually transfected into rice protoplasts using techniques similar to those described elsewhere in this specification. The luciferase activity of the 35S-OsTBF1-5'UTR-LUC construct is predicted to be lower than the luciferase activity of the control 35 S-LUC construct.

Another experiment is designed to delete the functional OsTBF1 uORF2, to test its effects on translation. Two guide RNAs designed to target the sequences at nucleotide positions 72-91 and 106-125 of SEQ ID NO:1674 are delivered to the 35S-OsTBF1-5'UTR-LUC-transformed cells (e. g., by Cas9 nuclease RNPs). This results in deletion of the genomic region (which includes the start codon of the uORF2's sequence) flanked by the double-stranded breaks effected by the two gRNAs; an increase in luciferase translation is expected with removal of the uORF's repressive effect.

Another experiment is designed to evaluate the OsTBF1 uORF2's responsiveness to MAMP signals and the effects of this on translation of an ORF downstream of the uORF. The 35S-OsTBF1-5'UTR-LUC-transformed cells are treated with 10 micromolar bacterial flg22 (e. g., catalogue number AS-62633, AnaSpec, Fremont, Calif.) as an elicitor signal, which is expected to lower the uORF's translational inhibition and result in increased luciferase translation.

A 15-nucleotide consensus sequence for purine-rich R-motifs is described in FIG. 2a of Xu et al. (2017) *Nature*, 545:487-490, doi:10.1038/nature22371. The ability of added R-motifs to regulate translation is tested by inserting an R-motif consisting of a 15-nucleotide poly(A) sequence (AAAAAAAAAAAAAAA (SEQ ID NO:1677)) or an AtTBF1 R-motif with the 25-nucleotide sequence CACATACACACAAAAATAAAAAAGA (SEQ ID NO:1678) 3' to the 35S promoter and 5' to the OsTBF1 uORF2 in the construct 35S-OsTBF1-5'UTR-LUC. Luciferase translation is compared in the 35S-R-motif-OsTBF1-5'UTR-LUC-transformed cells, with or without 10 micromolar bacterial flg22.

In one method to improve a plant's general immunity to pathogens, sequence encoded by a polynucleotide (such as a double-stranded DNA, a single-stranded DNA, a single-stranded DNA/RNA hybrid, or a double-stranded DNA/RNA hybrid) donor molecule including nucleotides having the sequence of or encoding an uORF is integrated at the site of at least one double-strand break (DSB) in a genome, wherein the DSB is located upstream of the transcription start site (TSS) of a plant defense gene main ORF. In embodiments, the polynucleotide is: (a) a double-stranded DNA molecule having at least one strand including an uORF, such as the OsTBF1 uORF2 sequence (SEQ ID NO:1675); (b) a single-stranded DNA molecule including an uORF, such as the OsTBF1 uORF2 sequence (SEQ ID NO:1675) or its complement; (c) a single-stranded polynucleotide that is a DNA/RNA hybrid and that includes an uORF, such as the OsTBF1 uORF2 sequence (SEQ ID NO:1675); or (d) a double-stranded DNA/RNA molecule including a DNA strand and an RNA strand capable of forming a double-stranded duplex, wherein at least one strand of the duplex includes an uORF, such as the OsTBF1 uORF2 sequence (SEQ ID NO:1675). In a non-limiting example, sequence encoded by a polynucleotide including nucleotides having the sequence of a uORF is integrated at the site of at least one DSB located upstream of the transcription start site (TSS) of the main ORF of the endogenous rice chitinase 8 gene (Os10g0542900; see, e. g., ensemble[dot]gramene[dot]org/Oryza_sativa/Gene/Summary?g=OS10G0542900;r=10: 21205700-21207611; t=OS10T0542900-01). A 5' region of the rice chitinase 8 gene is provided in SEQ ID NO:1679 (CAAACGC-CAAAACGCCACGGAAACAAATCAACAAT-TCCTCTCCTGTCAATGAACTTGTGT GCACGACAACTCATCTGACAGTGATC-CATCGTCCTTTTTCTTTGACTCGATGACTTTGT-GAGAGATGTTTTATGCCGATTTTATCTACTAAA-GTACTTACTAATCCTGCGGTTGATCCATCGCCGC-GCGGTTCACGCGCCAAATGACGAGTCGAAATGT-ATGCGTAGTTTGACCACATGCATAGCTCACTGGA- GAAGCTATTAGC-TATATATACCGCTGCAATGCTCGCTAGCT-TAGCTAAGCAACTGCA AGTGAAGCGGCGAC); this region includes a Cas9 nuclease PAM motif at nucleotide positions 319-321 of SEQ ID NO:1679, with a corresponding gRNA-specific target sequence at nucleotide positions 299-318 of SEQ ID NO:1679. A single-stranded DNA molecule including the OsTBF1 uORF2 sequence (SEQ ID NO:1675) is delivered to rice protoplasts together with an RNP including the Cas9 nuclease and a guide RNA designed to effect a DSB at the gRNA-specific target sequence at nucleotide positions 299-318 of SEQ ID NO:1679, which is located upstream of the transcription start site (TSS) of the chitinase ORF. The effect of the uORF2 sequence on chitinase 8 translation is measured by Western blot analysis with an anti-chitinase 8 antibody (catalogue number AS15 2889, Agrisera, Vannas, Sweden).

Example 13

OsABCC1 (GeneID, 4337027) is a member of *Oryza sativa* C-type ATP-binding cassette (ABC) transporter (OsABCC) family. OsABCC1 is involved in the detoxification and reduction of arsenic (As) in rice grains. OsABCC1 is localized to the phloem region of vascular bundles and limits As transport to the grains by sequestering As in vacuoles of the phloem companion cells of the nodes (doi:10.1073/pnas.1414968111).

Increase in the expression of OsABCC1 with constitutive enhancer element can reduce the amount of As transported to the grains. The OsABCC1 promoter region (300 bp) is TGTGAAGGTTCTGTAGTCGTCCTCTTGTGTT-TAATCTTGTTTTCTGAAATCATGAAGTCTTCCG CGTCTTGTTCTGATCCATGAGTATGTACTGAGGTT-TATGGGTGGAGTGAGGGCGATTCGTAC TAT-TTCTAATATGTGCATCAAACTGTAGGCGCTA GAGTAGTCGATTGCTATGGTTTTCTGTTC CTAGTT-GATCATTGTTCCAAGTATAGAAGTTTTGATGTTAA ATTGATGTTGCAAATACAGTGC TTATTGATTGGAT-TGCCAATTTATCATCGGTTTGCTCAATGAATCCAG (SEQ ID NO:1680).

The Gbox (40 nt, SEQ ID NO:1722) is inserted in Cas9/guide RNA cutting site, 106 bp, 209 bp, or 274 bp upstream of TSS. The crRNA sequences are AAAACAAGAUUAAACACAAGGUUUUAGAGC-UAUGCU (SEQ ID NO:1681), UGAUCCAUGAGUAU-GUACUGGUUUUAGAGCUAUGCU (SEQ ID NO:1682), and ACUUGGAACAAUGAUCAACUGUUUUAGAGC-UAUGCU (SEQ ID NO:1683).

As an exemplary assay for readout, use QPCR to check the transcript level of ABCC1.

Example 14

OsSDIR1 (*Oryza sativa* SALT-AND DROUGHT-INDUCED RING FINGER') (GeneID, 4332396) encodes a RING-finger containing E3 ligase. Upon drought treatment, the overexpression transgenic rice showed strong drought tolerance compared to control plants (doi:10.1007/s11103-011-9775-z). However, OsSDIR1 overexpressing rice showed slower growth at the early stage may be due to the constitutive activation of ABA signal transduction cascades, which enhances the ABA effect on the inhibition of plant growth.

OsSDIR1 promoter region (300 bp) is ATAAAAAAAACTCTCTAAAAATTTC-TATGTTTTTCTCCAAATGAAAGGCACTAAATAG-AGCA ATTTCTGCAGAAACCA-CATGTTCTTGCCGTTTCCCATCCCAGCTG-GAAGCACAAAAATAACC GTTTCTGTTTTGGCACGAGAAAAAAGTTTCGTC-CACCCATCATCCAATAGGCGGCCATTATG TAGC-CACGTGTCATCCAAATTTGCAACTAG-GAGGCAGAGGCTACGCAGCGCGCAGGATCTG AAACTGCAAAAAGAAAAAAGAAAAAAAAAAAC TTCCCCATCTTTCTAGCAGCTC. (SEQ ID NO:1684)

Green tissue-specific promoter (GSP, SEQ ID NO:1723) (doi:10.1038/srep18256) was identified as a tissue-specific cis-elements (44 nt). Insertion of GSP into the promoter region of OsSDIR1 may increase the expression of SDIR1 but not affect the plant growth. GSP is inserted in Cas9/guide RNA cutting site, 86 bp, 138 bp, or 258 bp upstream of TSS. The crRNA sequences are UAUGUUUUCUC-CAAAUGAAGUUUUAGAGCUAUGCU (SEQ ID NO:1685), GCCGCCUAUUGGAUGAUGGGGUUUUA-GAGCUAUGCU (SEQ ID NO:1686), and CAUC-CAAAUUUGCAACUAGGGUUUUAGAGCUAUGCU (SEQ ID NO:1687).

As an exemplary assay for readout, use QPCR to check the transcript level of SDIR.

Example 15

OsSWEET4 (GeneID, 4329093) is a member of *Oryza sativa* SWEET sugar transporter family (former MtN3 family, doi:10.1016/j.pbi.2015.04.005). OsSWEET4, as its maize ortholog, is involved in the import of glucose/fructose into the seed endosperm during seed filling and maturation. OsSWEET4 is localized at the plasma-membrane of a specific seed cells layer called the Basal Endosperm Transfer Layer, that is responsible to uptake and filter several metabolites into the rice endosperm and embryo. (doi:10.1038/ng.3422).

OsSWEET4 has been a target of artificial selection (domestication), and portions of its promoter and first intron-second exon-second intron are responsible to its increased expression in modern rice landraces compared with ancestral lines (*O. rufipogon*). OsSWEET4 increased expression is correlated with higher hexose import into the rice seed, contributing to increase seed size. OsSWEET4 expression is also regulated by its own substrate (glucose), and can be triggered by exogenous glucose application in protoplasts expressing OsSWEET4.

OsSWEET4 promoter region (400 bp upstream of TSS) AGGCGGTTACCCCGCGTTGCGCGCGTAGACGTA-CAGGGCGAGCCCTACAGGCCCCGGGACG GTGGTGGGACG-GATCGACACGGCGCGACGCACACGCACGCAAAC-CAAATCTTTTCGGACCA ACTCCTCCCCCC-CACGAATATTAATCATTTCTAAGCGTATTTATTGT CCTGCGAAGTTTTGTT TTATTTTATTTT-GAAAAAAGAGAGAGAGAGAGAGAGAGCAAAA GGTGACCACCAAGAGAA AGACCGGAGT-CACCAGCACTGACCACCAAGACCGTCACGG-GAGCGAGAGGGGACGGCCATGGGTGGGTGGGC CCGGCTCCCGGCTCCGTGCAGGCAGGGCCGCAG CGCAGGGGGAGTCGAG TCTATT-TAAGGCCCCCCTCCTCTCGCCCCCTC (SEQ ID NO:1688).

The enhancer OCS (SEQ ID NO:1724) is inserted in Cas9/guide RNA cutting site, 48 bp, 119 bp, or 264 bp upstream of TSS. The crRNA sequences are GAAAUGAUUAAUAUUCGUGGGUUUUAGAGC-UAUGCU (SEQ ID NO:1689), ACUGACCACCAA- GACCGUCAGUUUUAGAGCUAUGCU (SEQ ID NO:1690), and ACUCGACUCCCCUGCGCUG-GUUUUAGAGCUAUGCU (SEQ ID NO:1691).

As an exemplary assay for readout, use QPCR to check the transcript level of OsSWEET14.

Example 16

FZP (FRIZZY PANICLE) (GeneID, 4344233) encodes an ERF transcription factor and is the rice ortholog of the maize BD1 gene. FZP is required to prevent the formation of axillary meristems within the spikelet meristem and permit the subsequent establishment of floral meristem identity. A rice quantitative trait locus, SGDP7 (Small Grain and Dense Panicle 7), is identical to FZP and the causal mutation of SGDP7 is an 18-bp fragment, named CNV-18 bp, which was inserted ~5.3 kb upstream of FZP and resulted in a tandem duplication (doi:10.1038/s41477-017-0042-4). The CNV-18 bp duplication repressed FZP expression, prolonged the panicle branching period and increased grain yield by more than 15%.

FZP promoter (300 bp, −5294 to −4994 bp upstream of TSS, CNV-18 bp is underlined) GCATACAT-AGCCCGCGCGCGGCGTGCGTGCGCAGGGCAGC-TACCACAGCTAGCTAGCCGAA CGATCGATC-GATCGGCGCGGCGCGCGCAGACGCCGTCAC GCACGCACGCACGGACGCGC ACGCGCACGCGCGCGCCCACGTCCTGG-GAGCGGCCGGCGCGGCGCGGCAGCCCAGAGCGCG CGCTATAGTAGCTAGCGTTGTCGGCGCCGTAGCC GGTGTACAAGTCTCTCGTGCGCGCCGCGGCCGTA TGGCTCGGCTCTGTGGCTGTGGCTGGCTGGCGTC CCGCGGGGCAATGCG (SEQ ID NO:1692)

Two strategies are applied to recreate the SGDP7 QTL allele by duplicating CNV-18 bp.

(1) Oligo insertion: The CNV-18 bp oligo (SEQ ID NO:1725) is inserted in Cas9/guide RNA cutting site, 5193 bp upstream of TSS (1 bp upstream of existing CNV-18 bp). The crRNA sequence is: GUCCGUGCGUGCGUGCGUGAGUUUUAGAGC-UAUGCU (SEQ ID NO:1693).

(2) HDR with donor template: Cas9/guide RNA with cutting site at 5184 bp upstream of TSS (between 8 bp and 9 bp in the existing CNV-18 bp) and donor template consisting 2 copies of CNV-18 bp with flanking regions of 100 bp (underlined): CCCGCGCGGCGTGCGTGCG CAGGGCAGCTACCACAGCTAGCTAGCCGAACGATC GATCGATCGGCGCGGCGCGCGCGCAGACGCCGTC ACGCACGCACGCACGGACGCGCACGCACGCACGG ACGCGCACGCGCACGCGCGCGCCCACGTCCTGGG AGCGGCCGGCGCGGCGCGGCAGCCCAGAGCGCG CGCTATAGTAGCTAGCGTTGTCGGCGC (SEQ ID NO:1694) The crRNA sequence is CGCCGU-CACGCACGCACGCAGUUUUAGAGCUAUGCU (SEQ ID NO:1695).

As an exemplary assay for readout, use QPCR to check the transcript level of FZP.

Example 17

SPX-MFS1 (GeneID, 4336724, SEQ #8786 in U.S. Pat. No. 8,946,511 B2) encodes a protein consisting of SPX domain and a C-terminal MFS domain.

MiRMON18 (SEQ ID NO:1696: 5′-UUAGAUGAC-CAUCAGCAAAC-3′) expression was highly responsive to nitrogen conditions and phosphate conditions. Deletion of miRMON18 targeting site in 5′UTR region of SPX-MFS1 can release the regulation of miRMON18 and the expression level of SPX-MFS1 is expected to be deregulated in response to nitrate sufficient or phosphate sufficient conditions.

SPX-MFS1 5′UTR (1-446 bp, miRNA recognition site 334-354 bp is underlined):
ACCCCTCCCTCAGCTTCCCTTCC-CATCTGCCCGTCTTCTTCTTCTTCCTCCTCCTCC TGCCCTACCCGCGGCCGCGCGATATAAATACAT-CACCCTCCCCATCCGCCTCTCCGCCAGCA AACCAGCACAGCCGTACGCCGCCGGCAACTG CGTTCGCGCGAGCGCCTGTCCGCGTTGTACA TAT-TTGTGAGTAATCCGT-CACCTCTGTACGCAGCACGCACATGCCGCCGC-CAAAGCGCAGAT GATTCCAGTCTTTCCCTACTTTTGAATCTGTGCCT-GATGAATCTGCGTCGTCGTGCTGTAGCA CTAGCGAGTGTTTCCCTTGCGACGTAGAGTTTGCT-GATGTTCATCTAATTAGCCCGGAGGACT CGG-GAATCAGAATTCACCGTGGTGTCAGG-GAGAAAAAGTGGATCGAACTTCGGATCACCTG GTACCATTTGTTTACG (SEQ ID NO:1697).

Two RNP with cutting sites at 326 bp and 386 bp downstream of TSS are delivered to cells together to make a 60 bp deletion around miRNA recognition site. The crRNA sequences are CAGCAAACUCUACGU-CGCAAGUUUUAGAGCUAUGCU (SEQ ID NO:1698) and UCGGGAAUCAGAAUUCACCGGUUUUAGAGC-UAUGCU (SEQ ID NO:1699).

QPCR is conducted to examine the transcript level of SPX-MFS1 in the presence of high nitrate (10 mM KNO3) or high phosphate (10 mg/L) compared to the wild-type (non-edited).

Biomass of seedlings of edited plants are compared between high N (10 mM) and low N (0.1 mM) as well as high P (10 mg/L) and low P (0.1 mg/L)

Example 18

OsABA8ox3 (GeneID, 4347261) is the most highly expressed gene of the rice ABA 8′-hydroxylase family in rice leaves and it plays an important role in controlling ABA level and drought stress resistance in rice (doi:10.1371/journal.pone.0116646).

OsABA8ox3 3′-UTR region (300 bp, 3′-UTR is underlined) TTAGGCGTTTAATGTAGATAAGCTAGCTAG GGAGATATTTTTCTTTCTTTCATTGCCCTTCTATTTC CTCAAGGGAAGTCCGGGGAGAAAAAATGGAGTTT TCTTCTTTTTTAACTTGATCATAAGAAGGTAATGAT GATGAGAATGGGTTCTCGGAGGAAAAACAAATGA TAATGTGTAATATCATTGACATTGACCCAAATTAAA TGGCTTCAGCAGTTAATGCTGCTGCATTTCGGCTC CCTTTCATTACACCAAGGCACCAACGCGTGTTGC CATATGCGTTTTCCCCGTACACGG (SEQ ID NO:1700)

The mRNA destabilizing element (doi:10.1105/tpc.107.055046, SEQ ID NO:1726) is inserted in Cas9/guide RNA cutting site, 3265 bp, 3318 bp, or 3392 bp downstream of TSS. The crRNA sequences are UAAUGUA-GAUAAGCUAGCUAGUUUUAGAGCUAUGCU (SEQ ID NO:1701), AUUUCCUCAAGGGAAGUCCG-GUUUUAGAGCUAUGCU (SEQ ID NO:1702), and UGAUGAGAAUGGGUUCUCGGGUUUUAGAGC-UAUGCU (SEQ ID NO:1703).

As an exemplary assay for readout, use QPCR to check the transcript level of ABA8ox3 and its downstream regulated gene (0503g16920) and seedlings of edited plants can be treated with 20% PEG for 2 hours and then measure antioxidant enzyme activities following the methods (doi: 10.1371/journal.pone.0116646).

Example 19

The pyrabactin resistance-like (PYL) abscisic acid (ABA) receptor family has been identified and the overexpression of OsPYL3 (GeneID, 4328916) substantially improved drought and cold stress tolerance in rice. Homology-dependent repair (HDR) is employed to effect amino acid changes in genomic sequence of OsPYL3 to render the modified OsPYL3 hypersensitive to ABA (U.S. Patent Application Publication 2016/0194653).

OsPYL3 2nd exon (216 bp): GTTTGGTCTCTGGTGAGGCGTTTTGATCAGCCACAGCTTTTCAAGCCATTTGTGAGCCGGTGT GAGATGAAAGGGAACATTGAGATTGGCAGTGTAAGGGAGGTTAATGTTAAGTCTGGCCTGC CTGCCACAAGAAGCACTGAGAGGCTGGAGCTGTTAGATGACAATGAGCACATACTCAGTGTCAGGTTCGTGGGAGGTGATCATAGGCTCAAG (SEQ ID NO:1704)

The amino acid sequence encoded by the $2^{nd}$ exon (the amino acid V96 is underlined which is mutated to I to increase PYL3 sensitivity to ABA): VWSLVRRFDQPQLFKPFVSRCEMKGNIEIGSVREVNVKSGLPATRSTERLELLDDNEHILSVRFVGGDHRLK (SEQ ID NO:1705).

Cas9/guide RNA with cutting site at 1664 bp downstream of TSS and donor template consisting G1669 mutated to A with flanking regions of 100 bp (underlined): TTGGTCTCTGGTGAGGCGTTTTGATCAGCCACAGCTTTTCAAGCCATTTGTGAGCCGGTGTGAGATGAAAGGGAACATTGAGATTGGCAGTGTAAGGGAGATTAATGTTAAGTCTGGCCTGCCTGCCACAAGAAGCACTGAGAGGCTGGAGCTGTTAGATGACAATGAGCACATACTCAGTGTCAGGTTCGTGGGAGGTGA(SEQ ID NO:1706). The crRNA sequence is UGAGAUUGGCAGUGUAAGGGGUUUUAGAGCUAUGCU (SEQ ID NO:1707).

As an exemplary assay for readout, use CRISPR amplicon sequencing to confirm the G to A mutation and seedlings of edited plants can be treated with 10 uM ABA for 1 hour and then measure the expression level of ABA inducible genes (higher in edited seedlings compared to the wild type control).

Example 20

Na+ transporter HKT1;1 (GeneID, 9266695) regulates root Na+ content and underlies the divergence in root Na+ content between the two major subspecies, with indica accessions displaying higher root Na+ and japonica accessions exhibiting lower root Na+ content.

Genome-wide association analysis of HKT1;1 identified three non-synonymous mutations, 30726879 G→A caused amino acid change P→L, 30726432 A→G caused amino acid change F→S and 30726195 T→C caused amino acid change N→S. The three non-synonymous SNPs resulted in higher Na+ transport activity (doi:10.1371/journal.pgen.1006823)

OsHKT1;1 1" exon (1029 bp, three non-synonymous mutations are underlined): ATGCATCCACCAAGTTTAGTGCTAGATACCTTGAAGCGTATCAAACTATACATAGCCATGAA GCTCCTGTTACCGAATTCGGAGGTGCCTCGGATCTATTGGGAGAAAGCTCAGCATCTCTGTGGGTTCCTGTCCATGAAGCTCATTTCCAGAGCCAGATGTGTGGCAAGTTCTGTCAAACAATCT TATAGTTTTCTGGTTTGCAAAAGTAACCCTTTGGTAGTTCAGCTCGTTTACTTTGTGATAATC TCATTTGCTGGTTTCCTTGCTCTGAAGAATCTCAAGCCCCAGGGTAAGCCAGGTCCAAAGGA TTTGGACCTATTGTTCACCTCTGTGTCTACACTTACTGTCTCGAGCATGGCAACAGTAGAGAT GGAAGACTTATCTGACAGGCAACTCTGGGTTCTGATCCTTCTGATGCTAATGGGAGGAGAGG TGTTCACATCAATGCTAGGGCTCTACTTCAACAATGCCAATGCCAACAGAAATGAGAACAGCCAGAGAAGTTTACCTTCAATCAGCTTGGACATTGAATTCAACAGTCCTGCAAACAATGGGGA TCACAAAATTACGGAATGTGGCCAATCAGAAGAAACTATGTCGCAAAACCAGGTACAGCAA AACAAAAGCATAACATATAATCCTTGCGCTGTGTTGGTTCGCATAGTGACAGGTTATTTCGT AGCTACTGTCATTTCCAGTTCTGTCATCATTATTATTTACTTTTGGATTGATTCAGATGCAAGAAATGTACTGAAAAGTAAGGAGATCAATATGTATACCTTTTGCATCTTCACAGCAGTGTCCT CGTTCGCAAACTGTGGCTTCACGCCACTAAATAGTAACATGCAACCCTTC AGAAAGAACTGG GTCCTTTTGCTCCTAGTGATCCCGCAGATTCTAGCAGGCAACACCTTGTTTTCACCACTCTTG CGGCTATGCGTATGGGTTTTGGGGAAGGTCAGTGGAAAAGCAGAGTATGCTTACATCCTTCA GCATCCTGGGGAGACTGGCTACAAACATTTGCAT (SEQ ID NO:1708).

Three Cas9/guide RNA with three donor templates are applied to convert japonica OsHKT1;1 to indica accession with three non-synonymous mutations.

Cas9/guide RNA with cutting site at 360 bp downstream of TSS and donor template consisting C355 mutated to T with flanking regions of 100 bp (underlined). HDR with the donor template converts 30726879 G→A and thus makes amino acid change P→L: ATTTGTTGAAGAATGCATCCACCAAGTTTAGTGCTAGATACCTTGAAGCGTATCAAACTATACATAGCCATGAAGCTCCTGTTACCGAATTCGGAGGTGCTTCGGATCTATTGGGAGAAAGCTCAGCATCTCTGTGGGTTCCTGTCCATGAAGCTCATTTCCAGAGCCAGATGTGTGGCAAGTTCTGTCAACAATCTTAT(SEQ ID NO:1709).

Cas9/guide RNA with cutting site at 820 bp downstream of TSS and donor template consisting T802 mutated to C and G824 mutated to A with flanking regions of 100 bp (underlined). HDR with the donor template converts 30726432 A→G and thus makes amino acid change F→S and also destroy the PAM sequence for the guide: GTGTTCACATCAATGCTAGGGCTCTACTTCAACAATGCCAATGCCAACAGAAATGAGAACAGCCAGAGAAGTTTACCTTCAATCAGCTTGGACATTGAATCCAACAGTCCTGCAAACAATGGAGATCACAAAATTACGGAATGTGGCCAATCAGAAGAAACTATGTCGCAAAACCAGGTACAGCAAAACAAAAGCATAACATATAATCCTTGCGCTGTGTTGG(SEQ ID NO:1710).

Cas9/guide RNA with cutting site at 1054 bp downstream of TSS and donor template consisting A1039 mutated to G and C1049 mutated to A with flanking regions of 100 bp (underlined). HDR with the donor template converts 30726195 T→C and thus makes amino acid change N→S and also destroy the PAM sequence for the guide: GGTTATTTCGTAGCTACTGTCATTTCCAGTTCTGTCATCATTATTATTTACTTTTGGATTGATTCAGATGCAAGAAATGTACTGAAAAGTAAGGAGATCAGTATGTATACATTTTGCATCTTCACAGCAGTGTCCTCGTTC GCAAACTGTGGCTTCACGCCACTAAATAGTAACATGCAACCCTTCAGAAAGAACTGGGTCCTTTTGCTCC(SEQ ID NO:1711).

The crRNA sequences are GCUUUCUCCCAAUAGAUCCGGUUUUAGAGCUAUGCU (SEQ ID NO:1712), CAACAGUCCUGCAAACAAUGGUUUUAGAGCUAUGCU (SEQ ID NO:1713), and CACUGCUGUGAAGAUGCAAAGUUUUAGAGCUAUGCU (SEQ ID NO:1714).

As an exemplary assay for readout, use CRISPR amplicon sequencing to confirm three non-synonymous mutations. The seedlings of edited plants can be treated with NaCl and measure for root Na+ content following the methods (doi:10.1371/journal.pgen.1006823).

Example 21

A QTL in the super rice and related varieties is associated with reduced DNA methylation and a more open chromatin state at the IPA1 (IDEAL PLANT ARCHITECTURE 1) (GeneID, 4345998) promoter, thus alleviating the epigenetic repression of IPA1 mediated by nearby heterochromatin.

Constructs for dCas9-SunTag and anti-GCN4 scFv fused to TET1 used in Morita et. al, (2016, doi:10.1038/nbt.3658) are used to target IPA1 promoter for demethylating at the region identified in (doi:10.1038/ncomms14789) (105-266 bp upstream of TSS).

IPA1 promoter (350 bp upstream of TSS, differential methylation region is underlined): CGCGCTTGGGCTGCCCCACCGCCGAGCTCTGCCGCGCCGTTCGCCGGTGCTGCCGAGCTCCGCCGCGCCTGCCGGAGCACGCTGCCATGGCCGCCCTGGAGAAGACACGAGAGAATTAGGTGGAGGGTGGGGGAAGGGTGAGATTTTTTATATTATCTATGGGTCCCATTATAAATTTTCTAAACCACACTTATACTGTGGGTGCAGTGTCATTTAGAGTTCCCAAACCACCTATGTTGCAGCTGTGGTATAACAATTTGCTAGGACGCATTGCTACTGCCCTTGTACCCTGCTATAAGAAGATAACCAATGACATCTCCACTCGATTTTCTCGGCGCGCGTGTGAGGGT (SEQ ID NO:1715).

Two guide RNAs targeting region in the promoter of IPA1 are designed to bring TET1 to differential methylation region and trigger demethylation. The crRNA sequences are CUCUCGUGUCUUCUCCAGGGGUUUUAGAGCUAUGCU (SEQ ID NO:1716) and CUGCACCCACAGUAUAAGUGGUUUUAGAGCUAUGCU (SEQ ID NO:1717).

As an exemplary assay for readout, use QPCR to check the transcript level of OsSPL14/IPA1 and bisulfite sequencing of the differential methylation region in the promoter.

Example 22

This example describes the modification of two rice genes to make low-arsenic rice.

Due to the wide occurrence of arsenic (As) pollution in paddy soils and its efficient plant uptake, arsenic in rice grains presents health risks. Genome editing offers an effective approach to reduce As accumulation in rice grains. Knockout of Lsi2 and increase expression of ABCC1 in leaves can make low-arsenic rice.

The disruption of the Lsi2 gene is described in Example 11. The gene modification for increasing the expression of ABCC1 is described in Example 13.

As an exemplary assay for readout, use QPCR to check the transcript level of Lsi2 and ABCC1. Edited plants are growing on medium containing 1, 2, 5, or 10 uM of As (III). 2-week-old seedlings are dried and measured for As level (Ref: doi:10.1073/pnas.1414968111/-/DCSupplemental.

Example 23

This example describes the modification of two rice genes to improve the drought and salt tolerance.

Decreased ABA8ox3 level and mutant HKT1;1 with higher Na+ transport activity increase the drought and salt tolerance of rice. Insertion of the mRNA destabilizing element in the 3'-UTR of the OsABA8Ox3 gene is described in Example 18. Generation of the mutant NKT1;1 with higher Na+ transport activity is described in Example 20.

Example 24

This example describes the modification of two rice genes to improve NUE and architecture. Increased expression of OsNRT2.3b and alleviation of the epigenetic repression of SPL14/IPA1 increase NUE and improve architecture.

High OsNRT2.3b (GeneID, 4324249) expression in rice enhances the pH-buffering capacity of the plant, increasing N, Fe, and P uptake. In field trials, increased expression of OsNRT2.3b improved grain yield and nitrogen use efficiency (NUE) by 40%.

OsNRT2.3b promoter (300 bp upstream of TSS): ATGTGATAGTCATCTCTGCCATAAAACTTGCCATAATAGTTGGAGACTTGGTGGCATTCCGGGGGAACCCAATCCAAATCCGCGACGAATTCCTCTCCGCCAATACAGTATTCGTGTGTGCCGAGGAGGGAGGCAGTTCCACAGGCCAAGGAACTTACGTGACCTCCAAAGTCAGAGGTCGGAATCTCCCTTCGTTCCAGCCATGGCCCACCACCCTTGCGGCTTGGTGACCCTACTGCCCGCCAAGTCACCCGCTCGCCAACAAAAACCCGCGACGCGAGCGCGGAGACGGCAGCGCC (SEQ ID NO:1718).

The nitrate responsive element (NRE) is inserted in Cas9/guide RNA cutting site, 252 bp, 128 bp, or 84 bp upstream of TSS. The crRNA sequences are CAUAAUAGUUGGAGACUUGGGUUUUAGAGCUAUGCU (SEQ ID NO:1719), UACGUGACCUCCAAAGUCAGGUUUUAGAGCUAUGCU (SEQ ID NO:1720), and GGGUCACCAAGCCGCAAGGGGUUUUAGAGCUAUGCU (SEQ ID NO:1721).

As an exemplary assay for readout, use QPCR to check the transcript level of OsNRT2.3b in the presence of high nitrate (10 mM KNO3) compared to the wild-type (non-edited). Biomass of seedlings of edited plants are compared between high N (10 mM) and low N (0.1 mM).

Demethylation of SPL14/IPA1 is described Example 21.

Example 25

Nitrogen is the key limiting nutrient required for plant growth. Application of synthetic nitrogen fertilizer to farmland resulted in a dramatic increase in crop yields but also led to serious environmental problems. New solutions are needed to increase yields while maintaining or preferably decreasing fertilizer to maximize the nitrogen use efficiency (NUE) in crops. Several strategies using gene transformation to overexpress nitrate transporter and regulation genes successfully achieved higher crop yields. The hypothesis is to maximize NUE by editing multiple genes simultaneously.

Examples of genes and enzyme families that can be modified to increase NUE are shown in Table 4. To maximize NUE, protoplasts are transfected with combination of RNPs targeting different members in each gene family. QPCR or RNA-Seq are used to evaluate NUE by investigating nitrate responsive genes expression level.

TABLE 4

| Gene family | Member | Gene ID | Change in gene activity | Element inserted |
|---|---|---|---|---|
| nitrate transporter | OsPTR6 | 4336854 | Upregulate | AtNRE |
| | OsPTR9 | 9268091 | Upregulate | AtNRE |
| | OsNRT2.1 | 4328051 | Upregulate | AtNRE |
| | OsNRT2.3b | 4324249 | Upregulate | AtNRE |
| | OsNRT1.1b | 4332183 | Upregulate | AtNRE |
| | OsNPF6.5 | ABB47972 | Upregulate | AtNRE |
| 7glutamine synthetase | OsGS1;1 | 4330649 | Upregulate | AtNRE |
| | GS1;2 | 4332108 | Upregulate | AtNRE |
| | GS2 | 4337272 | Upregulate | AtNRE |
| glutamate synthase | NADH-GOGAT | 4324398 | Upregulate | AtNRE |
| | NADH-GOGAT1 | BAA35120.1 | Upregulate | AtNRE |
| | OsGOGAT2 | 4339561 | Upregulate | AtNRE |
| alanine amino-transferase | AlaAT | 4348524 | Upregulate | AtNRE |
| ammonium transporter | AMT1;1 | 4336365 | Upregulate | AtNRE |
| | AMT1;2 | 4330008 | | |
| | AMT1;3 | 4330007 | | |
| | OsAMT3;1 | 4324937 | | |
| isopentenyl transferase | IPT | 107275347 | Upregulate | AtNRE |
| early nodulin gene | OsENOD93-1 | 9271477 | Upregulate | AtNRE |

Example 26

Rice productivity can be improved by targeting processes associated with non-photochemical quenching (NPQ). This is a strategy to increase photosynthetic efficiency. Orthologous genes to those targeted in Kromdjik et al. (2016, Science, 354 (6314): 857-61) can be up-regulated by inserting an enhancer element in the promoter proximal region of the tomato orthologous genes for the chloroplastic photosystem II 22 kDa protein (PsbS-Gene ID 4324933, SEQ ID NO:1727), violaxanthin de-epoxidase (VDE-Gene ID 4335625, SEQ ID NO:1729) and zeoxanthin epoxidase (ZEP-Gene ID 4335984, SEQ ID NO:1731). Here we use the nopaline synthase OCS element (SEQ ID NO:1724), Ellis et al., 1987, The EMBO Journal, 6 (11): 3203-8) to upregulate the three rice NPQ genes. As additional examples, G-box (SEQ ID NO:1722) and green tissue-specific promoter (GSP, SEQ ID NO:1722) can also be used to upregulate the NPQ genes.

An appropriate guide RNA is designed to target Cas9 or its equivalent to one or more sites within 500 bp of each gene's transcription start site. The site-directed endonuclease can be delivered as a ribonucleoprotein (RNP) complex or encoded on plasmid DNA. Synthetic oligonucleotides representing 1-5 copies of the OCS element (Ellis et al. 1987) are co-delivered with the site-specific endonuclease. The design of each guide RNA can be developed and optimized in a rice protoplast system, using qRT-PCR of mRNA from each target gene to report successful up-regulation. Alternatively, a synthetic promoter for each target gene, linked to a suitable reporter gene like eGFP, can be co-transfected with the site-specific RNPs and enhancer oligonucleotide into protoplasts to evaluate the efficacy of all possible guide RNAs to identify the most effective candidates for deliver to whole plant tissues. The most effective RNPs are used to insert the NPQ technology in rice.

One of many published methods for introducing the OCS enhancer element into the predetermined target sites of the tomato NPQ genes can used to generate lines with enhanced photosynthetic activity. These include agrobacterium, viral or biolistic-mediated approaches (Sah et al., 2014 (doi: 10.4172/2375-4338.1000132). The RNPs and OCS element can also be introduced by microinjection, as described above.

Rice tissues that are appropriate for genome editing manipulation (in general) include embryogenic callus, exposed shoot apical meristems and 1 DAP embryos. There are many approaches to producing embryogenic callus (for example, Tahir 2010 (doi:10.1007/978-1-61737-988-821), Ge et al., 2006 (doi:10.1007/s00299-005-0100-7)). Shoot apical meristem explants can be prepared using a variety of methods in the art (Sticklen and Oraby, 2005 (doi:10.1079/IVP2004616); Baskaran and Dasgupta, 2012 (doi:10.1007/s13562-011-0078-x)). This work describes how to prepare and nurture material that is adequate for microinjection.

Several molecular techniques can be used to confirm that the intended edits are present in the treated plants. These include sequence analysis of each target site and qRT-PCR of each target gene. The NPQ trait is confirmed using photosynthesis instrument such as a Ciras 3 or Licor 6400, to compare modified plants to unmodified or wildtype plants. The NPQ trait is expected to increase biomass accumulation relative to wildtype plants.

Example 27

Table 6 provides a list of genes in rice associated with various traits including abiotic stress resistance, plant architecture, biotic stress resistance, photosynthesis, and resource partitioning. Within each trait, various non-limiting (and often overlapping) sub-categories of traits may be identified, as presented in the Table. For example, "abiotic stress resistance" may be related to or associated with changes in abscisic acid (ABA) signaling, biomass, cold tolerance, drought tolerance, tolerance to high temperatures, tolerance to low temperatures, and/or salt tolerance; the trait "plant architecture" may be related to or may include traits such as biomass, fertilization, flowering time and/or flower architecture, inflorescence architecture, lodging resistance, root architecture, shoot architecture, leaf architecture, and yield; the trait "biotic stress" may include disease resistance, insect resistance, population density stress and/or shading stress; the trait "photosynthesis" can include photosynthesis and respiration traits; the trait "resource partitioning" can include or be related to biomass, seed weight, drydown rate, grain size, nitrogen utilization, oil production and metabolism, protein production and metabolism, provitamin A production and metabolism, seed composition, seed filling (including sugar and nitrogen transport), and starch production and metabolism. By modifying one or more of the associated genes in Table 6, each of these traits may be manipulated singly or in combination to improve the yield, productivity or other desired aspects of a rice plant comprising the modification(s).

Each of the genes listed in Table 6 may be modified using any of the gene modification methods described herein. In particular, each of the genes may be modified using the targeted modification methods described herein which introduce desired genomic changes at specific locations in the absence of off-target effects. Even more specifically, each of the genes in Table 6 may be modified using the CRISPR targeting methods described herein, either singly or in multiplexed fashion. For example, a single gene in Table 6 could be modified by the introduction of a single mutation (change in residue, insertion of residue(s), or deletion of residue(s)) or by multiple mutations. Another possibility is that a single gene in Table 6 could be modified by the introduction of two or more mutations, including two or more targeted mutations. In addition, or alternatively, two or more genes in Table 6 could be modified (e.g., using the targeted modification techniques described herein) such that the two or more genes each contains one or more modifications.

The various types of modifications that can be introduced into the genes of Table 6 have been described herein. The modifications include both modifications to regulatory regions that affect the expression of the gene product (i.e., the amount of proteins or RNA encoded by the gene) and modifications that affect the sequence or activity of the encoded protein or RNA (in some cases the same modification may affect both the expression level and the activity of the encoded protein or RNA). Modifying genes encoding proteins with the amino acid sequences listed in Table 6 (SEQ ID Nos: 932-1653, 1728, 1730 and 32), or sequences with at least 95%, 96%, 97%, 98%, or 99% identity to the protein sequences listed in Table 6, may result in proteins with improved or diminished activity. Methods of alignment of sequences for comparison are well known in the art. Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information. Optimal alignment of sequences for comparison can also be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

In some cases, targeted modifications may result in proteins with no activity (e.g., the introduction of a stop codon may result in a functionless protein) or a protein with a new activity or feature. Similarly, the sequences of the miRNAs listed in Table 6 may also be modified to increase, decrease or reduce their activity.

In addition to modifications to the encoded proteins or miRNAs, each of the gene sequences listed in Table 6 (the gene sequences of SEQ IDs 210-931, 1727, 1729, and 1731) may also be modified, individually or in combination with one or more other modifications, to alter the expression of the encoded protein or RNA, or to alter the stability of the RNA encoding the protein. For example, regulatory sequences affecting transcription of any of the genes listed in Table 6, including primer sequences and transcription factor binding sequences, can be modified, or introduced into, any of the gene sequences listed in Table 6 using the methods described herein. The modifications can effect increases in transcription levels, decreases in transcription levels, and/or changes in the timing of transcription of the genes under control of the modified regulatory regions. Targeted epigenetic modifications affecting gene expression may also be introduced.

One skilled in the art will be able to identify regulatory regions (e.g., regulatory regions in the gene sequences provided in Table 6) using techniques described in the literature, e.g., Bartlett A. et al, "Mapping genome-wide transcription-factor binding sites using DAP-seq.", *Nat Protoc.* (2017) August; 12(8):1659-1672; O'Malley R. C. et al, "Cistrome and Epicistrome Features Shape the Regulatory DNA Landscape", *Cell* (2016) September 8; 166(6):1598; He Y et al, "Improved regulatory element prediction based on tissue-specific local epigenomic signatures", *Proc Natl Acad Sci USA,* 2017 Feb. 28; 114(9):E1633-E1640; Zefu Lu et al, "Combining ATAC-seq with nuclei sorting for discovery of cis-regulatory regions in plant genomes", *Nucleic Acids Research*, (2017) V45(6); Rurika Oka et al, "Genome-wide mapping of transcriptional enhancer candidates using DNA and chromatin features in maize", *Genome Biology* (2017) 18:137. In addition, Table 5, provided herein, lists sequences which may be inserted into or otherwise created in the genomic sequences of Table 6 for the purpose of regulating gene expression and/or transcript stability.

The stability of transcribed RNA encoded by the genes in Table 6 (in addition to other genes), can be increased or decreased by the targeted insertion or creation of the transcript stabilizing or destabilizing sequences provided in Table 5 (e.g., SEQ ID Nos. 198-200 and 202). In addition, Table 6 includes miRNAs whose expression can be used to regulate the stability of transcripts comprising the corresponding recognitions sites. Additional miRNAs, miRNA precursors and miRNA recognition site sequences that can be used to regulate transcript stability and gene expression in the context of the methods described herein may be found in, e.g., U.S. Pat. No. 9,192,112 (e.g., Table 2), 8,946,511 and 9,040,774, the disclosures of each of which is incorporated by reference herein.

Any of the above regulatory modifications may be combined to regulate a single gene, or multiple genes, or they may be combined with the non-regulatory modifications discussed above to regulate the activity of a single modified gene, or multiple modified genes. The genetic modifications or gene regulatory changes discussed above may affect distinct traits in the rice cell or plant, or they make affect the same trait. The resulting effects of the described modifications on a trait or trait may be additive or synergistic. Modifications to the rice genes listed in Table 6 may be combined with modifications to other sequences in the rice genome for the purpose of improving one or more rice traits. The rice sequences of Table 6 may also be modified for the purpose of tracking the expression or localizing the expression or activity of the listed genes and gene products

TABLE 5

| Type of regulation | Name of element | Sequence | SEQ ID NO |
|---|---|---|---|
| regulatory control by TF | ABFs binding site motif | CACGTGGC | SEQ ID NO:19 |
| regulatory control by TF | ABBE binding site motif | (C/T)ACGTGGC | SEQ ID NO:20 |

TABLE 5-continued

| Type of regulation | Name of element | Sequence | SEQ ID NO |
|---|---|---|---|
| regulatory control by TF | ABRE-like binding site motif | (C/G/T)ACGTG(G/T)(A/C) | SEQ ID NO:21 |
| regulatory control by TF | ACE promoter motif | GACACGTAGA | SEQ ID NO:22 |
| regulatory control by TF | AG binding site motif | TT(A/G/T)CC(A/T)(A/T)(A/T)(A/T)(A/T)(A/T)GG(A/C/T) | SEQ ID NO:23 |
| regulatory control by TF | AG binding site in AP3 | CCATTTTTAGT | SEQ ID NO:24 |
| regulatory control by TF | AG binding site in SUP | CCATTTTTGG | SEQ ID NO:25 |
| regulatory control by TF | AG L1 binding site motif | NTT(A/G/T)CC(A/T)(A/T)(A/T)(A/T)NNGG(A/T)AAN | SEQ ID NO:26 |
| regulatory control by TF | AG L2 binding site motif | NN(A/T)NCCA(A/T)(A/T)(A/T)(A/T)T(A/G)G(A/T)(A/T)AN | SEQ ID NO:27 |
| regulatory control by TF | AG L3 binding site motif | TT(A/T)C(C/T)A(A/T)(A/T)(A/T)(A/T)T(A/G)G(A/T)AA | SEQ ID NO:28 |
| regulatory control by TF | AP1 binding site in AP3 | CCATTTTTAG | SEQ ID NO:29 |
| regulatory control by TF | AP1 binding site in SUP | CCATTTTTGG | SEQ ID NO:30 |
| regulatory control by TF | ARE binding site motif | TGTCTC | SEQ ID NO:31 |
| regulatory control by TF | ARF1 binding site motif | TGTCTC | SEQ ID NO:32 |
| regulatory control by TF | ATHB1 binding site motif | CAAT(A/T)ATTG | SEQ ID NO:33 |
| regulatory control by TF | ATHB2 binding site motif | CAAT(C/G)ATTG | SEQ ID NO:34 |
| regulatory control by TF | ATHB5 binding site motif | CAATNATTG | SEQ ID NO:35 |
| regulatory control by TF | ATHB6 binding site motif | CAATTATTA | SEQ ID NO:36 |
| regulatory control by TF | AtMYB2 binding site in RD22 | CTAACCA | SEQ ID NO:37 |
| regulatory control by TF | AtMYC2 binding site in RD22 | CACATG | SEQ ID NO:38 |
| regulatory control by TF | Box 11 promoter motif | GGTTAA | SEQ ID NO:39 |
| regulatory control by TF | CArG promoter motif | CC(A/T)(A/T)(A/T)(A/T)(A/T)(A/T)GG | SEQ ID NO:40 |
| regulatory control by TF | CArG1 motif in AP3 | GTTTACATAAATGGAAAA | SEQ ID NO:41 |
| regulatory control by TF | CArG2 motif in AP3 | CTTACCTTTCATGGATTA | SEQ ID NO:42 |
| regulatory control by TF | CArG3 motif in AP3 | CTTTCCATTTTTAGTAAC | SEQ ID NO:43 |
| regulatory control by TF | CBF1 binding site in cor15a | TGGCCGAC | SEQ ID NO:44 |
| regulatory control by TF | CBF2 binding site motif | CCACGTGG | SEQ ID NO:45 |
| regulatory control by TF | CCA1 binding site motif | AA(A/C)AATCT | SEQ ID NO:46 |
| regulatory control by TF | CCA1 motif1 binding site in CAB1 | AAACAATCTA | SEQ ID NO:47 |
| regulatory control by TF | CCA1 motif2 binding site in CAB1 | AAAAAAAATCTATGA | SEQ ID NO:48 |
| regulatory control by TF | DPBF1&2 binding site motif | ACACNNG | SEQ ID NO:49 |
| regulatory control by TF | DRE promoter motif | TACCGACAT | SEQ ID NO:50 |
| regulatory control by TF | DREB1&2 binding site in rd29a | TACCGACAT | SEQ ID NO:51 |
| regulatory control by TF | DRE-like promoter motif | (A/G/T)(A/G)CCGACN(A/T) | SEQ ID NO:52 |
| regulatory control by TF | E2F binding site motif | TTTCCCGC | SEQ ID NO:53 |
| regulatory control by TF | E2F/DP binding site in AtCDC6 | TTTCCCGC | SEQ ID NO:54 |

TABLE 5-continued

| Type of regulation | Name of element | Sequence | SEQ ID NO |
|---|---|---|---|
| regulatory control by TF | E2F-varient binding site motif | TCTCCCGCC | SEQ ID NO:55 |
| regulatory control by TF | EIL1 binding site in ERF1 | TTCAAGGGGGCATGTATCTTGAA | SEQ ID NO:56 |
| regulatory control by TF | EIL2 binding site in ERF1 | TTCAAGGGGGCATGTATCTTGAA | SEQ ID NO:57 |
| regulatory control by TF | EIL3 binding site in ERF1 | TTCAAGGGGGCATGTATCTTGAA | SEQ ID NO:58 |
| regulatory control by TF | EIN3 binding site in ERF1 | GGATTCAAGGGGGCATGTATCTTGAATCC | SEQ ID NO:59 |
| regulatory control by TF | ERE promoter motif | TAAGAGCCGCC | SEQ ID NO:60 |
| regulatory control by TF | ERF1 binding site in AtCHI-B | GCCGCC | SEQ ID NO:61 |
| regulatory control by TF | Evening Element promoter motif | AAAATATCT | SEQ ID NO:62 |
| regulatory control by TF | GATA promoter motif | (A/T)GATA(G/A) | SEQ ID NO:63 |
| regulatory control by TF | GBF1/2/3 binding site in ADH1 | CCACGTGG | SEQ ID NO:64 |
| regulatory control by TF | G-box promoter motif | CACGTG | SEQ ID NO:65 |
| regulatory control by TF | GCC-box promoter motif | GCCGCC | SEQ ID NO:66 |
| regulatory control by TF | GT promoter motif | TGTGTGGTTAATATG | SEQ ID NO:67 |
| regulatory control by TF | Hexamer promoter motif | CCGTCG | SEQ ID NO:68 |
| regulatory control by TF | HSEs binding site motif | AGAANNTTCT | SEQ ID NO:69 |
| regulatory control by TF | Ibox promoter motif | GATAAG | SEQ ID NO:70 |
| regulatory control by TF | JASE1 motif in OPR1 | CGTCAATGAA | SEQ ID NO:71 |
| regulatory control by TF | JASE2 motif in OPR2 | CATACGTCGTCAA | SEQ ID NO:72 |
| regulatory control by TF | L1-box promoter motif | TAAATG(C/T)A | SEQ ID NO:73 |
| regulatory control by TF | LS5 promoter motif | ACGTCATAGA | SEQ ID NO:74 |
| regulatory control by TF | LS7 promoter motif | TCTACGTCAC | SEQ ID NO:75 |
| regulatory control by TF | LTRE promoter motif | ACCGACA | SEQ ID NO:76 |
| regulatory control by TF | MRE motif in CHS | TCTAACCTACCA | SEQ ID NO:77 |
| regulatory control by TF | MYB binding site promoter | (A/C)ACC(A/T)A(A/C)C | SEQ ID NO:78 |
| regulatory control by TF | MYB1 binding site motif | (A/C)TCC(A/T)ACC | SEQ ID NO:79 |
| regulatory control by TF | MYB2 binding site motif | TAACT(G/C)GTT | SEQ ID NO:80 |
| regulatory control by TF | MYB3 binding site motif | TAACTAAC | SEQ ID NO:81 |
| regulatory control by TF | MYB4 binding site motif | A(A/C)C(A/T)A(A/C)C | SEQ ID NO:82 |
| regulatory control by TF | Nonamer promoter motif | AGATCGACG | SEQ ID NO:83 |
| regulatory control by TF | OBF4,5 binding site in GST6 | ATCTTATGTCATTGATGACGACCTCC | SEQ ID NO:84 |
| regulatory control by TF | OBP-1,4,5 binding site in GST6 | TACACTTTTGG | SEQ ID NO:85 |
| regulatory control by TF | OCS promoter motif | TGACG(C/T)AAG(C/G)(A/G)(A/C)T(G/T)ACG(C/T)(A/C)(A/C) | SEQ ID NO:86 |
| regulatory control by TF | octamer promoter motif | CGCGGATC | SEQ ID NO:87 |
| regulatory control by TF | PI promoter motif | GTGATCAC | SEQ ID NO:88 |

TABLE 5-continued

| Type of regulation | Name of element | Sequence | SEQ ID NO |
|---|---|---|---|
| regulatory control by TF | PII promoter motif | TTGGTTTTGATCAAAACCAA | SEQ ID NO:89 |
| regulatory control by TF | PRHA binding site in PAL1 | TAATTGACTCAATTA | SEQ ID NO:90 |
| regulatory control by TF | RAV1-A binding site motif | CAACA | SEQ ID NO:91 |
| regulatory control by TF | RAV1-B binding site motif | CACCTG | SEQ ID NO:92 |
| regulatory control by TF | RY-repeat promoter motif | CATGCATG | SEQ ID NO:93 |
| regulatory control by TF | SBP-box promoter motif | TNCGTACAA | SEQ ID NO:94 |
| regulatory control by TF | T-box promoter motif | ACTTTG | SEQ ID NO:95 |
| regulatory control by TF | TEF-box promoter motif | AGGGGCATAATGGTAA | SEQ ID NO:96 |
| regulatory control by TF | TELO-box promoter motif | AAACCCTAA | SEQ ID NO:97 |
| regulatory control by TF | TGA1 binding site motif | TGACGTGG | SEQ ID NO:98 |
| regulatory control by TF | W-box promoter motif | TTGAC | SEQ ID NO:99 |
| regulatory control by TF | Z-box promoter motif | ATACGTGT | SEQ ID NO:100 |
| regulatory control by TF | AG binding site in SPL/NOZ | AAAACAGAATAGGAAA | SEQ ID NO:101 |
| regulatory control by TF | Bellringer/ replumless/ pennywise binding site IN AG | AAATTAAA | SEQ ID NO:102 |
| regulatory control by TF | Bellringer/ replumless/ pennywise binding site 2 in AG | AAATTAGT | SEQ ID NO:103 |
| regulatory control by TF | Bellringer/ replumless/ pennywise binding site 3 in AG | ACTAATTT | SEQ ID NO:104 |
| regulatory control by TF | AGL15 binding site in AtGA2ox6 | CCAATTTAATGG | SEQ ID NO:105 |
| regulatory control by TF | ATB2/ AtbZIP53/ AtbZIP44/ GBF5 binding site in ProDH | ACTCAT | SEQ ID NO:106 |
| regulatory control by TF | LFY binding site in AP3 | CTTAAACCCTAGGGGTAAT | SEQ ID NO:107 |
| regulatory control by TF | SORLREP1 | TT(A/T)TACTAGT | SEQ ID NO:108 |
| regulatory control by TF | SORLREP2 | ATAAAACGT | SEQ ID NO:109 |
| regulatory control by TF | SORLREP3 | TGTATATAT | SEQ ID NO:110 |
| regulatory control by TF | SORLREP4 | CTCCTAATT | SEQ ID NO:111 |
| regulatory control by TF | SORLREP5 | TTGCATGACT | SEQ ID NO:112 |
| regulatory control by TF | SORLIP1 | AGCCAC | SEQ ID NO:113 |
| regulatory control by TF | SORLIP2 | GGGCC | SEQ ID NO:114 |
| regulatory control by TF | SORLIP3 | CTCAAGTGA | SEQ ID NO:115 |
| regulatory control by TF | SORLIP4 | GTATGATGG | SEQ ID NO:116 |
| regulatory control by TF | SORLIP5 | GAGTGAG | SEQ ID NO:117 |

TABLE 5-continued

| Type of regulation | Name of element | Sequence | SEQ ID NO |
|---|---|---|---|
| regulatory control by TF | ABFs binding site motif | CACGTGGC | SEQ ID NO:118 |
| down | NdeI restriction site | GTTTAATTGAGTTGTCATATGTTAATAACGGTAT | SEQ ID NO:119 |
| down | NdeI restriction site | ATACCGTTATTAACATATGACAACTCAATTAAAC | SEQ ID NO:120 |
| up (auxin responsive) | 3xDR5 auxin-response element | CCGACAAAAGGCCGACAAAAGGCCGACAAAAGGT | SEQ ID NO:121 |
| up (auxin responsive) | 3xDR5 auxin-response element | ACCTTTTGTCGGCCTTTTGTCGGCCTTTTGTCGG | SEQ ID NO:122 |
| up (auxin responsive) | 6xDR5 auxin-responsive element | GCCGACAAAAGGCCGACAAAAGGCCGACAAAAGGCCGACAAAAGGCCGACAAAAGGCCGACAAAAGGT | SEQ ID NO:123 |
| up (auxin responsive) | 6xDR5 auxin-responsive element | ACCTTTTGTCGGCCTTTTGTCGGCCTTTTGTCGGCCTTTTGTCGGCCTTTTGTCGGC | SEQ ID NO:124 |
| up (auxin responsive) | 9xDR5 auxin-responsive element | CCGACAAAAGGCCGACAAAAGGCCGACAAAAGGCCGACAAAAGGCCGACAAAAGGCCGACAAAAGGCCGACAAAAGGCCGACAAAAGGT | SEQ ID NO:125 |
| up (auxin responsive) | 9xDR5 auxin-responsive element | ACCTTTTGTCGGCCTTTTGTCGGCCTTTTGTCGGCCTTTTGTCGGCCTTTTGTCGGCCTTTTGTCGGCCTTTTGTCGGCCTTTTGTCGG | SEQ ID NO:126 |
| Cre recombinase recognition site | LoxP (wild-type 1) | ATAACTTCGTATAGCATACATTATACGAAGTTAT | SEQ ID NO:127 |
| Cre recombinase recognition site | LoxP (wild-type 2) | ATAACTTCGTATAATGTATGCTATACGAAGTTAT | SEQ ID NO:128 |
| Cre recombinase recognition site | Canonical LoxP | ATAACTTCGTATANNNTANNNTATACGAAGTTAT | SEQ ID NO:129 |
| Cre recombinase recognition site | Lox 511 | ATAACTTCGTATAATGTATaCTATACGAAGTTAT | SEQ ID NO:130 |
| Cre recombinase recognition site | Lox 5171 | ATAACTTCGTATAATGTgTaCTATACGAAGTTAT | SEQ ID NO:131 |
| Cre recombinase recognition site | Lox 2272 | ATAACTTCGTATAAaGTATcCTATACGAAGTTAT | SEQ ID NO:132 |
| Cre recombinase recognition site | M2 | ATAACTTCGTATAAgaaAccaTATACGAAGTTAT | SEQ ID NO:133 |
| Cre recombinase recognition site | M3 | ATAACTTCGTATAtaaTACCATATACGAAGTTAT | SEQ ID NO:134 |
| Cre recombinase recognition site | M7 | ATAACTTCGTATAAgaTAGAATATACGAAGTTAT | SEQ ID NO:135 |
| Cre recombinase recognition site | M11 | ATAACTTCGTATAaGATAgaaTATACGAAGTTAT | SEQ ID NO:136 |
| Cre recombinase recognition site | Lox 71 | taccgTTCGTATANNNTANNNTATACGAAGTTAT | SEQ ID NO:137 |
| Cre recombinase recognition site | Lox 66 | ATAACTTCGTATANNNTANNNTATACGAAcggta | SEQ ID NO:138 |
| maize ovule/early kernel transcript down-regulation | miR156j recognition site | GTGCTCTCTCTCTTCTGTCA | SEQ ID NO:139 |
| maize ovule/early kernel transcript down-regulation | miR156j recognition site | CTGCTCTCTCTCTTCTGTCA | SEQ ID NO:140 |
| maize ovule/early kernel transcript down-regulation | miR156j recognition site | TTGCTTACTCTCTTCTGTCA | SEQ ID NO:141 |
| maize ovule/early kernel transcript down-regulation | miR156j recognition site | CCGCTCTCTCTCTTCTGTCA | SEQ ID NO:142 |
| maize ovule/early kernel transcript down-regulation | miR159c recognition site | TGGAGCTCCCTTCATTCCAAT | SEQ ID NO:143 |
| maize ovule/early kernel transcript down-regulation | miR159c recognition site | TCGAGTTCCCTTCATTCCAAT | SEQ ID NO:144 |
| maize ovule/early kernel transcript down-regulation | miR159c recognition site | ATGAGCTCTCTTCAAACCAAA | SEQ ID NO:145 |

TABLE 5-continued

| Type of regulation | Name of element | Sequence | SEQ ID NO |
|---|---|---|---|
| maize ovule/early kernel transcript down-regulation | miR159c recognition site | TGGAGCTCCCTTCATTCCAAG | SEQ ID NO:146 |
| maize ovule/early kernel transcript down-regulation | miR159c recognition site | TAGAGCTTCCTTCAAACCAAA | SEQ ID NO:147 |
| maize ovule/early kernel transcript down-regulation | miR159c recognition site | TGGAGCTCCATTCGATCCAAA | SEQ ID NO:148 |
| maize ovule/early kernel transcript down-regulation | miR159c recognition site | AGCAGCTCCCTTCAAACCAAA | SEQ ID NO:149 |
| maize ovule/early kernel transcript down-regulation | miR159c recognition site | CAGAGCTCCCTTCACTCCAAT | SEQ ID NO:150 |
| maize ovule/early kernel transcript down-regulation | miR159c recognition site | TGGAGCTCCCTTCACTCCAAT | SEQ ID NO:151 |
| maize ovule/early kernel transcript down-regulation | miR159c recognition site | TGGAGCTCCCTTCACTCCAAG | SEQ ID NO:152 |
| maize ovule/early kernel transcript down-regulation | miR159c recognition site | TGGAGCTCCCTTTAATCCAAT | SEQ ID NO:153 |
| maize embryo transcript down-regulation | miR166b recognition site | TTGGGATGAAGCCTGGTCCGG | SEQ ID NO:154 |
| maize embryo transcript down-regulation | miR166b recognition site | CTGGGATGAAGCCTGGTCCGG | SEQ ID NO:155 |
| maize embryo transcript down-regulation | miR166b recognition site | CTGGAATGAAGCCTGGTCCGG | SEQ ID NO:156 |
| maize embryo transcript down-regulation | miR166b recognition site | CGGGATGAAGCCTGGTCCGG | SEQ ID NO:157 |
| maize endosperm transcript down-regulation | miR167g recognition site | GAGATCAGGCTGGCAGCTTGT | SEQ ID NO:158 |
| maize endosperm transcript down-regulation | miR167g recognition site | TAGATCAGGCTGGCAGCTTGT | SEQ ID NO:159 |
| maize endosperm transcript down-regulation | miR167g recognition site | AAGATCAGGCTGGCAGCTTGT | SEQ ID NO:160 |
| maize pollen transcript down-regulation | miR156i recognition site | GTGCTCTCTCTCTTCTGTCA | SEQ ID NO:161 |
| maize pollen transcript down-regulation | miR156i recognition site | CTGCTCTCTCTCTTCTGTCA | SEQ ID NO:162 |
| maize pollen transcript down-regulation | miR156i recognition site | TTGCTTACTCTCTTCTGTCA | SEQ ID NO:163 |
| maize pollen transcript down-regulation | miR156i recognition site | CCGCTCTCTCTCTTCTGTCA | SEQ ID NO:164 |
| maize pollen transcript down-regulation | mir160b-like recognition site | TGGCATGCAGGGAGCCAGGCA | SEQ ID NO:165 |
| maize pollen transcript down-regulation | mir160b-like recognition site | AGGAATACAGGGAGCCAGGCA | SEQ ID NO:166 |
| maize pollen transcript down-regulation | mir160b-like recognition site | GGGTTTACAGGGAGCCAGGCA | SEQ ID NO:167 |

TABLE 5-continued

| Type of regulation | Name of element | Sequence | SEQ ID NO |
|---|---|---|---|
| maize pollen transcript down-regulation | mir160b-like recognition site | AGGCATACAGGGAGCCAGGCA | SEQ ID NO:168 |
| maize pollen transcript down-regulation | miR393a recognition site | AAACAATGCGATCCCTTTGGA | SEQ ID NO:169 |
| maize pollen transcript down-regulation | miR393a recognition site | AGACCATGCGATCCCTTTGGA | SEQ ID NO:170 |
| maize pollen transcript down-regulation | miR393a recognition site | GGTCAGAGCGATCCCTTTGGC | SEQ ID NO:171 |
| maize pollen transcript down-regulation | miR393a recognition site | AGACAATGCGATCCCTTTGGA | SEQ ID NO:172 |
| maize pollen transcript down-regulation | miR396a recognition site | TCGTTCAAGAAAGCCTGTGGAA | SEQ ID NO:173 |
| maize pollen transcript down-regulation | miR396a recognition site | CGTTCAAGAAAGCCTGTGGAA | SEQ ID NO:174 |
| maize pollen transcript down-regulation | miR396a recognition site | TCGTTCAAGAAAGCATGTGGAA | SEQ ID NO:175 |
| maize pollen transcript down-regulation | miR396a recognition site | ACGTTCAAGAAAGCTTGTGGAA | SEQ ID NO:176 |
| maize pollen transcript down-regulation | miR396a recognition site | CGTTCAAGAAAGCCTGTGGAA | SEQ ID NO:177 |
| maize male tissue transcript down-regulation | male tissue-specific siRNA element | GGACAACAAGCACCTTCTTGCCTTGCAAGGCCTCCCTTCCCTATGGTAGCCACTTGAGTGGATGACTTCACCTTAAAGCTATTGATTCCCTAAGTGCCAGACATAATAGGCTATACATTCTCTCTGGTGGCAACAATGAGCCATTTTGGTTGGTGTGGTAGTCTATTATTGAGTTTTTTTTGGCACCGTACTCCCATGGAGAGTAGAAGACAAACTCTTCACCGTTGTAGTCGTTGATGGTATTGGTGGTGACGACATCCTTGGTGTGCATGCACTGGTGAGTCACTGTTGTACTCGGCG | SEQ ID NO:178 |
| maize male tissue transcript down-regulation | male tissue-specific siRNA element | GGACAACAAGCACCTTCTTGCCTTGCAAGGCCTCCCTTCCCTATGGTAGCCACTTGAGTGGATGACTTCACCTTAAAGCTATCGATTCCCTAAGTGCCAGACAT | SEQ ID NO:179 |
| maize male tissue transcript down-regulation | male tissue-specific siRNA element | CTCTTCACCGTTGTAGTCGTTGATGGTATTGGTGGTGACGACATCCTTGGTGTGCATGCACTGGTGAGTCACTGTTGTAC | SEQ ID NO:180 |
| maize male tissue transcript down-regulation | male tissue-specific siRNA element | GGACAACAAGCACCTTCTTGCCTTGCAAGGCCTCCCTTCCCTATGGTAGCCACTTGAGTGGATGACTTCACCTTAAAGCTATCGATTCCCTAAGTGCCAGACATCTCTTCACCGTTGTAGTCGTTGATGGTATTGGTGGTGACGACATCCTTGGTGTGCATGCACTGGTGAGTCACTGTTGTAC | SEQ ID NO:181 |
| maize male tissue transcript down-regulation | male tissue-specific siRNA element | CTCTTCACCGTTGTAGTCGTTGATGGTATTGGTGGTGACGACATCCTTGGTGTGCATGCACTGGTGAGTCACTGTTGTACGGACAACAAGCACCTTCTTGCCTTGCAAGGCCTCCCTTCCCTATGGTAGCCACTTGAGTGGATGACTTCACCTTAAAGCTATCGATTCCCTAAGTGCCAGACAT | SEQ ID NO:182 |
| up (auxin reponsive; constitutive) | ocs enhancer (*Agrobacterium* sp.) | ACGTAAGCGCTTACGT | SEQ ID NO:183 |
| up (auxin reponsive; constitutive) | 12-nt ocs orthologue (Zea mays) | GTAAGCGCTTAC | SEQ ID NO:184 |
| up (nitrogen responsive) | AtNRE | AAGAGATGAGCTCTTGAGCAATGTAAAGGGTCAAGTTGTTTCT | SEQ ID NO:185 |
| up (nitrogen responsive) | AtNRE | AGAAACAACTTGACCCTTTACATTGCTCAAGAGCTCATCTCTT | SEQ ID NO:186 |
| up (auxin responsive) | 3xDR5 auxin-response element; RNA strand of RNA/DNA hybrid | ACCUUUGUCGGCCUUUUGUCGGCCUUUUGUCGG | SEQ ID NO:187 |
| up (auxin responsive) | 3xDR5 auxin-response element; sticky-ended | TCGGTCCGACAAAAGGCCGACAAAAGGCGGACAAAAGG | SEQ ID NO:188 |
| up (auxin responsive) | 3xDR5 auxin-response element; sticky-ended | ACCGACCTTTTGTCGGCCTTTTGTCGGCCTTTTGTCGG | SEQ ID NO:189 |
| down or up (MAMP-responsive) | OsTBF1 uORF2 | ATGGGAGTAGAGGCGGGCGGCGGCTGCGGTGGGAGGGCGGTAGTCACCGGATTCTACGTCTGGGGCTGGGAGTTCCTCACCGCCCTCCTGCTCTTCTCGGCCACCACCTCCTACTAG | SEQ ID NO:190 |

TABLE 5-continued

| Type of regulation | Name of element | Sequence | SEQ ID NO |
|---|---|---|---|
| down or up (MAMP-responsive) | synthetic R-motif | AAAAAAAAAAAAAAA | SEQ ID NO:191 |
| down or up (MAMP-responsive) | AtTBF1 R-motif | CACATACACACAAAAATAAAAAAGA | SEQ ID NO:192 |
| decreases upregulation | insulator | GAATATATATATATTC | SEQ ID NO:193 |
| sequence modification | ZmEPSPS exon 1 with two point mutations and heterospecific lox sites | GTGAACAACCTTATGAAATTTGGGCGCATAACTTCGTATAGCATACATTATACGAAGTTA TAAAGAACTCGCCCTCAAGGGTTGATCTTATGCCATCGTCATGATAAACAGTGGAGCAC GGACGATCCTTTACGTTGTTTTTAACAAACTTTGTCAGAAAACTAGCATCATTAACTTCTT AATGACGATTTCACAACAAAAAAAGGTAACCTCGCTACTAACATAACAAAATACTTGTTG CTTATTAATTATATGTTTTTTAATCTTTGATCAGGGGACAACAGTGGTTGATAACCTGTTG AACAGTGAGGATGTCCACTACATGCTCGGGGCCTTGAGGACTCTTGGTCTCTCTGTCGA AGCGGACAAAGCTGCCAAAAGAGCTGTAGTTGTTGGCTGTGGTGGAAAGTTCCCAGTT GAGGATTCTAAAGAGGAAGTGCAGCTCTTCTTGGGGAATGCTGGAATTGCAATGCGGG CATTGACAGCAGCTGTTACTGCTGCTGGTGGAAATGCAACGTATGTTTCCTCTCTTTCTCT CTACAATACTTGCATAACTTCGTATAAAGTATCCTATACGAAGTTATTGGAGTTAGTATG AAACCCATGGGTATGTCTAGT | SEQ ID NO:194 |
| decreases upregulation | miniature inverted-repeat transposable element ("MITE") | TACTCCCTCCGTTTCTTTTTATTAGTCGCTGGATAGTGCAATTTTGCACTATCCAGCGACT AATAAAAAGAAACGGAGGGAGTA | SEQ ID NO:195 |
| decreases upregulation | miniature inverted-repeat transposable element ("MITE") | TACTCCCTCCGTTTCTTTTTATTAGTCGCTGGATAGTGCAAAATTGCACTATCCAGCGACT AATAAAAAGAAACGGAGGGAGTA | SEQ ID NO:196 |
| up (constitutive) | G-box | ACACGTGACACGTGACACGTGACACGTG | SEQ ID NO:197 |
| decreased transcript stability | mRNA destabilizing element (mammalian) | TTATTTATTTTATTTATTTTATTTATTTTATTTATT | SEQ ID NO:198 |
| decreased transcript stability | mRNA destabilizing element (Arabidopsis thaliana) | AATTTTAATTTTAATTTTAATTTTAATTTTAATTTT | SEQ ID NO:199 |
| increased transcript stability | mRNA stabilizing element | TCTCTTTCTCTTTCTCTTTCTCTTTCTCTTTCTCTT | SEQ ID NO:200 |
| down | SHAT1-repressor | ATTAAAAAAATAAATAAGATATTATTAAAAAAATAAATAAGATATTATTAAAAAAATAAA TAAGATATTATTAAAAAAATAAATAAGATATT | SEQ ID NO:201 |
| decreased transcript stability | SAUR mRNA destabilizing element | AGATCTAGGAGACTGACATAGATTGGAGGAGACATTTTGTATAATAAGATCTAGGAGAC TGACATAGATTGGAGGAGACATTTTGTATAATA | SEQ ID NO:202 |
| down by recruiting transcription factors interacting with PRC2 | CTCC | CTCC(T/A/G)CC(G/T/A) | SEQ ID NO:203 |
| down by recruiting transcription factors interacting with PRC2 | CCG | (C/T/A)(G/T)C(C/A)(G/A)(C/A)C(G/T)(C/A) | SEQ ID NO:204 |
| down by recruiting transcription factors interacting with PRC2 | G-box | (C/G)ACGTGGNN(G/A/C)(T/A) | SEQ ID NO:205 |
| down by recruiting transcription factors interacting with PRC2 | GA repeat | A(G/A)A(G/A)AGA(G/A)(A/G) | SEQ ID NO:206 |
| down by recruiting transcription factors interacting with PRC2 | AC-rich | CA(A/T/C)CA(C/A)CA(A/C/T) | SEQ ID NO:207 |

TABLE 5-continued

| Type of regulation | Name of element | Sequence | SEQ ID NO |
|---|---|---|---|
| down by recruiting transcription factors interacting with PRC2 | Telobox | (A/G)AACCC(T/A)A(A/G) | SEQ ID NO:208 |
| up (Pi starvation response) | P1BS | GNATATNC | SEQ ID NO:209 |
| Up | Gbox | GCCACGTGCCGCCACGTGCCGCCACGTGCCGCCACGTGCC | SEQ ID NO:1722 |
| Up | Green tissue-specific promoter (GSP) | AAAATATTTATAAAATATTTATAAAATATTTATAAAATATTTAT | SEQ ID NO:1723 |
| Up | OCS | GTAAGCGCTTAC | SEQ ID NO:1724 |
| Down | CNV-18bp | GCACGCACGCACGGACGC | SEQ ID NO:1725 |
| Down | mRNA destablizing element | AATTTTAATTTTAATTTTAATTTTAATTTTAATTTT | SEQ ID NO:1726 |

TABLE 6

| Trait | Trait subcategory | Gene(s) | GeneID | GeneProduct | Expression Change | Gene SEQ ID | Protein SEQ ID |
|---|---|---|---|---|---|---|---|
| Abiotic stress | | AP2/ERF-N22(2) | 4325981 | protein | Increase | SEQ ID NO:210 | SEQ ID NO:932 |
| Abiotic stress | | AP37 | 4327621 | protein | Increase | SEQ ID NO:211 | SEQ ID NO:933 |
| Abiotic stress | | ARAG1 | 4330203 | protein | Increase | SEQ ID NO:212 | SEQ ID NO:934 |
| Abiotic stress | | ASR1 | 4329601 | protein | Increase | SEQ ID NO:213 | SEQ ID NO:935 |
| Abiotic stress | | ASR3 | 4329601 | protein | Increase | SEQ ID NO:214 | SEQ ID NO:936 |
| Abiotic stress | | ASR5 | 4349876 | protein | Increase | SEQ ID NO:215 | SEQ ID NO:937 |
| Abiotic stress | | COLD1 | 4336878 | protein | Increase | SEQ ID NO:216 | SEQ ID NO:938 |
| Abiotic stress | | CTB4a | 4335004 | protein | Increase | SEQ ID NO:217 | SEQ ID NO:939 |
| Abiotic stress | | CYP-like | 4344447 | protein | Increase | SEQ ID NO:218 | SEQ ID NO:940 |
| Abiotic stress | | CYP94C2b | 4351514 | protein | Increase | SEQ ID NO:219 | SEQ ID NO:941 |
| Abiotic stress | | DCA1 | 4348796 | protein | Decrease | SEQ ID NO:220 | SEQ ID NO:942 |
| Abiotic stress | | DREB1A | 4347620 | protein | Increase | SEQ ID NO:221 | SEQ ID NO:943 |
| Abiotic stress | | DREB1B | 4347618 | protein | Increase | SEQ ID NO:222 | SEQ ID NO:944 |
| Abiotic stress | | DST | 4334350 | protein | Increase | SEQ ID NO:223 | SEQ ID NO:945 |
| Abiotic stress | | EG1 | 4325037 | protein | Increase | SEQ ID NO:224 | SEQ ID NO:946 |
| Abiotic stress | | GA2ox6 | 4336431 | protein | Increase | SEQ ID NO:225 | SEQ ID NO:947 |
| Abiotic stress | | Ghd2 | 4330626 | protein | Decrease | SEQ ID NO:226 | SEQ ID NO:948 |
| Abiotic stress | | Ghd7 | 107276161 | protein | Decrease | SEQ ID NO:227 | SEQ ID NO:949 |
| Abiotic stress | | glyoxalase II | 4347581 | protein | Increase | SEQ ID NO:228 | SEQ ID NO:950 |
| Abiotic stress | | glyoxylase pathway | 4347581 | protein | Increase | SEQ ID NO:229 | SEQ ID NO:951 |
| Abiotic stress | | gr3 | 4348623 | protein | Decrease | SEQ ID NO:230 | SEQ ID NO:952 |
| Abiotic stress | | GS2 | 4337272 | protein | Increase | SEQ ID NO:231 | SEQ ID NO:953 |
| Abiotic stress | | JIOsPR10 | 4332568 | protein | Increase | SEQ ID NO:232 | SEQ ID NO:954 |
| Abiotic stress | | LOC_Os03g61750 (OsTRM13) | 9267457 | protein | Increase | SEQ ID NO:233 | SEQ ID NO:955 |
| Abiotic stress | | LOS5 | 838224 | protein | Increase | SEQ ID NO:234 | SEQ ID NO:956 |
| Abiotic stress | | LRK2 | 4328340 | protein | Increase | SEQ ID NO:235 | SEQ ID NO:957 |
| Abiotic stress | | microRNA319 | MI0001098 | miRNA | Increase | | |
| Abiotic stress | | MicroRNA528 | MI0003201 | miRNA | Increase | | |
| Abiotic stress | | MID1 | 4338925 | protein | Increase | SEQ ID NO:238 | SEQ ID NO:960 |
| Abiotic stress | | miR169r-5p | MI0006973 | miRNA | Increase | | |
| Abiotic stress | | miR390 | MI0001690 | miRNA | Decrease | | |
| Abiotic stress | | MSD1 | 4338417 | protein | Increase | SEQ ID NO:241 | SEQ ID NO:963 |
| Abiotic stress | | NF-YC13 | 4325336 | protein | Increase | SEQ ID NO:242 | SEQ ID NO:964 |
| Abiotic stress | | NUS1 | 4333618 | protein | Increase | SEQ ID NO:243 | SEQ ID NO:965 |
| Abiotic stress | | OCPI2 | 4326646 | ncRNA | Increase | SEQ ID NO:244 | |
| Abiotic stress | | OgTT1 | 4333000 | protein | Increase | SEQ ID NO:245 | SEQ ID NO:967 |
| Abiotic stress | | ONAC022 | 4331520 | protein | Increase | SEQ ID NO:246 | SEQ ID NO:968 |
| Abiotic stress | | ONAC045 | 4349650 | protein | Increase | SEQ ID NO:247 | SEQ ID NO:969 |
| Abiotic stress | | ONAC063 | 4345668 | protein | Increase | SEQ ID NO:248 | SEQ ID NO:970 |
| Abiotic stress | | ONAC095 | 4342116 | protein | increase/decrease | SEQ ID NO:249 | SEQ ID NO:971 |
| Abiotic stress | | ONAC106 | 9266817 | protein | Increase | SEQ ID NO:250 | SEQ ID NO:972 |
| Abiotic stress | | OrbHLH001 | 4326959 | protein | Increase | SEQ ID NO:251 | SEQ ID NO:973 |
| Abiotic stress | | OrbHLH2 | 4350609 | protein | Increase | SEQ ID NO:252 | SEQ ID NO:974 |
| Abiotic stress | | Os09g0410300 | 4347029 | protein | Increase | SEQ ID NO:253 | SEQ ID NO:975 |
| Abiotic stress | | osa-MIR393 | MI0001026 | miRNA | Decrease | | |
| Abiotic stress | | OsABA8ox3 | 4347261 | protein | Decrease | SEQ ID NO:255 | SEQ ID NO:977 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Abiotic stress | | OsABF2 | 4340462 | protein | Increase | SEQ ID NO:256 | SEQ ID NO:978 |
| Abiotic stress | | OsABI5 | 4325061 | protein | Increase | SEQ ID NO:257 | SEQ ID NO:979 |
| Abiotic stress | | OsABIL2 | 4339797 | protein | Decrease | SEQ ID NO:258 | SEQ ID NO:980 |
| Abiotic stress | | OsACA6 | 4336912 | protein | Increase | SEQ ID NO:259 | SEQ ID NO:981 |
| Abiotic stress | | OsAMTR1 | 4339095 | protein | Increase | SEQ ID NO:260 | SEQ ID NO:982 |
| Abiotic stress | | OsANN1 | 4330759 | protein | Increase | SEQ ID NO:261 | SEQ ID NO:983 |
| Abiotic stress | | OsAOX1a | 4336874 | protein | Increase | SEQ ID NO:262 | SEQ ID NO:984 |
| Abiotic stress | | OsAP21 | 4327064 | protein | Increase | SEQ ID NO:263 | SEQ ID NO:985 |
| Abiotic stress | | OsAPXa | 4332474 | protein | Increase | SEQ ID NO:264 | SEQ ID NO:986 |
| Abiotic stress | | OsAPXb | 4344397 | protein | Increase | SEQ ID NO:265 | SEQ ID NO:987 |
| Abiotic stress | | OsAREB1 | 4340462 | protein | Increase | SEQ ID NO:266 | SEQ ID NO:988 |
| Abiotic stress | | OsAsr1 | 4349876 | protein | Increase | SEQ ID NO:267 | SEQ ID NO:989 |
| Abiotic stress | | OsbHLH068 | 4337107 | protein | Decrease | SEQ ID NO:268 | SEQ ID NO:990 |
| Abiotic stress | | OsbHLH148 | 4334060 | protein | Increase | SEQ ID NO:269 | SEQ ID NO:991 |
| Abiotic stress | | OsbZIP16 | 4328579 | protein | Increase | SEQ ID NO:270 | SEQ ID NO:992 |
| Abiotic stress | | OsbZIP23 | 4330838 | protein | Increase/Decrease | SEQ ID NO:271 | SEQ ID NO:993 |
| Abiotic stress | | OsbZIP46 | 4340462 | protein | Increase | SEQ ID NO:272 | SEQ ID NO:994 |
| Abiotic stress | | OsbZIP71 | 4346672 | protein | Increase | SEQ ID NO:273 | SEQ ID NO:995 |
| Abiotic stress | | OsbZIP72 | 4347257 | protein | Increase | SEQ ID NO:274 | SEQ ID NO:996 |
| Abiotic stress | | OsCA1 | 4326583 | protein | Increase | SEQ ID NO:275 | SEQ ID NO:997 |
| Abiotic stress | | OsCAS | 4330608 | protein | Increase | SEQ ID NO:276 | SEQ ID NO:998 |
| Abiotic stress | | OsCBL8 | 107276173 | protein | Increase | SEQ ID NO:277 | SEQ ID NO:999 |
| Abiotic stress | | OsCBSX4 | 4334035 | protein | Increase | SEQ ID NO:278 | SEQ ID NO:1000 |
| Abiotic stress | | OsCDPK13 | 4331490 | protein | Increase | SEQ ID NO:279 | SEQ ID NO:1001 |
| Abiotic stress | | OsCDPK7 | 4336783 | protein | Increase | SEQ ID NO:280 | SEQ ID NO:1002 |
| Abiotic stress | | OsCEST | 4327627 | protein | Increase | SEQ ID NO:281 | SEQ ID NO:1003 |
| Abiotic stress | | OsChl1 | 4327522 | protein | Increase | SEQ ID NO:282 | SEQ ID NO:1004 |
| Abiotic stress | | OsCIPK03 | 4332665 | protein | Increase | SEQ ID NO:283 | SEQ ID NO:1005 |
| Abiotic stress | | OsCIPK12 | 4325613 | protein | Increase | SEQ ID NO:284 | SEQ ID NO:1006 |
| Abiotic stress | | OsCIPK15 | 4349594 | protein | Increase | SEQ ID NO:285 | SEQ ID NO:1007 |
| Abiotic stress | | OsCKX2 | 4327333 | protein | Decrease | SEQ ID NO:286 | SEQ ID NO:1008 |
| Abiotic stress | | OsClpD1 | 4329520 | protein | Increase | SEQ ID NO:287 | SEQ ID NO:1009 |
| Abiotic stress | | OsCNX | 4335732 | protein | Increase | SEQ ID NO:288 | SEQ ID NO:1010 |
| Abiotic stress | | OsCOIN | 4326292 | protein | Increase | SEQ ID NO:289 | SEQ ID NO:1011 |
| Abiotic stress | | OsCPK21 | 4346187 | protein | Increase | SEQ ID NO:290 | SEQ ID NO:1012 |
| Abiotic stress | | OsCPK4 | 4328155 | protein | Increase | SEQ ID NO:291 | SEQ ID NO:1013 |
| Abiotic stress | | OsCPK9 | 4333767 | protein | Increase | SEQ ID NO:292 | SEQ ID NO:1014 |
| Abiotic stress | | OsCTR1 | 4335292 | protein | Increase | SEQ ID NO:293 | SEQ ID NO:1015 |
| Abiotic stress | | OsCYP18-2 | 4346316 | protein | Increase | SEQ ID NO:294 | SEQ ID NO:1016 |
| Abiotic stress | | OsCYP19-4 | 4342020 | protein | Increase | SEQ ID NO:295 | SEQ ID NO:1017 |
| Abiotic stress | | OsCYP2 | 4328121 | protein | Increase | SEQ ID NO:296 | SEQ ID NO:1018 |
| Abiotic stress | | OsCYP21-4 | 4343218 | protein | Increase | SEQ ID NO:297 | SEQ ID NO:1019 |
| Abiotic stress | | OsDERF1 | 107275353 | protein | Decrease | SEQ ID NO:298 | SEQ ID NO:1020 |
| Abiotic stress | | OsDHODH1 | 4330657 | protein | Increase | SEQ ID NO:299 | SEQ ID NO:1021 |
| Abiotic stress | | OsDi19-4 | 4329107 | protein | Increase | SEQ ID NO:300 | SEQ ID NO:1022 |
| Abiotic stress | | OsDIL | 4348109 | protein | Increase | SEQ ID NO:301 | SEQ ID NO:1023 |
| Abiotic stress | | OsDIS1 | 9266295 | protein | Decrease | SEQ ID NO:302 | SEQ ID NO:1024 |
| Abiotic stress | | OsDREB1A | 4347620 | protein | Increase | SEQ ID NO:303 | SEQ ID NO:1025 |
| Abiotic stress | | OsDREB1B | 4347618 | protein | Increase | SEQ ID NO:304 | SEQ ID NO:1026 |
| Abiotic stress | | OsDREB1F | 4323832 | protein | Increase | SEQ ID NO:305 | SEQ ID NO:1027 |
| Abiotic stress | | OsDREB1G | 4346220 | protein | Increase | SEQ ID NO:306 | SEQ ID NO:1028 |
| Abiotic stress | | OsDREB2A | 4324418 | protein | Increase | SEQ ID NO:307 | SEQ ID NO:1029 |
| Abiotic stress | | OsDREB2B | 4338484 | protein | Increase | SEQ ID NO:308 | SEQ ID NO:1030 |
| Abiotic stress | | OsECS | 4337696 | protein | Increase | SEQ ID NO:309 | SEQ ID NO:1031 |
| Abiotic stress | | OsEm1 | 4338499 | protein | Increase | SEQ ID NO:310 | SEQ ID NO:1032 |
| Abiotic stress | | OsEREBP1 | 4330935 | protein | Increase | SEQ ID NO:311 | SEQ ID NO:1033 |
| Abiotic stress | | OsERF109 | 4346686 | protein | Increase | SEQ ID NO:312 | SEQ ID NO:1034 |
| Abiotic stress | | OsERF10a | 4338484 | protein | Increase | SEQ ID NO:313 | SEQ ID NO:1035 |
| Abiotic stress | | OsERF3 | 4327621 | protein | Decrease | SEQ ID NO:314 | SEQ ID NO:1036 |
| Abiotic stress | | OsERF48 | 4345541 | protein | Increase | SEQ ID NO:315 | SEQ ID NO:1037 |
| Abiotic stress | | OsERF4a | 4327621 | protein | Increase | SEQ ID NO:316 | SEQ ID NO:1038 |
| Abiotic stress | | OsERF71 | 4340383 | protein | Increase | SEQ ID NO:317 | SEQ ID NO:1039 |
| Abiotic stress | | OsERF922 | 4327006 | protein | Decrease | SEQ ID NO:318 | SEQ ID NO:1040 |
| Abiotic stress | | OsFAD8 | 4344389 | protein | Increase | SEQ ID NO:319 | SEQ ID NO:1041 |
| Abiotic stress | | OsFKBP20 | 4339000 | protein | Increase | SEQ ID NO:320 | SEQ ID NO:1042 |
| Abiotic stress | | OsGGP | 4351698 | protein | Increase | SEQ ID NO:321 | SEQ ID NO:1043 |
| Abiotic stress | | OsGL1-2 | 4328496 | protein | Increase | SEQ ID NO:322 | SEQ ID NO:1044 |
| Abiotic stress | | OsGL1-6 | 4331117 | protein | Increase | SEQ ID NO:323 | SEQ ID NO:1045 |
| Abiotic stress | | OsGME-1 | 4348636 | protein | Increase | SEQ ID NO:324 | SEQ ID NO:1046 |
| Abiotic stress | | OsGME-2 | 4350816 | protein | Increase | SEQ ID NO:325 | SEQ ID NO:1047 |
| Abiotic stress | | OsGRAS23 | 4336820 | protein | Increase | SEQ ID NO:326 | SEQ ID NO:1048 |
| Abiotic stress | | OsGRX8 | 4329462 | protein | Increase | SEQ ID NO:327 | SEQ ID NO:1049 |
| Abiotic stress | | OsGS | 4330649 | protein | Increase | SEQ ID NO:328 | SEQ ID NO:1050 |
| Abiotic stress | | OsGSTU4 | 4340775 | protein | Increase | SEQ ID NO:329 | SEQ ID NO:1051 |
| Abiotic stress | | OsHAP2E | 4333094 | protein | Increase | SEQ ID NO:330 | SEQ ID NO:1052 |
| Abiotic stress | | OsHBP1b | 4326907 | protein | Increase | SEQ ID NO:331 | SEQ ID NO:1053 |
| Abiotic stress | | OsHKT1;1 | 9266695 | protein | Increase | SEQ ID NO:332 | SEQ ID NO:1054 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Abiotic stress | | OsHKT1;5 | 4327757 | protein | Increase | SEQ ID NO:333 | SEQ ID NO:1055 |
| Abiotic stress | | OsHOX24 | 4330155 | protein | Decrease | SEQ ID NO:334 | SEQ ID NO:1056 |
| Abiotic stress | | OsHSF7 | 4331707 | protein | Increase | SEQ ID NO:335 | SEQ ID NO:1057 |
| Abiotic stress | | OsHsfB2b | 4346229 | protein | Decrease | SEQ ID NO:336 | SEQ ID NO:1058 |
| Abiotic stress | | osHsp101 | 4339343 | protein | Increase | SEQ ID NO:337 | SEQ ID NO:1059 |
| Abiotic stress | | Oshsp16.9 | 4325697 | protein | Increase | SEQ ID NO:338 | SEQ ID NO:1060 |
| Abiotic stress | | OsHsp17.0 | 4325698 | protein | Increase | SEQ ID NO:339 | SEQ ID NO:1061 |
| Abiotic stress | | OsHsp23.7 | 9268687 | ncRNA | Increase | SEQ ID NO:340 | |
| Abiotic stress | | OsICE1 | 4350609 | protein | Increase | SEQ ID NO:341 | SEQ ID NO:1063 |
| Abiotic stress | | OsICE2 | 4326959 | protein | Increase | SEQ ID NO:342 | SEQ ID NO:1064 |
| Abiotic stress | | OsIFL | 9269676 | protein | Increase | SEQ ID NO:343 | SEQ ID NO:1065 |
| Abiotic stress | | OsIMP | 4333347 | protein | Increase | SEQ ID NO:344 | SEQ ID NO:1066 |
| Abiotic stress | | OsiSAP1 | 4347423 | protein | Increase | SEQ ID NO:345 | SEQ ID NO:1067 |
| Abiotic stress | | OsJAZ9 | 4331832 | protein | Decrease | SEQ ID NO:346 | SEQ ID NO:1068 |
| Abiotic stress | | OsLAC10 | 107276196 | protein | Increase | SEQ ID NO:347 | SEQ ID NO:1069 |
| Abiotic stress | | OsLEA3-1 | 4339480 | protein | Increase | SEQ ID NO:348 | SEQ ID NO:1070 |
| Abiotic stress | | OsLEA3-2 | 4332688 | protein | Increase | SEQ ID NO:349 | SEQ ID NO:1071 |
| Abiotic stress | | OsLOL5 | 4325320 | protein | Increase | SEQ ID NO:350 | SEQ ID NO:1072 |
| Abiotic stress | | OsMADS87 | 107280316 | protein | Increase | SEQ ID NO:351 | SEQ ID NO:1073 |
| Abiotic stress | | OsMAPK5 | 4332475 | protein | Increase | SEQ ID NO:352 | SEQ ID NO:1074 |
| Abiotic stress | | OsMGD | 4331045 | protein | Increase | SEQ ID NO:353 | SEQ ID NO:1075 |
| Abiotic stress | | OsMIOX | 4341305 | protein | Increase | SEQ ID NO:354 | SEQ ID NO:1076 |
| Abiotic stress | | OsMPG1 | 4327472 | protein | Increase | SEQ ID NO:355 | SEQ ID NO:1077 |
| Abiotic stress | | OsMSR2 | 4325408 | protein | Increase | SEQ ID NO:356 | SEQ ID NO:1078 |
| Abiotic stress | | OsMT1a | 4351213 | protein | Increase | SEQ ID NO:357 | SEQ ID NO:1079 |
| Abiotic stress | | OsMYB2 | 4332651 | protein | Increase | SEQ ID NO:358 | SEQ ID NO:1080 |
| Abiotic stress | | OsMYB30 | 4330027 | protein | Decrease | SEQ ID NO:359 | SEQ ID NO:1081 |
| Abiotic stress | | OsMYB3R-2 | 4327399 | protein | Increase | SEQ ID NO:360 | SEQ ID NO:1082 |
| Abiotic stress | | Osmyb4 | 4336407 | protein | Increase | SEQ ID NO:361 | SEQ ID NO:1083 |
| Abiotic stress | | OsMYB48-1 | 4324302 | protein | Increase | SEQ ID NO:362 | SEQ ID NO:1084 |
| Abiotic stress | | OsMYB511 | 4336779 | protein | Increase | SEQ ID NO:363 | SEQ ID NO:1085 |
| Abiotic stress | | OsMYB55 | 4339548 | protein | Increase | SEQ ID NO:364 | SEQ ID NO:1086 |
| Abiotic stress | | OsMYB91 | 4352588 | protein | Increase | SEQ ID NO:365 | SEQ ID NO:1087 |
| Abiotic stress | | OsMYBR1 | 4330349 | protein | Increase | SEQ ID NO:366 | SEQ ID NO:1088 |
| Abiotic stress | | OsNAC10 | 4349648 | protein | Increase | SEQ ID NO:367 | SEQ ID NO:1089 |
| Abiotic stress | | OsNAC2 | 4336052 | protein | Decrease | SEQ ID NO:368 | SEQ ID NO:1090 |
| Abiotic stress | | OsNAC5 | 4349963 | protein | Increase | SEQ ID NO:369 | SEQ ID NO:1091 |
| Abiotic stress | | OsNAC6 | 4325006 | protein | Increase | SEQ ID NO:370 | SEQ ID NO:1092 |
| Abiotic stress | | OsNAP | 4332717 | protein | Increase | SEQ ID NO:371 | SEQ ID NO:1093 |
| Abiotic stress | | OsNDPK2 | 4352460 | protein | Increase | SEQ ID NO:372 | SEQ ID NO:1094 |
| Abiotic stress | | OsNF-YA7 | 4344874 | protein | Increase | SEQ ID NO:373 | SEQ ID NO:1095 |
| Abiotic stress | | OsNHX1 | 4344217 | protein | Increase | SEQ ID NO:374 | SEQ ID NO:1096 |
| Abiotic stress | | OsORAP1 | 4346875 | protein | Decrease | SEQ ID NO:375 | SEQ ID NO:1097 |
| Abiotic stress | | OsOTS1 SUMO protease | 4341072 | protein | Increase | SEQ ID NO:376 | SEQ ID NO:1098 |
| Abiotic stress | | OsPCS2 | 4339838 | protein | Decrease | SEQ ID NO:377 | SEQ ID NO:1099 |
| Abiotic stress | | OsPEX11 (Oa03g0302000) | 4332579 | protein | Increase | SEQ ID NO:378 | SEQ ID NO:1100 |
| Abiotic stress | | OsPFA-DSP1 | 4346470 | protein | Decrease | SEQ ID NO:379 | SEQ ID NO:1101 |
| Abiotic stress | | OsPgk2a-P | 4328435 | protein | Increase | SEQ ID NO:380 | SEQ ID NO:1102 |
| Abiotic stress | | OsPIL1 | 4334324 | protein | Increase | SEQ ID NO:381 | SEQ ID NO:1103 |
| Abiotic stress | | OsPIP1;3 | 4331194 | protein | Increase | SEQ ID NO:382 | SEQ ID NO:1104 |
| Abiotic stress | | OsPP108 | 4346736 | protein | Increase | SEQ ID NO:383 | SEQ ID NO:1105 |
| Abiotic stress | | OsPR4a | 4350823 | protein | Increase | SEQ ID NO:384 | SEQ ID NO:1106 |
| Abiotic stress | | OsPRP3 | 4348110 | protein | Increase | SEQ ID NO:385 | SEQ ID NO:1107 |
| Abiotic stress | | OsPsbR1 | 4342395 | protein | Increase | SEQ ID NO:386 | SEQ ID NO:1108 |
| Abiotic stress | | OsPUB15 | 4344480 | protein | Increase | SEQ ID NO:387 | SEQ ID NO:1109 |
| Abiotic stress | | OsPYL3 or OsPYL9 | 4328916 | protein | Increase | SEQ ID NO:388 | SEQ ID NO:1110 |
| Abiotic stress | | OsRab7 | 4339322 | protein | Increase | SEQ ID NO:389 | SEQ ID NO:1111 |
| Abiotic stress | | OsRacB | 4328116 | protein | Increase | SEQ ID NO:390 | SEQ ID NO:1112 |
| Abiotic stress | | OsRAN1 | 4325312 | protein | Increase | SEQ ID NO:391 | SEQ ID NO:1113 |
| Abiotic stress | | OsRAN2 | 4339683 | protein | Increase | SEQ ID NO:392 | SEQ ID NO:1114 |
| Abiotic stress | | OsRbohA | 4324163 | protein | Increase | SEQ ID NO:393 | SEQ ID NO:1115 |
| Abiotic stress | | OsRDCP1 | 4336483 | protein | Increase | SEQ ID NO:394 | SEQ ID NO:1116 |
| Abiotic stress | | OsRINO1 | 4331917 | protein | Increase | SEQ ID NO:395 | SEQ ID NO:1117 |
| Abiotic stress | | OSRIP18 | 4343572 | protein | Increase | SEQ ID NO:396 | SEQ ID NO:1118 |
| Abiotic stress | | OsRZ2 | 4342599 | protein | Increase | SEQ ID NO:397 | SEQ ID NO:1119 |
| Abiotic stress | | OsRZFP34 | 4324695 | protein | Decrease | SEQ ID NO:398 | SEQ ID NO:1120 |
| Abiotic stress | | OsSce1 | 4349236 | protein | Increase | SEQ ID NO:399 | SEQ ID NO:1121 |
| Abiotic stress | | OsSCP | 4342317 | protein | Increase | SEQ ID NO:400 | SEQ ID NO:1122 |
| Abiotic stress | | OsSDIR1 | 4332396 | protein | Increase | SEQ ID NO:401 | SEQ ID NO:1123 |
| Abiotic stress | | OsSGL | 4328218 | protein | Increase | SEQ ID NO:402 | SEQ ID NO:1124 |
| Abiotic stress | | OsSIDP366 | 4341921 | protein | Increase | SEQ ID NO:403 | SEQ ID NO:1125 |
| Abiotic stress | | OsSIK1 | 4340000 | protein | Increase | SEQ ID NO:404 | SEQ ID NO:1126 |
| Abiotic stress | | OsSIK2 | 4342594 | protein | Increase | SEQ ID NO:405 | SEQ ID NO:1127 |
| Abiotic stress | | OsSIT1 | 4330111 | protein | Decrease | SEQ ID NO:406 | SEQ ID NO:1128 |
| Abiotic stress | | OsSIZ1 | 4337672 | protein | Increase | SEQ ID NO:407 | SEQ ID NO:1129 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Abiotic stress | | OsSMCP1 | 4342211 | protein | Increase | SEQ ID NO:408 | SEQ ID NO:1130 |
| Abiotic stress | | OsSNAC1 | 4334553 | protein | Increase | SEQ ID NO:409 | SEQ ID NO:1131 |
| Abiotic stress | | OsSPX1 | 4341465 | protein | Increase | SEQ ID NO:410 | SEQ ID NO:1132 |
| Abiotic stress | | OsSRFP1 | 4332833 | protein | Decrease | SEQ ID NO:411 | SEQ ID NO:1133 |
| Abiotic stress | | OsSta2 | 4330191 | protein | Increase | SEQ ID NO:412 | SEQ ID NO:1134 |
| Abiotic stress | | OsSUV3 | 4334089 | protein | Increase | SEQ ID NO:413 | SEQ ID NO:1135 |
| Abiotic stress | | OsTIFY11b | 4331834 | protein | Increase | SEQ ID NO:414 | SEQ ID NO:1136 |
| Abiotic stress | | OsTOP6A1 | 9267055 | protein | Increase | SEQ ID NO:415 | SEQ ID NO:1137 |
| Abiotic stress | | OsTPP1 | 4330221 | protein | Increase | SEQ ID NO:416 | SEQ ID NO:1138 |
| Abiotic stress | | OsTPS1 | 9266089 | protein | Increase | SEQ ID NO:417 | SEQ ID NO:1139 |
| Abiotic stress | | OsTZF1 | 4338037 | protein | Increase | SEQ ID NO:418 | SEQ ID NO:1140 |
| Abiotic stress | | OsVPE3 | 4330133 | protein | Decrease | SEQ ID NO:419 | SEQ ID NO:1141 |
| Abiotic stress | | OsVTC1-1 | 4327472 | protein | Increase | SEQ ID NO:420 | SEQ ID NO:1142 |
| Abiotic stress | | OsVTE1 | 4329007 | protein | Increase | SEQ ID NO:421 | SEQ ID NO:1143 |
| Abiotic stress | | OsWR1 | 4328653 | protein | Increase | SEQ ID NO:422 | SEQ ID NO:1144 |
| Abiotic stress | | OsWRKY11 | 4326690 | protein | Increase | SEQ ID NO:423 | SEQ ID NO:1145 |
| Abiotic stress | | OsWRKY30 | 4345940 | protein | Increase | SEQ ID NO:424 | SEQ ID NO:1146 |
| Abiotic stress | | OsWRKY47 | 4344296 | protein | Increase | SEQ ID NO:425 | SEQ ID NO:1147 |
| Abiotic stress | | OsWRKY74 | 4346768 | protein | Increase | SEQ ID NO:426 | SEQ ID NO:1148 |
| Abiotic stress | | OsZFP6 | 4329640 | protein | Increase | SEQ ID NO:427 | SEQ ID NO:1149 |
| Abiotic stress | | OVP1 | 4341645 | protein | Increase | SEQ ID NO:428 | SEQ ID NO:1150 |
| Abiotic stress | | Rab16A | 4350454 | protein | Increase | SEQ ID NO:429 | SEQ ID NO:1151 |
| Abiotic stress | | RGG1 | 4333518 | protein | Increase | SEQ ID NO:430 | SEQ ID NO:1152 |
| Abiotic stress | | rHsp90 | 4342077 | protein | Increase | SEQ ID NO:431 | SEQ ID NO:1153 |
| Abiotic stress | | ROC1 | 4346661 | protein | Increase | SEQ ID NO:432 | SEQ ID NO:1154 |
| Abiotic stress | | Rubisco activase | 4351224 | protein | Increase | SEQ ID NO:433 | SEQ ID NO:1155 |
| Abiotic stress | | SAPK4 | 4324934 | protein | Increase | SEQ ID NO:434 | SEQ ID NO:1156 |
| Abiotic stress | | SAPK6 | 4329630 | protein | Increase | SEQ ID NO:435 | SEQ ID NO:1157 |
| Abiotic stress | | SAPK9 | 4352660 | protein | Increase | SEQ ID NO:436 | SEQ ID NO:1158 |
| Abiotic stress | | sHSP17.7 | 4332363 | protein | Increase | SEQ ID NO:437 | SEQ ID NO:1159 |
| Abiotic stress | | SKC1 | 4327757 | protein | Increase/Decrease | SEQ ID NO:438 | SEQ ID NO:1160 |
| Abiotic stress | | SNAC1 | 4334553 | protein | Increase | SEQ ID NO:439 | SEQ ID NO:1161 |
| Abiotic stress | | SNAC2 | 4325006 | protein | Increase | SEQ ID NO:440 | SEQ ID NO:1162 |
| Abiotic stress | | SNAC3 | 4327298 | protein | Increase | SEQ ID NO:441 | SEQ ID NO:1163 |
| Abiotic stress | | SQS | 4334492 | protein | Decrease | SEQ ID NO:442 | SEQ ID NO:1164 |
| Abiotic stress | | TLD1 | 4350632 | protein | Decrease | SEQ ID NO:443 | SEQ ID NO:1165 |
| Abiotic stress | | WRKY62 | 4347070 | protein | Increase | SEQ ID NO:444 | SEQ ID NO:1166 |
| Abiotic stress | | ZAT10 | 839666 | protein | Increase | SEQ ID NO:445 | SEQ ID NO:1167 |
| Abiotic stress | | ZFP177 | 4342503 | protein | Increase | SEQ ID NO:446 | SEQ ID NO:1168 |
| Abiotic stress | | ZFP179 | 9272517 | protein | Increase | SEQ ID NO:447 | SEQ ID NO:1169 |
| Abiotic stress | | ZFP185 | 4328609 | protein | Decrease | SEQ ID NO:448 | SEQ ID NO:1170 |
| Abiotic stress | | ZFP252 | 4352653 | protein | Increase | SEQ ID NO:449 | SEQ ID NO:1171 |
| Abiotic stress | | ZFP36 | 4333197 | protein | Increase | SEQ ID NO:450 | SEQ ID NO:1172 |
| Architecture | architecture | MIR172B | MI0001140 | miRNA | increase/decrease | | |
| Architecture | architecture | MIR172D | MI0001154 | miRNA | increase/decrease | | |
| Architecture | biomass | ARGOS | 4335949 | protein | Increase | SEQ ID NO:453 | SEQ ID NO:1175 |
| Architecture | Biomass | BZIP27 | 4332602 | protein | Decrease | SEQ ID NO:454 | SEQ ID NO:1176 |
| Architecture | biomass | MIR156B | MI0000654 | miRNA | Increase | | |
| Architecture | biomass | MIR156D | MI0000656 | miRNA | Increase | | |
| Architecture | biomass | MIR156E | MI0000657 | miRNA | Increase | | |
| Architecture | biomass | MIR156F | MI0000658 | miRNA | Increase | | |
| Architecture | BR homeostasis - grain size and leaf angle | SLG | 4343175 | protein | increase/decrease | SEQ ID NO:459 | SEQ ID NO:1181 |
| Architecture | branching/height | LAZY1 | 4350543 | protein | increase/decrease | SEQ ID NO:460 | SEQ ID NO:1182 |
| Architecture | branching/meristem | LAX1 | 4327431 | protein | increase/decrease | SEQ ID NO:461 | SEQ ID NO:1183 |
| Architecture | Branching/Tillering | CKX3 | 4348932 | protein | Decrease | SEQ ID NO:462 | SEQ ID NO:1184 |
| Architecture | Branching/Tillering | GN1A | 4327333 | protein | Decrease | SEQ ID NO:463 | SEQ ID NO:1185 |
| Architecture | cellular proliferation, organ growth | SG1 | 4347276 | protein | increase/decrease | SEQ ID NO:464 | SEQ ID NO:1186 |
| Architecture | chloroplast development | HAP3A | 9268285 | protein | Decrease | SEQ ID NO:465 | SEQ ID NO:1187 |
| Architecture | cold stress | RAN1 | 4325312 | protein | Increase | SEQ ID NO:466 | SEQ ID NO:1188 |
| Architecture | cold stress | RAN2 | 4339683 | protein | Increase | SEQ ID NO:467 | SEQ ID NO:1189 |
| Architecture | domestication gene | PROG1 | 107275427 | protein | Increase/Decrease | SEQ ID NO:468 | SEQ ID NO:1190 |
| Architecture | Domestication panicle | LG1 | 4337258 | protein | increase/decrease | SEQ ID NO:469 | SEQ ID NO:1191 |
| Architecture | drought tolerance | SDIR1 | 4332396 | protein | Increase | SEQ ID NO:470 | SEQ ID NO:1192 |
| Architecture | dwarfism & yield | FIE2 | 4344620 | protein | Increase | SEQ ID NO:471 | SEQ ID NO:1193 |
| Architecture | epigenetics | DRM2 | 4331357 | protein | Increase | SEQ ID NO:472 | SEQ ID NO:1194 |
| Architecture | Fe acquisition and root growth | RMC | 4337274 | protein | Increase | SEQ ID NO:473 | SEQ ID NO:1195 |
| Architecture | fertility | CDPK9 | 4333767 | protein | Increase | SEQ ID NO:474 | SEQ ID NO:1196 |
| Architecture | fertilization/flower opening/dehiecnse | JAR1 | 4339756 | protein | increase/decrease | SEQ ID NO:475 | SEQ ID NO:1197 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Architecture | fertilization/flower opening/dehiecnse | JAR2 | 4324650 | protein | increase/decrease | SEQ ID NO:476 | SEQ ID NO:1198 |
| Architecture | floral architecture | ERF108 | 4325981 | protein | Increase | SEQ ID NO:477 | SEQ ID NO:1199 |
| Architecture | floral architecture | FZP | 4344233 | protein | increase/decrease | SEQ ID NO:478 | SEQ ID NO:1200 |
| Architecture | floral architecture | G1 | 107276238 | protein | increase/decrease | SEQ ID NO:479 | SEQ ID NO:1201 |
| Architecture | Floral architecture | G1L5 | 9266624 | protein | increase/decrease | SEQ ID NO:480 | SEQ ID NO:1202 |
| Architecture | Floral organ number | FON1 | 4342080 | protein | increase/decrease | SEQ ID NO:481 | SEQ ID NO:1203 |
| Architecture | Floral organ number | FON2 | 107276890 | protein | increase/decrease | SEQ ID NO:482 | SEQ ID NO:1204 |
| Architecture | Floral organ number | FOR1 | 4343645 | protein | Decrease | SEQ ID NO:483 | SEQ ID NO:1205 |
| Architecture | Flower architecture | APO1 | 107277138 | protein | Increase/Decrease | SEQ ID NO:484 | SEQ ID NO:1206 |
| Architecture | Flower architecture | EG1 | 4325037 | protein | increase/Decrease | SEQ ID NO:485 | SEQ ID NO:1207 |
| Architecture | flower architecture | RAG | 9271572 | protein | increase/decrease | SEQ ID NO:486 | SEQ ID NO:1208 |
| Architecture | flower development | MFO1 | 4330328 | protein | increase/decrease | SEQ ID NO:487 | SEQ ID NO:1209 |
| Architecture | flower structure | LFY | 4336857 | protein | increase/decrease | SEQ ID NO:488 | SEQ ID NO:1210 |
| Architecture | flowering | SDG708 | 4335856 | protein | Increase | SEQ ID NO:489 | SEQ ID NO:1211 |
| Architecture | flowering time | RFL | 4336857 | protein | increase/decrease | SEQ ID NO:490 | SEQ ID NO:1212 |
| Architecture | flowering time/SAM | HD3A | 4340185 | protein | increase/decrease | SEQ ID NO:491 | SEQ ID NO:1213 |
| Architecture | flowering tme/structure | MADS18 | 4343851 | protein | increase/decrease | SEQ ID NO:492 | SEQ ID NO:1214 |
| Architecture | flowering tme/structure | MADS24 | 4347517 | protein | increase/decrease | SEQ ID NO:493 | SEQ ID NO:1215 |
| Architecture | flowering tme/structure | MADS50 | 4331445 | protein | increase/decrease | SEQ ID NO:494 | SEQ ID NO:1216 |
| Architecture | flowers and seeds | BRD2 | 4348555 | protein | Increase | SEQ ID NO:495 | SEQ ID NO:1217 |
| Architecture | fragrance | SK2(T)(SCL, FGR) | 4345606 | protein | increase/decrease | SEQ ID NO:496 | SEQ ID NO:1218 |
| Architecture | GA response, plant growth | SLR1 | 4333860 | protein | increase/decrease | SEQ ID NO:497 | SEQ ID NO:1219 |
| Architecture | grain length | IL15 | 4330725 | protein | Increase | SEQ ID NO:498 | SEQ ID NO:1220 |
| Architecture | grain length | IL16 | 4331776 | protein | Increase | SEQ ID NO:499 | SEQ ID NO:1221 |
| Architecture | Grain size | BGLU18 | 4336391 | protein | Increase | SEQ ID NO:500 | SEQ ID NO:1222 |
| Architecture | Grain size | BU1 | 4340551 | protein | Increase | SEQ ID NO:501 | SEQ ID NO:1223 |
| Architecture | grain size | GIF1 | 4335790 | protein | Increase | SEQ ID NO:502 | SEQ ID NO:1224 |
| Architecture | grain size | GL2 | 4325622 | protein | Increase | SEQ ID NO:503 | SEQ ID NO:1225 |
| Architecture | grain size | GS5 | 4337873 | protein | Increase | SEQ ID NO:504 | SEQ ID NO:1226 |
| Architecture | grain size | LK3 | 9269602 | protein | Increase | SEQ ID NO:505 | SEQ ID NO:1227 |
| Architecture | grain size | RDD1 | 4330293 | protein | Increase | SEQ ID NO:506 | SEQ ID NO:1228 |
| Architecture | grain weight | GW2 | 4328856 | protein | increase/decrease | SEQ ID NO:507 | SEQ ID NO:1229 |
| Architecture | grain weight | GWS | 4338011 | protein | increase/decrease | SEQ ID NO:508 | SEQ ID NO:1230 |
| Architecture | grain weight | GW8 | 4346133 | protein | increase/decrease | SEQ ID NO:509 | SEQ ID NO:1231 |
| Architecture | Grain weight | SPL16 | 4346133 | protein | Increase | SEQ ID NO:510 | SEQ ID NO:1232 |
| Architecture | Grain weight | SPL17 | 9266075 | protein | Increase | SEQ ID NO:511 | SEQ ID NO:1233 |
| Architecture | Grain weight | SPL7 | 4336597 | protein | Increase | SEQ ID NO:512 | SEQ ID NO:1234 |
| Architecture | height | D18 | 4323864 | protein | Decrease | SEQ ID NO:513 | SEQ ID NO:1235 |
| Architecture | Height | ETR2 | 4335058 | protein | Increase/Decrease | SEQ ID NO:514 | SEQ ID NO:1236 |
| Architecture | Height | EXPA4 | 4339106 | protein | Increase/Decrease | SEQ ID NO:515 | SEQ ID NO:1237 |
| Architecture | height | GA20OX1 | 4334841 | protein | increase/decrease | SEQ ID NO:516 | SEQ ID NO:1238 |
| Architecture | height | GA2OX3 | 4325145 | protein | increase/decrease | SEQ ID NO:517 | SEQ ID NO:1239 |
| Architecture | height | GA2OX6 | 4336431 | protein | increase/decrease | SEQ ID NO:518 | SEQ ID NO:1240 |
| Architecture | height | HOX4 | 4347333 | protein | increase/decrease | SEQ ID NO:519 | SEQ ID NO:1241 |
| Architecture | height | IAA13 | 4334069 | protein | increase/decrease | SEQ ID NO:520 | SEQ ID NO:1242 |
| Architecture | height & branching | NAC2 | 4336052 | protein | Increase/decrease | SEQ ID NO:521 | SEQ ID NO:1243 |
| Architecture | height & leaf angle | D2 | 4327329 | protein | Increase/decrease | SEQ ID NO:522 | SEQ ID NO:1244 |
| Architecture | height & leaf angle | D61 | 4324691 | protein | Increase/decrease | SEQ ID NO:523 | SEQ ID NO:1245 |
| Architecture | Hight and seed | CCA1 | 4344703 | protein | increase/decrease | SEQ ID NO:524 | SEQ ID NO:1246 |
| Architecture | improved cuticle, pathogen res | PDR6 | 4323865 | protein | Increase | SEQ ID NO:525 | SEQ ID NO:1247 |
| Architecture | Internode length | ACO4 | 4349970 | protein | Increase/Decrease | SEQ ID NO:526 | SEQ ID NO:1248 |
| Architecture | iron acquisition | Rab6a | 4331906 | protein | Increase | SEQ ID NO:527 | SEQ ID NO:1249 |
| Architecture | lateral root development | ZFP179 | 9272517 | protein | increase/decrease | SEQ ID NO:528 | SEQ ID NO:1250 |
| Architecture | leaf angle | ILA1 | 4342105 | protein | increase/decrease | SEQ ID NO:529 | SEQ ID NO:1251 |
| Architecture | leaf angle | OsSERK1 | 4344785 | protein | Decrease | SEQ ID NO:530 | SEQ ID NO:1252 |
| Architecture | leaf angle & seed size | D11 | 4336116 | protein | Increase | SEQ ID NO:531 | SEQ ID NO:1253 |
| Architecture | leaf size | FTL1 | 4324585 | protein | increase/decrease | SEQ ID NO:532 | SEQ ID NO:1254 |
| Architecture | leaf width | NAL2 | 107276476 | protein | increase/decrease | SEQ ID NO:533 | SEQ ID NO:1255 |
| Architecture | leaf width | NAL3 | 107275468 | protein | increase/decrease | SEQ ID NO:534 | SEQ ID NO:1256 |
| Architecture | lipid peroxidation in grains | R9-LOX1 | 4333818 | protein | Decrease | SEQ ID NO:535 | SEQ ID NO:1257 |
| Architecture | lodging | BC1 | 4333114 | protein | Increase | SEQ ID NO:536 | SEQ ID NO:1258 |
| Architecture | Lodging | FC1 | 4333856 | protein | Increase | SEQ ID NO:537 | SEQ ID NO:1259 |
| Architecture | male fertility | RTS | 4326940 | protein | decrease/KO | SEQ ID NO:538 | SEQ ID NO:1260 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Architecture | melatonin synthesis, stress resistance, yield | SNAT1 | 4339123 | protein | Increase | SEQ ID NO:539 | SEQ ID NO:1261 |
| Architecture | Meristem | AGO1A | 4330281 | protein | Increase/Decrease | SEQ ID NO:540 | SEQ ID NO:1262 |
| Architecture | Meristem | AGO1B | 9270411 | protein | Increase/Decrease | SEQ ID NO:541 | SEQ ID NO:1263 |
| Architecture | Meristem | AGO1C | 4331253 | protein | Increase/Decrease | SEQ ID NO:542 | SEQ ID NO:1264 |
| Architecture | Meristem | AGO3 | 4336992 | protein | Increase/Decrease | SEQ ID NO:543 | SEQ ID NO:1265 |
| Architecture | meristem/height | GRF10 | 4330314 | protein | increase/decrease | SEQ ID NO:544 | SEQ ID NO:1266 |
| Architecture | meristem/height | GRF3 | 4336879 | protein | increase/decrease | SEQ ID NO:545 | SEQ ID NO:1267 |
| Architecture | meristem/height | GRF5 | 4339928 | protein | increase/decrease | SEQ ID NO:546 | SEQ ID NO:1268 |
| Architecture | Midrib | DL | 4332058 | protein | Increase/decrease | SEQ ID NO:547 | SEQ ID NO:1269 |
| Architecture | Panicle architecture | DEP1 | 4347178 | protein | Increase/decrease | SEQ ID NO:548 | SEQ ID NO:1270 |
| Architecture | Panicle architecture | DEP3a | 4341835 | protein | Increase/decrease | SEQ ID NO:549 | SEQ ID NO:1271 |
| Architecture | Panicle architecture | DN1 | 4347178 | protein | Increase/decrease | SEQ ID NO:550 | SEQ ID NO:1272 |
| Architecture | Panicle architecture | EP2 | 4343904 | protein | Increase/decrease | SEQ ID NO:551 | SEQ ID NO:1273 |
| Architecture | Panicle architecture | EP3 | 4328935 | protein | Increase/decrease | SEQ ID NO:552 | SEQ ID NO:1274 |
| Architecture | Panicle architecture | MIR529a | M10003202 | miRNA | Decrease | | |
| Architecture | panicle architecture | RAE2 | 4345878 | protein | decrease/KO | SEQ ID NO:554 | SEQ ID NO:1276 |
| Architecture | photosynthetic aclimation to heat stress | RA | 4336636 | protein | Increase | SEQ ID NO:555 | SEQ ID NO:1277 |
| Architecture | Plant architecture | CUC1 | 4332714 | protein | increase/decrease | SEQ ID NO:556 | SEQ ID NO:1278 |
| Architecture | Plant architecture | CYP734A2 | 9268939 | protein | increase/decrease | SEQ ID NO:557 | SEQ ID NO:1279 |
| Architecture | Plant architecture | CYP734A4 | 4341450 | protein | increase/decrease | SEQ ID NO:558 | SEQ ID NO:1280 |
| Architecture | Plant architecture | CYP734A6 | 4325222 | protein | increase/decrease | SEQ ID NO:559 | SEQ ID NO:1281 |
| Architecture | plant architecture | RDD4 | 4331765 | protein | increase/decrease | SEQ ID NO:560 | SEQ ID NO:1282 |
| Architecture | plant height | APC6 | 107277295 | protein | Increase/Decrease | SEQ ID NO:561 | SEQ ID NO:1283 |
| Architecture | plant height | BLE3 | 4338204 | protein | Increase/Decrease | SEQ ID NO:562 | SEQ ID NO:1284 |
| Architecture | Plant height | CEL9D | 4332724 | protein | increase/decrease | SEQ ID NO:563 | SEQ ID NO:1285 |
| Architecture | plant stature | SD37 | 4331570 | protein | decrease/KO | SEQ ID NO:564 | SEQ ID NO:1286 |
| Architecture | plant stature, yield | SD1 | 4325003 | protein | decrease/KO | SEQ ID NO:565 | SEQ ID NO:1287 |
| Architecture | planting density | GATA12 | 4334668 | protein | Increase | SEQ ID NO:566 | SEQ ID NO:1288 |
| Architecture | Root and shoot architecture | PSK | 4341588 | protein | Increase/Decrease | SEQ ID NO:567 | SEQ ID NO:1289 |
| Architecture | Root and shoot architecture | PSK2 | 4349781 | protein | Increase/Decrease | SEQ ID NO:568 | SEQ ID NO:1290 |
| Architecture | Root and shoot architecture | PSK3 | 4351500 | protein | Increase/Decrease | SEQ ID NO:569 | SEQ ID NO:1291 |
| Architecture | Root angle & depth | DRO1 | 4347169 | protein | Increase/decrease | SEQ ID NO:570 | SEQ ID NO:1292 |
| Architecture | Root Architecture | CKX4 | 4326515 | protein | increase/decrease | SEQ ID NO:571 | SEQ ID NO:1293 |
| Architecture | Root Architecture | CRL1 | 9271993 | protein | Increase | SEQ ID NO:572 | SEQ ID NO:1294 |
| Architecture | Root Architecture | CRL4 | 4352167 | protein | Increase | SEQ ID NO:573 | SEQ ID NO:1295 |
| Architecture | root architecture | NAC5 | 4349963 | protein | Increase | SEQ ID NO:574 | SEQ ID NO:1296 |
| Architecture | Root hairs | ABIL2 | 4325847 | protein | Increase/Decrease | SEQ ID NO:575 | SEQ ID NO:1297 |
| Architecture | Root hairs | CSLD1 | 4349505 | protein | Increase | SEQ ID NO:576 | SEQ ID NO:1298 |
| Architecture | Root hairs | CSLD3 | 9271833 | protein | Increase | SEQ ID NO:577 | SEQ ID NO:1299 |
| Architecture | root hairs | EXPA10 | 4336776 | protein | Increase/Decrease | SEQ ID NO:578 | SEQ ID NO:1300 |
| Architecture | root hairs | EXPA17 | 107276467 | protein | Increase/Decrease | SEQ ID NO:579 | SEQ ID NO:1301 |
| Architecture | root hairs | EXPA7 | 4334606 | protein | Increase/Decrease | SEQ ID NO:580 | SEQ ID NO:1302 |
| Architecture | Root hairs | LSI1 | 4330713 | protein | Increase | SEQ ID NO:581 | SEQ ID NO:1303 |
| Architecture | Root hairs | PHR1 | 4332726 | protein | Increase/Decrease | SEQ ID NO:582 | SEQ ID NO:1304 |
| Architecture | Root hairs | PHR2 | 4343086 | protein | Increase/Decrease | SEQ ID NO:583 | SEQ ID NO:1305 |
| Architecture | Root hairs | PHR3 | 4328249 | protein | Increase/Decrease | SEQ ID NO:584 | SEQ ID NO:1306 |
| Architecture | root hairs | PT1 | 4331635 | protein | Increase | SEQ ID NO:585 | SEQ ID NO:1307 |
| Architecture | root stem cell | PLT1 | 4337245 | protein | Increase/Decrease | SEQ ID NO:586 | SEQ ID NO:1308 |
| Architecture | root stem cell | PLT2 | 4341722 | protein | Increase/Decrease | SEQ ID NO:587 | SEQ ID NO:1309 |
| Architecture | Root system architecture | ERF3 | 4327621 | protein | Increase | SEQ ID NO:588 | SEQ ID NO:1310 |
| Architecture | Root System Architecture | EXPA8 | 4327217 | protein | Increase | SEQ ID NO:589 | SEQ ID NO:1311 |
| Architecture | root system architecture | SIZ1 | 4337672 | protein | decrease/KO | SEQ ID NO:590 | SEQ ID NO:1312 |
| Architecture | sailinity stress tolerance | RAB16A | 4350454 | protein | Increase | SEQ ID NO:591 | SEQ ID NO:1313 |
| Architecture | SAM | NAM | 4340969 | protein | increase/decrease | SEQ ID NO:592 | SEQ ID NO:1314 |
| Architecture | SAM | OsCLE402 | 107276630 | protein | increase/decrease | SEQ ID NO:593 | SEQ ID NO:1315 |
| Architecture | SAM | OSH15 | 4342320 | protein | increase/decrease | SEQ ID NO:594 | SEQ ID NO:1316 |
| Architecture | SAM | PNH1 | 9269490 | protein | Increase | SEQ ID NO:595 | SEQ ID NO:1317 |
| Architecture | SAM/RAM maintenance | QHB | 4324824 | protein | Increase | SEQ ID NO:596 | SEQ ID NO:1318 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Architecture | senescence and yield | LOG1 | 4324445 | protein | Decrease | SEQ ID NO:597 | SEQ ID NO:1319 |
| Architecture | shattering | SH4 | 9266435 | protein | decrease/KO | SEQ ID NO:598 | SEQ ID NO:1320 |
| Architecture | shattering | SH5 | 4338977 | protein | decrease/KO | SEQ ID NO:599 | SEQ ID NO:1321 |
| Architecture | shattering | SHAT1 | 9269072 | protein | decrease/KO | SEQ ID NO:600 | SEQ ID NO:1322 |
| Architecture | Shattering & abcission | SH-H | 4342696 | protein | Increase | SEQ ID NO:601 | SEQ ID NO:1323 |
| Architecture | shoot regeneration | SERK1 | 4327640 | protein | Increase | SEQ ID NO:602 | SEQ ID NO:1324 |
| Architecture | shoot/root ratio | PIN | 4330700 | protein | Increase/Decrease | SEQ ID NO:603 | SEQ ID NO:1325 |
| Architecture | shoot/root ratio | PIN2 | 4341736 | protein | increase/decrease | SEQ ID NO:604 | SEQ ID NO:1326 |
| Architecture | sporophytic plant development | SDG701 | 4344819 | protein | Increase | SEQ ID NO:605 | SEQ ID NO:1327 |
| Architecture | starch biosynthesis | RSR1 | 4337654 | protein | decrease/KO | SEQ ID NO:606 | SEQ ID NO:1328 |
| Architecture | tiller angle and architecture | LPA1 | 4331161 | protein | increase/decrease | SEQ ID NO:607 | SEQ ID NO:1329 |
| Architecture | tiller angle, architecture, senescence | NAC106 | 9266817 | protein | Increase | SEQ ID NO:608 | SEQ ID NO:1330 |
| Architecture | Tillering | MADS57 | 4330621 | protein | increase/decrease | SEQ ID NO:609 | SEQ ID NO:1331 |
| Architecture | Tillering & size | D14 | 4331983 | protein | Increase/decrease | SEQ ID NO:610 | SEQ ID NO:1332 |
| Architecture | Tillering & size | D17 | 4336591 | protein | Increase/decrease | SEQ ID NO:611 | SEQ ID NO:1333 |
| Architecture | Tillering & size | D27 | 107276001 | protein | Increase/decrease | SEQ ID NO:612 | SEQ ID NO:1334 |
| Architecture | Tillers | AGR1 | 4341736 | protein | Increase/Decrease | SEQ ID NO:613 | SEQ ID NO:1335 |
| Architecture | Upper internode elongation | EUI1 | 4339131 | protein | Increase/Decrease | SEQ ID NO:614 | SEQ ID NO:1336 |
| Architecture | vesicular trafficking | ric2 | 4341266 | protein | Increase | SEQ ID NO:615 | SEQ ID NO:1337 |
| Architecture | Yield | GHD7 | 107276161 | protein | increase/decrease | SEQ ID NO:616 | SEQ ID NO:1338 |
| Architecture | yield | GS2 | 4337272 | protein | Increase | SEQ ID NO:617 | SEQ ID NO:1339 |
| Architecture | yield | IPT2 | 4332870 | protein | Increase | SEQ ID NO:618 | SEQ ID NO:1340 |
| Architecture | yield | IPT3 | 107277295 | protein | Increase | SEQ ID NO:619 | SEQ ID NO:1341 |
| Architecture | yield | IPT6 | 107275425 | protein | Increase | SEQ ID NO:620 | SEQ ID NO:1342 |
| Architecture | yield | IPT8 | 107278247 | protein | Increase | SEQ ID NO:621 | SEQ ID NO:1343 |
| Architecture | Yield | SGL | 4328218 | protein | Increase | SEQ ID NO:622 | SEQ ID NO:1344 |
| Architecture | yield/architecture | MIR398A | MI0001051 | miRNA | Increase | | SEQ ID NO:1346 |
| Architecture | yield/architecture | SPL14 | 4345998 | protein | increase/decrease | SEQ ID NO:625 | SEQ ID NO:1347 |
| Architecture | Zn distribution | ZIP4 | 4344937 | protein | increase/decrease | SEQ ID NO:626 | SEQ ID NO:1348 |
| Architecture | Zn transporter | ZIP5 | 4339082 | protein | increase/decrease | SEQ ID NO:627 | SEQ ID NO:1349 |
| Biotic stress | bacterial resistance | SAP1 | 4347423 | protein | Increase | SEQ ID NO:628 | SEQ ID NO:1350 |
| Biotic stress | blast resistance | ONAC122 | 4349648 | protein | Increase | SEQ ID NO:629 | SEQ ID NO:1351 |
| Biotic stress | blast resistance | ONAC131 | 4351369 | protein | Increase | SEQ ID NO:630 | SEQ ID NO:1352 |
| Biotic stress | blast resistance | PI21 | 4335725 | protein | Increase/Decrease | SEQ ID NO:631 | SEQ ID NO:1353 |
| Biotic stress | blast resistance | PITA | 4351983 | protein | AA change | | SEQ ID NO:1354 |
| Biotic stress | blast resistance | PIZ | 4340778 | protein | AA change | SEQ ID NO:633 | SEQ ID NO:1355 |
| Biotic stress | blast resistance | VAMP714 | 4348130 | protein | Increase | SEQ ID NO:634 | SEQ ID NO:1356 |
| Biotic stress | blast resistance | WRKY76 | 4347069 | protein | Increase | SEQ ID NO:635 | SEQ ID NO:1357 |
| Biotic stress | blast resistance gene | PIKH | 4350993 | protein | Increase | SEQ ID NO:636 | SEQ ID NO:1358 |
| Biotic stress | blight resistance | XA21 | 9271075 | protein | Increase | SEQ ID NO:637 | SEQ ID NO:1359 |
| Biotic stress | blight resistance \| bacterial leaf streak resistance | XA5 | 4337575 | protein | Increase/Decrease | SEQ ID NO:638 | SEQ ID NO:1360 |
| Biotic stress | fungal nad bacterial resistance \| fungal resistance | WRKY45 | 4338413 | protein | Increase | SEQ ID NO:639 | SEQ ID NO:1361 |
| Biotic stress | fungal resistance | ALD1 | 4331930 | protein | Increase | SEQ ID NO:640 | SEQ ID NO:1362 |
| Biotic stress | fungal resistance | CEBiP | 4331523 | protein | Increase | SEQ ID NO:641 | SEQ ID NO:1363 |
| Biotic stress | fungal resistance | RLCK185 | 4338592 | protein | Increase | SEQ ID NO:642 | SEQ ID NO:1364 |
| Biotic stress | fungus and xanthomonas resistance | PBZ1 | 4352491 | protein | Increase | SEQ ID NO:643 | SEQ ID NO:1365 |
| Biotic stress | fungus resistance | WRKY4 | 4334178 | protein | Increase | SEQ ID NO:644 | SEQ ID NO:1366 |
| Biotic stress | herbivore resistance | WRKY70 | 4339092 | protein | Increase | SEQ ID NO:645 | SEQ ID NO:1367 |
| Biotic stress | herbivore resistance | LCB2A1 | 4326966 | protein | Increase | SEQ ID NO:646 | SEQ ID NO:1368 |
| Biotic stress | rice blast resistance | RAC1 | 4325879 | protein | Increase/AA change | SEQ ID NO:647 | SEQ ID NO:1369 |
| Biotic stress | virus resistance | DCL2A | 4333337 | protein | Decrease | SEQ ID NO:648 | SEQ ID NO:1370 |
| Biotic stress | virus resistance | DCL2B | 4346696 | protein | Decrease | SEQ ID NO:649 | SEQ ID NO:1371 |
| Biotic stress | virus resistance | RYMV2 | 4324361 | protein | AA change | SEQ ID NO:650 | SEQ ID NO:1372 |
| Biotic stress | Xanthomonas resistance | WRKY51 | 4335388 | protein | Increase | SEQ ID NO:651 | SEQ ID NO:1373 |
| Biotic stress | | ACDR1 | 4331696 | protein | Increase/Decrease | SEQ ID NO:652 | SEQ ID NO:1374 |
| Biotic stress | | ACS2 | 4336750 | protein | Increase | SEQ ID NO:653 | SEQ ID NO:1375 |
| Biotic stress | | AOS1 | 4334233 | protein | Increase | SEQ ID NO:654 | SEQ ID NO:1376 |
| Biotic stress | | BIHD1 | 4333726 | protein | Increase | | |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Biotic stress | | BWMKY1 | 4342017 | protein | Increase | SEQ ID NO:655 | SEQ ID NO:1377 |
| Biotic stress | | CIPK14 | 4351307 | protein | Increase | SEQ ID NO:656 | SEQ ID NO:1378 |
| Biotic stress | | edr1-rice ortholog | 4348694 | protein | Increase | SEQ ID NO:657 | SEQ ID NO:1379 |
| Biotic stress | | eIF4G | 4343565 | protein | AA change | SEQ ID NO:658 | SEQ ID NO:1380 |
| Biotic stress | | GAP1 | 4329192 | protein | Increase | SEQ ID NO:659 | SEQ ID NO:1381 |
| Biotic stress | | GF14e | 4329775 | protein | Decrease | SEQ ID NO:660 | SEQ ID NO:1382 |
| Biotic stress | | GH3 | 4327043 | protein | Increase | SEQ ID NO:661 | SEQ ID NO:1383 |
| Biotic stress | | GH3-2 | 4326893 | protein | Increase | SEQ ID NO:662 | SEQ ID NO:1384 |
| Biotic stress | | GH3-8 | 4343785 | protein | Increase | SEQ ID NO:663 | SEQ ID NO:1385 |
| Biotic stress | | GLP1 | 4345763 | protein | Increase | SEQ ID NO:664 | SEQ ID NO:1386 |
| Biotic stress | | Gns1 | 4338611 | protein | Increase | SEQ ID NO:665 | SEQ ID NO:1387 |
| Biotic stress | | LOX1 | 4333823 | protein | Increase | SEQ ID NO:666 | SEQ ID NO:1388 |
| Biotic stress | | LTP1 | 4331301 | protein | Increase | SEQ ID NO:667 | SEQ ID NO:1389 |
| Biotic stress | | OS BIDK1 | 4337126 | protein | Increase | SEQ ID NO:668 | SEQ ID NO:1390 |
| Biotic stress | | Os BIMK2 | 4328223 | protein | Increase | SEQ ID NO:669 | SEQ ID NO:1391 |
| Biotic stress | | Os BIRH1 | 4342669 | protein | Increase | SEQ ID NO:670 | SEQ ID NO:1392 |
| Biotic stress | | Os BISCPL1 | 4346323 | protein | Increase | SEQ ID NO:671 | SEQ ID NO:1393 |
| Biotic stress | | OS BWMK1 | 4342017 | protein | Increase | SEQ ID NO:672 | SEQ ID NO:1394 |
| Biotic stress | | Os CBT | 4343265 | protein | Decrease | SEQ ID NO:673 | SEQ ID NO:1395 |
| Biotic stress | | Os CCR1 | 4331101 | protein | Increase | SEQ ID NO:674 | SEQ ID NO:1396 |
| Biotic stress | | Os Chib1 | 4348633 | protein | Increase | SEQ ID NO:675 | SEQ ID NO:1397 |
| Biotic stress | | Os EREBP1 | 4347142 | protein | Increase | SEQ ID NO:676 | SEQ ID NO:1398 |
| Biotic stress | | Os LOL2 | 4352767 | protein | Increase | SEQ ID NO:677 | SEQ ID NO:1399 |
| Biotic stress | | Os MAPK6 | 4340170 | protein | Increase | SEQ ID NO:678 | SEQ ID NO:1400 |
| Biotic stress | | Os MAPKY5 | 4332475 | protein | Increase | SEQ ID NO:679 | SEQ ID NO:1401 |
| Biotic stress | | Os MKK4 | 4330957 | protein | Increase | SEQ ID NO:680 | SEQ ID NO:1402 |
| Biotic stress | | Os mlo | 4331493 | protein | Decrease | SEQ ID NO:681 | SEQ ID NO:1403 |
| Biotic stress | | Os NAC6 | 4328715 | protein | Increase | SEQ ID NO:682 | SEQ ID NO:1404 |
| Biotic stress | | Os PLDbeta1 | 4349161 | protein | Decrease | SEQ ID NO:683 | SEQ ID NO:1405 |
| Biotic stress | | Os PR1a | 4342317 | protein | Increase | SEQ ID NO:684 | SEQ ID NO:1406 |
| Biotic stress | | Os RAC1 | 4325879 | protein | Increase | SEQ ID NO:685 | SEQ ID NO:1407 |
| Biotic stress | | Os Rad | 4329567 | protein | Increase | SEQ ID NO:686 | SEQ ID NO:1408 |
| Biotic stress | | Os SBP | 4324333 | protein | Increase | SEQ ID NO:687 | SEQ ID NO:1409 |
| Biotic stress | | Os SGT1 | 4326682 | protein | Increase | SEQ ID NO:688 | SEQ ID NO:1410 |
| Biotic stress | | Os TPC1 | 4325272 | protein | Increase | SEQ ID NO:689 | SEQ ID NO:1411 |
| Biotic stress | | Os WAK1 | 4325700 | protein | Increase | SEQ ID NO:690 | SEQ ID NO:1412 |
| Biotic stress | | Os WRKY 45-1 | 4338413 | protein | Decrease | SEQ ID NO:691 | SEQ ID NO:1413 |
| Biotic stress | | Os WRKY13 | 4325658 | protein | Increase | SEQ ID NO:692 | SEQ ID NO:1414 |
| Biotic stress | | Os WRKY28 | 4341678 | protein | Decrease | SEQ ID NO:693 | SEQ ID NO:1415 |
| Biotic stress | | Os WRKY45 | 4338413 | protein | Increase | SEQ ID NO:694 | SEQ ID NO:1416 |
| Biotic stress | | OsBBI1 | 4339966 | protein | Increase | SEQ ID NO:695 | SEQ ID NO:1417 |
| Biotic stress | | OsBIANK1 | 4347554 | protein | Increase | SEQ ID NO:696 | SEQ ID NO:1418 |
| Biotic stress | | OsChi11 | 4342114 | protein | Increase | SEQ ID NO:697 | SEQ ID NO:1419 |
| Biotic stress | | OsCIPK15 | 4349594 | protein | Increase | SEQ ID NO:698 | SEQ ID NO:1420 |
| Biotic stress | | OsCPK12 | 4336653 | protein | Decrease | SEQ ID NO:699 | SEQ ID NO:1421 |
| Biotic stress | | OsEDR1 | EDR1 | 4331696 | protein | Decrease | SEQ ID NO:700 | SEQ ID NO:1422 |
| Biotic stress | | OsERF3 | 4327621 | protein | Increase | SEQ ID NO:701 | SEQ ID NO:1423 |
| Biotic stress | | OsERF922 | 4327006 | protein | increase/decrease | SEQ ID NO:702 | SEQ ID NO:1424 |
| Biotic stress | | OsHIR1 | 4345499 | protein | Increase | SEQ ID NO:703 | SEQ ID NO:1425 |
| Biotic stress | | OsLRR1 | 4327564 | protein | Increase | SEQ ID NO:704 | SEQ ID NO:1426 |
| Biotic stress | | OsMPK3 | 4328297 | protein | Increase | SEQ ID NO:705 | SEQ ID NO:1427 |
| Biotic stress | | OsMPK5 | 4332475 | protein | Increase | SEQ ID NO:706 | SEQ ID NO:1428 |
| Biotic stress | | OsMPK6 | 4349225 | protein | Increase | SEQ ID NO:707 | SEQ ID NO:1429 |
| Biotic stress | | OsNH1 | 4327315 | protein | Decrease | SEQ ID NO:708 | SEQ ID NO:1430 |
| Biotic stress | | OsNPR1 | 4327315 | protein | Increase | SEQ ID NO:709 | SEQ ID NO:1431 |
| Biotic stress | | OsOxi1 | 4336231 | protein | Increase | SEQ ID NO:710 | SEQ ID NO:1432 |
| Biotic stress | | OsSGT | 4347593 | protein | Increase | SEQ ID NO:711 | SEQ ID NO:1433 |
| Biotic stress | | OsTGAP1 | 9270267 | protein | Increase | SEQ ID NO:712 | SEQ ID NO:1434 |
| Biotic stress | | OsWRKY62 | 4347070 | protein | Decrease | SEQ ID NO:713 | SEQ ID NO:1435 |
| Biotic stress | | OsWRKY71 | 4328512 | protein | Decrease | SEQ ID NO:714 | SEQ ID NO:1436 |
| Biotic stress | | OsWRKY76 | 4347069 | protein | Decrease | SEQ ID NO:715 | SEQ ID NO:1437 |
| Biotic stress | | PDR6 | 4323865 | protein | Decrease | SEQ ID NO:716 | SEQ ID NO:1438 |
| Biotic stress | | Pi-d2 | 4341092 | protein | Increase | SEQ ID NO:717 | SEQ ID NO:1439 |
| Biotic stress | | Pi37 | 9268622 | protein | Increase | SEQ ID NO:718 | SEQ ID NO:1440 |
| Biotic stress | | Pi54 | 9272143 | protein | Increase | SEQ ID NO:719 | SEQ ID NO:1441 |
| Biotic stress | | PiK | 107278320 | protein | Increase | SEQ ID NO:720 | SEQ ID NO:1442 |
| Biotic stress | | Pita | 4351983 | protein | Increase | SEQ ID NO:721 | SEQ ID NO:1443 |
| Biotic stress | | RAC5 | 4331272 | protein | Decrease | SEQ ID NO:722 | SEQ ID NO:1444 |
| Biotic stress | | RACK1A | 4324115 | protein | Increase | SEQ ID NO:723 | SEQ ID NO:1445 |
| Biotic stress | | RACK1B | 4339539 | protein | Increase | SEQ ID NO:724 | SEQ ID NO:1446 |
| Biotic stress | | RCH10 | 4333121 | protein | Increase | SEQ ID NO:725 | SEQ ID NO:1447 |
| Biotic stress | | RF2B | 4332761 | protein | Increase | SEQ ID NO:726 | SEQ ID NO:1448 |
| Biotic stress | | RIM1 | 9270943 | protein | Decrease | SEQ ID NO:727 | SEQ ID NO:1449 |
| Biotic stress | | RYMV1 | 4336300 | protein | AA change | SEQ ID NO:728 | SEQ ID NO:1450 |
| Biotic stress | | TPS1 | 9266089 | protein | Increase | SEQ ID NO:729 | SEQ ID NO:1451 |
| Biotic stress | | WRKY6 | 4334437 | protein | Increase | SEQ ID NO:730 | SEQ ID NO:1452 |
| Biotic stress | | WRKY71 | 4328512 | protein | Increase | SEQ ID NO:731 | SEQ ID NO:1453 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Biotic stress | | Xa13 | 4346153 | protein | AA change | SEQ ID NO:732 | SEQ ID NO:1454 |
| Biotic stress | | XB24 | 4324614 | protein | Decrease | SEQ ID NO:733 | SEQ ID NO:1455 |
| Biotic stress | | XB3 | 4337598 | protein | Increase | SEQ ID NO:734 | SEQ ID NO:1456 |
| Flowering Time | Flowering Time | CHI | 4334588 | protein | Increase/Decrease | SEQ ID NO:735 | SEQ ID NO:1457 |
| Flowering Time | Flowering time | DTH2 | 4330574 | protein | increase/decrease | SEQ ID NO:736 | SEQ ID NO:1458 |
| Flowering Time | Flowering time | Ehd2 | 4348644 | protein | increase/decrease | SEQ ID NO:737 | SEQ ID NO:1459 |
| Flowering Time | Flowering time | Ehd3 | 4344443 | protein | increase/decrease | SEQ ID NO:738 | SEQ ID NO:1460 |
| Flowering Time | Flowering time | Ehd4 | 4331372 | protein | increase/decrease | SEQ ID NO:739 | SEQ ID NO:1461 |
| Flowering Time | Flowering time | ETR2 | 4335058 | protein | increase/decrease | SEQ ID NO:740 | SEQ ID NO:1462 |
| Flowering Time | Flowering time | Hd1 | 4340746 | protein | increase/decrease | SEQ ID NO:741 | SEQ ID NO:1463 |
| Flowering Time | Flowering time | Hd14 | 107276289 | protein | increase/decrease | SEQ ID NO:742 | SEQ ID NO:1464 |
| Flowering Time | Flowering time | Hd16 | 4334396 | protein | increase/decrease | SEQ ID NO:743 | SEQ ID NO:1465 |
| Flowering Time | Flowering time | Hd17 | 4340087 | protein | increase/decrease | SEQ ID NO:744 | SEQ ID NO:1466 |
| Flowering Time | Flowering time | Hd2 | 4344399 | protein | increase/decrease | SEQ ID NO:745 | SEQ ID NO:1467 |
| Flowering Time | Flowering time | Hd4 | 107276161 | protein | increase/decrease | SEQ ID NO:746 | SEQ ID NO:1468 |
| Flowering Time | Flowering time | Hd5 | 4344784 | protein | increase/decrease | SEQ ID NO:747 | SEQ ID NO:1469 |
| Flowering Time | Flowering time | Hd6 | 4334197 | protein | increase/decrease | SEQ ID NO:748 | SEQ ID NO:1470 |
| Flowering Time | Flowering time | OsCO3 | 4346474 | protein | increase/decrease | SEQ ID NO:749 | SEQ ID NO:1471 |
| Flowering Time | Flowering time | OsCOL4 | 4329950 | protein | increase/decrease | SEQ ID NO:750 | SEQ ID NO:1472 |
| Flowering Time | Flowering time | OsDof12 | 4331765 | protein | increase/decrease | SEQ ID NO:751 | SEQ ID NO:1473 |
| Flowering Time | Flowering time | OsGI | 4325329 | protein | increase/decrease | SEQ ID NO:752 | SEQ ID NO:1474 |
| Flowering Time | Flowering time | OsLF | 9269440 | protein | increase/decrease | SEQ ID NO:753 | SEQ ID NO:1475 |
| Flowering Time | Flowering time | OsLFL1 | 4325939 | protein | increase/decrease | SEQ ID NO:754 | SEQ ID NO:1476 |
| Flowering Time | Flowering time | OsMADS50 | 4331445 | protein | increase/decrease | SEQ ID NO:755 | SEQ ID NO:1477 |
| Flowering Time | Flowering time | OsMADS56 | 4349237 | protein | increase/decrease | SEQ ID NO:756 | SEQ ID NO:1478 |
| Flowering Time | Flowering time | OsphyB | 4332623 | protein | increase/decrease | SEQ ID NO:757 | SEQ ID NO:1479 |
| Flowering Time | Flowering time | RCN1 | 4349798 | protein | increase/decrease | SEQ ID NO:758 | SEQ ID NO:1480 |
| Flowering Time | Flowering time | RFT1 | 4340184 | protein | increase/decrease | SEQ ID NO:759 | SEQ ID NO:1481 |
| Flowering Time | Flowering time | SE5 | 4341462 | protein | increase/decrease | SEQ ID NO:760 | SEQ ID NO:1482 |
| Flowering Time | Flowering time | Spin1 | 4334557 | protein | increase/decrease | SEQ ID NO:761 | SEQ ID NO:1483 |
| Flowering Time | Flowering time | SPL11 | 4352575 | protein | increase/decrease | SEQ ID NO:762 | SEQ ID NO:1484 |
| Nutrient use efficiency | Abiotic Stress | LHY | 4344703 | protein | Increase | SEQ ID NO:763 | SEQ ID NO:1485 |
| Nutrient use efficiency | Abiotic Stress | TPS10 | 4346981 | protein | Increase | SEQ ID NO:764 | SEQ ID NO:1486 |
| Nutrient use efficiency | allelopathy and rhizosphere | PAL | 4330040 | protein | increaes | SEQ ID NO:765 | SEQ ID NO:1487 |
| Nutrient use efficiency | Biotic Stress \| Cold and salt stress \| broad-spectrum disease resistance \| disease | PAL1 | 4330034 | protein | Increase | SEQ ID NO:766 | SEQ ID NO:1488 |
| Nutrient use efficiency | eating quality in rice | OsAGPS1 | 4346656 | protein | allele | SEQ ID NO:767 | SEQ ID NO:1489 |
| Nutrient use efficiency | Fe, Zn and aa enrichment in seeds | OsNAC5 | 4349963 | protein | increase | SEQ ID NO:768 | SEQ ID NO:1490 |
| Nutrient use efficiency | High Iron Stress | NRAMP1 | 4342862 | protein | Increase | SEQ ID NO:769 | SEQ ID NO:1491 |
| Nutrient use efficiency | High Iron Stress | NRAMP3 | 9267339 | protein | Increase | SEQ ID NO:770 | SEQ ID NO:1492 |
| Nutrient use efficiency | increase mineral contents in rice grains | NAS3 | 4344361 | protein | increase | SEQ ID NO:771 | SEQ ID NO:1493 |
| Nutrient use efficiency | iron | ATM3 | 4339984 | protein | increase | SEQ ID NO:772 | SEQ ID NO:1494 |
| Nutrient use efficiency | iron | OsMTP1 | 4337694 | protein | increase | SEQ ID NO:773 | SEQ ID NO:1495 |
| Nutrient use efficiency | iron | OsRMC | 4337274 | protein | increase | SEQ ID NO:774 | SEQ ID NO:1496 |
| Nutrient use efficiency | iron | OsYSL1 | 4326360 | protein | increase | SEQ ID NO:775 | SEQ ID NO:1497 |
| Nutrient use efficiency | iron | OsYSL2 | 4330161 | protein | increase | SEQ ID NO:776 | SEQ ID NO:1498 |
| Nutrient use efficiency | iron- and zinc-biofortification | OsNAS2 | 4332607 | protein | increase | SEQ ID NO:777 | SEQ ID NO:1499 |
| Nutrient use efficiency | iron deficiency | IDEF1 | 4344415 | protein | increase | SEQ ID NO:778 | SEQ ID NO:1500 |
| Nutrient use efficiency | Iron deficiency | IDEF2 | 4338852 | protein | increase | SEQ ID NO:779 | SEQ ID NO:1501 |
| Nutrient use efficiency | iron deficiency | NRAMP4 | 4324486 | protein | increase | SEQ ID NO:780 | SEQ ID NO:1502 |
| Nutrient use efficiency | iron deficiency | OsIRO2 | 4325750 | protein | increase | SEQ ID NO:781 | SEQ ID NO:1503 |
| Nutrient use efficiency | iron deficiency | OsIRO3 | 4332972 | protein | Decrease | SEQ ID NO:782 | SEQ ID NO:1504 |

TABLE 6-continued

| Trait | Trait subcategory | Gene(s) | GeneID | GeneProduct | Expression Change | Gene SEQ ID | Protein SEQ ID |
| --- | --- | --- | --- | --- | --- | --- | --- |
| Nutrient use efficiency | iron deficiency | OsYSL15 | 9268232 | protein | increase | SEQ ID NO:783 | SEQ ID NO:1505 |
| Nutrient use efficiency | Iron transport | DMAS1 | 4332187 | protein | increase | SEQ ID NO:784 | SEQ ID NO:1506 |
| Nutrient use efficiency | low iron/alkaline soil | NAAT1 | 9267778 | protein | Increase | SEQ ID NO:785 | SEQ ID NO:1507 |
| Nutrient use efficiency | low phytic acid | MIPS | 4331917 | protein | decrease (seed specific) | SEQ ID NO:786 | SEQ ID NO:1508 |
| Nutrient use efficiency | low phytic acid | OsLpa1 | 4331161 | protein | AA change | SEQ ID NO:787 | SEQ ID NO:1509 |
| Nutrient use efficiency | low phytic acid | OsMRP5 | 4331585 | protein | AA change | SEQ ID NO:788 | SEQ ID NO:1510 |
| Nutrient use efficiency | low phytic acid | OsSULTR3;3 | 4337235 | protein | Decrease | SEQ ID NO:789 | SEQ ID NO:1511 |
| Nutrient use efficiency | low phytic acid | RINO1 | 4331917 | protein | decrease (seed specific) | SEQ ID NO:790 | SEQ ID NO:1512 |
| Nutrient use efficiency | NUE | ABC1 | 4344164 | protein | increase | SEQ ID NO:791 | SEQ ID NO:1513 |
| Nutrient use efficiency | NUE | AlaAT | 4348524 | protein | increase | SEQ ID NO:792 | SEQ ID NO:1514 |
| Nutrient use efficiency | NUE | AMT1;1 | 4336365 | protein | increase | SEQ ID NO:793 | SEQ ID NO:1515 |
| Nutrient use efficiency | NUE | AMT1;2 | 4330008 | protein | increase | SEQ ID NO:794 | SEQ ID NO:1516 |
| Nutrient use efficiency | NUE | AMT1;3 | 4330007 | protein | increase | SEQ ID NO:795 | SEQ ID NO:1517 |
| Nutrient use efficiency | NUE | GRX6 | 4326324 | protein | increase | SEQ ID NO:796 | SEQ ID NO:1518 |
| Nutrient use efficiency | NUE | GS1;2 | 4332108 | protein | increase | SEQ ID NO:797 | SEQ ID NO:1519 |
| Nutrient use efficiency | NUE | GS2 | 4337272 | protein | Increase | SEQ ID NO:798 | SEQ ID NO:1520 |
| Nutrient use efficiency | NUE | NADH-GOGAT | 4324398 | protein | increase | SEQ ID NO:799 | SEQ ID NO:1521 |
| Nutrient use efficiency | NUE | OsAMT3;1 | 4324937 | protein | increase | SEQ ID NO:800 | SEQ ID NO:1522 |
| Nutrient use efficiency | NUE | OsARG | 4334912 | protein | Increase | SEQ ID NO:801 | SEQ ID NO:1523 |
| Nutrient use efficiency | NUE | OsENOD93-1 (LOC_Os06g05010) | 9271477 | protein | increase | SEQ ID NO:802 | SEQ ID NO:1524 |
| Nutrient use efficiency | NUE | OsGOGAT2 | 4339561 | protein | increase | SEQ ID NO:803 | SEQ ID NO:1525 |
| Nutrient use efficiency | NUE | OsGS1;1 | 4330649 | protein | increase | SEQ ID NO:804 | SEQ ID NO:1526 |
| Nutrient use efficiency | NUE | OsNRT1.1b | 4332183 | protein | increase | SEQ ID NO:805 | SEQ ID NO:1527 |
| Nutrient use efficiency | NUE | OsNRT2.1 | 4328051 | protein | Increase | SEQ ID NO:806 | SEQ ID NO:1528 |
| Nutrient use efficiency | NUE | OsNRT2.3b | 4324249 | protein | increase | SEQ ID NO:807 | SEQ ID NO:1529 |
| Nutrient use efficiency | NUE | OsPTR6 | 4336854 | protein | increase | SEQ ID NO:808 | SEQ ID NO:1530 |
| Nutrient use efficiency | NUE | OsPTR9 | 9268091 | protein | Increase | SEQ ID NO:809 | SEQ ID NO:1531 |
| Nutrient use efficiency | NUE under water deficit | IPT | 107275347 | protein | increase | SEQ ID NO:810 | SEQ ID NO:1532 |
| Nutrient use efficiency | NUE/PUE | OsSPX1 | 4341465 | protein | increase | SEQ ID NO:811 | SEQ ID NO:1533 |
| Nutrient use efficiency | Photosynthesis | RBCS | 4351966 | protein | decrease | SEQ ID NO:812 | SEQ ID NO:1534 |
| Nutrient use efficiency | PUE | NLA1 | 4344254 | protein | Decrease | SEQ ID NO:813 | SEQ ID NO:1535 |
| Nutrient use efficiency | PUE | OsLPT1 | 4346342 | protein | increase | SEQ ID NO:814 | SEQ ID NO:1536 |
| Nutrient use efficiency | PUE | OsMYB2P-1 | 4337756 | protein | Increase | SEQ ID NO:815 | SEQ ID NO:1537 |
| Nutrient use efficiency | PUE | OsPT1 | 4331635 | protein | Increase | SEQ ID NO:816 | SEQ ID NO:1538 |
| Nutrient use efficiency | PUE | OsWRKY74 | 4346768 | protein | Increase | SEQ ID NO:817 | SEQ ID NO:1539 |
| Nutrient use efficiency | PUE | PHF1 | 4342601 | protein | increase | SEQ ID NO:818 | SEQ ID NO:1540 |
| Nutrient use efficiency | PUE | PHR1 | 4332726 | protein | increaes | SEQ ID NO:819 | SEQ ID NO:1541 |
| Nutrient use efficiency | Salt Stress | CASTOR | 4334751 | protein | Increase | SEQ ID NO:820 | SEQ ID NO:1542 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Nutrient use efficiency | Salt tolerance change | INO1 | 4331917 | protein | Increase/AA | SEQ ID NO:821 | SEQ ID NO:1543 |
| Nutrient use efficiency | zinc | OsARD2 | 4331707 | protein | increase | SEQ ID NO:822 | SEQ ID NO:1544 |
| Nutrient use efficiency | zinc | OslRT1 | 4333669 | protein | increase | SEQ ID NO:823 | SEQ ID NO:1545 |
| Nutrient use efficiency | zinc | OsNAS1 | 4332608 | protein | increase | SEQ ID NO:824 | SEQ ID NO:1546 |
| Photosynthesis | | GA2ox6 | 4336431 | protein | Increase | SEQ ID NO:825 | SEQ ID NO:1547 |
| Photosynthesis | | NAL2 | 107276476 | protein | Increase | SEQ ID NO:826 | SEQ ID NO:1548 |
| Photosynthesis | | Os02g0465900 | 4329321 | protein | Increase | SEQ ID NO:827 | SEQ ID NO:1549 |
| Photosynthesis | | OsBRI1 | 4324691 | protein | Decrease | SEQ ID NO:828 | SEQ ID NO:1550 |
| Photosynthesis | | OsBZR1 | 4343719 | protein | Increase | SEQ ID NO:829 | SEQ ID NO:1551 |
| Photosynthesis | | OsCBSX4 | 4334035 | protein | Increase | SEQ ID NO:830 | SEQ ID NO:1552 |
| Photosynthesis | | OsDET1 | 4326296 | protein | AA change | SEQ ID NO:831 | SEQ ID NO:1553 |
| Photosynthesis | | OsERF71 | 4340383 | protein | Increase | SEQ ID NO:832 | SEQ ID NO:1554 |
| Photosynthesis | | OsHAP2E | 4333094 | protein | Increase | SEQ ID NO:833 | SEQ ID NO:1555 |
| Photosynthesis | | OsHAP3H | 4344784 | protein | AA change | SEQ ID NO:834 | SEQ ID NO:1556 |
| Photosynthesis | | OsHox32 | 4333544 | protein | Increase | SEQ ID NO:835 | SEQ ID NO:1557 |
| Photosynthesis | | OsMGD | 4331045 | protein | Increase | SEQ ID NO:836 | SEQ ID NO:1558 |
| Photosynthesis | | OsNAL1 | 4336986 | protein | Increase | SEQ ID NO:837 | SEQ ID NO:1559 |
| Photosynthesis | | OsSNAC1 | 4334553 | protein | Increase | SEQ ID NO:838 | SEQ ID NO:1560 |
| Photosynthesis | | OsSUV3 | 4334089 | protein | Increase | SEQ ID NO:839 | SEQ ID NO:1561 |
| Photosynthesis | | OsTLP27 | 4326466 | protein | Increase | SEQ ID NO:840 | SEQ ID NO:1562 |
| Photosynthesis | | SsNHX1 | 4344217 | protein | Increase | SEQ ID NO:841 | SEQ ID NO:1563 |
| Photosynthesis | | SUV3 | 4334089 | protein | Increase | SEQ ID NO:842 | SEQ ID NO:1564 |
| Photosynthesis | | TIFY11b | 4331834 | protein | Increase | SEQ ID NO:843 | SEQ ID NO:1565 |
| Senescence | Brassinosteroid (BR) regulation | MADS22 | 4330805 | protein | Decrease | SEQ ID NO:844 | SEQ ID NO:1566 |
| Senescence | drought | salt | SNAC1 | 4334553 | protein | Increase | SEQ ID NO:845 | SEQ ID NO:1567 |
| Senescence | Fe-deficiency | Induced programmed cell death | Leaf development | Male sterility | Micronutrient mobilization-iron and Zinc | Oxidative stress | Programmed cell death | Developmental regulation | Cytokinin oxidase/dehydrogenase | RT | 4336284 | protein | Increase/Decrease | SEQ ID NO:846 | SEQ ID NO:1568 |
| Senescence | Flowering regulation | SE1 | 4340746 | protein | Increase/Decrease | SEQ ID NO:847 | SEQ ID NO:1569 |
| Senescence | GA - regulation | Male sterility | GAMYB | 4327362 | protein | Increase | SEQ ID NO:848 | SEQ ID NO:1570 |
| Senescence | Immune response | Programmed cell death | H5P90 | 4342077 | protein | Increase/Decrease | SEQ ID NO:849 | SEQ ID NO:1571 |
| Senescence | Leaf senescence | AOC | 4333201 | protein | Decrease | SEQ ID NO:850 | SEQ ID NO:1572 |
| Senescence | Leaf senescence | AOS1 | 4334233 | protein | Increase | SEQ ID NO:851 | SEQ ID NO:1573 |
| Senescence | Leaf senescence | AOS2 | 4332121 | protein | Decrease | SEQ ID NO:852 | SEQ ID NO:1574 |
| Senescence | Lesion mimick | ACDR1 | 4331696 | protein | Decrease | SEQ ID NO:853 | SEQ ID NO:1575 |
| Senescence | Photorespiration | Stress response | WRKY45 | 4338413 | protein | Increase | SEQ ID NO:854 | SEQ ID NO:1576 |
| Senescence | Photosynthesis | SPS1 | 4324364 | protein | Increase | SEQ ID NO:855 | SEQ ID NO:1577 |
| Senescence | Premature senescence | Salt stress | Stay green | Stress response/early leaf senescence | NYC1 | 4327178 | protein | Increase/Decrease | SEQ ID NO:856 | SEQ ID NO:1578 |
| Senescence | seed germination | D35 | 4341347 | protein | Decrease | SEQ ID NO:857 | SEQ ID NO:1579 |
| Senescence | Aging/protein repair | PIMT1 | 4346293 | protein | Increase | SEQ ID NO:858 | SEQ ID NO:1580 |
| Senescence | Aging/protein repair | PIMT2 | 4336186 | protein | Increase | SEQ ID NO:859 | SEQ ID NO:1581 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Senescence | Anther development \| Disease resistance \| Disease resistance/Anthracnose \| Immune response \| leaf senescence \| Male sterility \| Micronutrient mobilization-iron and Zinc \| Programmed cell death \| Salt stress \| Stay green \| Transcription factor \| Leaf senescence \| Pollen development \| Developmental/ senescence \| Endosperm development \| Stress response \| Drought | WRKY16 | 4326856 | protein | Increase/Decrease | SEQ ID NO:860 | SEQ ID NO:1582 |
| Senescence | auxin synthesis and transport \| Submergence tolerance | SAUR39 | 9271092 | protein | Decrease | SEQ ID NO:861 | SEQ ID NO:1583 |
| Senescence | Branching/Tillering \| Cytokinin oxidase/dehydrogenase | CKX3 | 4348932 | protein | Decrease | SEQ ID NO:862 | SEQ ID NO:1584 |
| Senescence | Branching/Tillering \| Cytokinin oxidase/dehydrogenase | GN1A | 4327333 | protein | Decrease | SEQ ID NO:863 | SEQ ID NO:1585 |
| Senescence | Brassinosteroid (BR) regulation | MADS47 | 4331872 | protein | Decrease | SEQ ID NO:864 | SEQ ID NO:1586 |
| Senescence | Brassinosteroid (BR) regulation | MADS55 | 4340495 | protein | Decrease | SEQ ID NO:865 | SEQ ID NO:1587 |
| Senescence | Cellulase activity \| Drought/ Striga/Stay green \| Grain yield related traits (multiple QTLs) \| leaf senescence \| Nodal root angle \| photosynthesis-stay green \| Salt stress \| Stay green \| stay green \| Chlorophyll | SGR | 4347672 | protein | Increase/Decrease | SEQ ID NO:866 | SEQ ID NO:1588 |
| Senescence | Chloroplast biogenesis | CGA1 | 4328751 | protein | Increase | SEQ ID NO:867 | SEQ ID NO:1589 |
| Senescence | Disease resistance | Rbs1 | 4351966 | protein | Increase | SEQ ID NO:868 | SEQ ID NO:1590 |
| Senescence | Disease resistance | SPL5 | 4342674 | protein | Increase/Decrease | SEQ ID NO:869 | SEQ ID NO:1591 |
| Senescence | Disease resistance | TYDC | 4325604 | protein | Increase/Decrease | SEQ ID NO:870 | SEQ ID NO:1592 |
| Senescence | Disease resistance \| Flowering regulation | SPIN1 | 4334557 | protein | Increase/Decrease | SEQ ID NO:871 | SEQ ID NO:1593 |
| Senescence | Disease resistance \| Flowering regulation \| Plant-microbe interaction \| Programmed cell death | SPL11 | 4352575 | protein | Increase/Decrease | SEQ ID NO:872 | SEQ ID NO:1594 |
| Senescence | Disease resistance \| Transcription factor biosynthesis | WRKY14 | 4324426 | protein | Increase | SEQ ID NO:873 | SEQ ID NO:1595 |
| Senescence | Drought | AP2/EREBP77 | 107277455 | protein | Increase | SEQ ID NO:874 | SEQ ID NO:1596 |
| Senescence | Drought \| Leaf senescence \| Transposon activity | TET13 | 4347111 | protein | Increase | SEQ ID NO:875 | SEQ ID NO:1597 |
| Senescence | Drought \| Stay green | VP1 | 4324314 | protein | Increase/Decrease | SEQ ID NO:876 | SEQ ID NO:1598 |
| Senescence | dwarfism \| Drought \| seed germination | KO1 | 4341347 | protein | Decrease | SEQ ID NO:877 | SEQ ID NO:1599 |
| Senescence | Early leaf senescence | SPL32 | 4344164 | protein | Increase/Decrease | SEQ ID NO:878 | SEQ ID NO:1600 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Senescence | fertilization/flower opening/dehiecnse \| Flowering regulation | JAR1 | 4339756 | protein | Increase | SEQ ID NO:879 | SEQ ID NO:1601 |
| Senescence | Flag leaf senescence | TET5 | 107276347 | protein | Increase/Decrease | SEQ ID NO:880 | SEQ ID NO:1602 |
| Senescence | Flag leaf senescence | TET9 | 4341357 | protein | Increase/Decrease | SEQ ID NO:881 | SEQ ID NO:1603 |
| Senescence | Floral organ number \| Meristem size regulation | FON1 | 4342080 | protein | Increase/Decrease | SEQ ID NO:882 | SEQ ID NO:1604 |
| Senescence | flowering time/SAM \| Disease resistance \| Flowering regulation | HD3A | 4340185 | protein | Increase/Decrease | SEQ ID NO:883 | SEQ ID NO:1605 |
| Senescence | flowering time | PHYB | 4332623 | protein | Increase | SEQ ID NO:884 | SEQ ID NO:1606 |
| Senescence | GA - regulation | CYP703A3 | 4344594 | protein | Decrease | SEQ ID NO:885 | SEQ ID NO:1607 |
| Senescence | GA - regulation \| leaf senescence \| Pollen development | MYB | 4324302 | protein | Increase/Decrease | SEQ ID NO:886 | SEQ ID NO:1608 |
| Senescence | grain weight \| Grain yield related traits (multiple QTLs) | GW8 | 4346133 | protein | Increase/Decrease | SEQ ID NO:887 | SEQ ID NO:1609 |
| Senescence | Growth and development | CZOGT1 | 4336629 | protein | Increase | SEQ ID NO:888 | SEQ ID NO:1610 |
| Senescence | Growth and development | CZOGT2 | 4336630 | protein | Increase | SEQ ID NO:889 | SEQ ID NO:1611 |
| Senescence | Growth and development | CZOGT3 | 4336683 | protein | Increase | SEQ ID NO:890 | SEQ ID NO:1612 |
| Senescence | height & leaf angle | D1 \| D2 \| Os07g0558500 | 4343584 | protein | Increase/Decrease | SEQ ID NO:891 | SEQ ID NO:1613 |
| Senescence | Hight and seed immunity \| Disease resistance \| Plant-microbe interaction | CCA1 | 4344703 | protein | Increase/Decrease | SEQ ID NO:892 | SEQ ID NO:1614 |
| Senescence | | RAC1 | 4325879 | protein | AA change | SEQ ID NO:893 | SEQ ID NO:1615 |
| Senescence | leaf senescence | ABA8OX1 | 9269675 | protein | Increase | SEQ ID NO:894 | SEQ ID NO:1616 |
| Senescence | leaf senescence | ATG7 | 4326644 | protein | Decrease | SEQ ID NO:895 | SEQ ID NO:1617 |
| Senescence | Leaf senescence | D14 | 4331983 | protein | Increase | SEQ ID NO:896 | SEQ ID NO:1618 |
| Senescence | leaf senescence | NCED1 | 4333566 | protein | Increase/Decrease | SEQ ID NO:897 | SEQ ID NO:1619 |
| Senescence | leaf senescence | NCED3 | 4333566 | protein | Increase/Decrease | SEQ ID NO:898 | SEQ ID NO:1620 |
| Senescence | leaf senescence | OsABA2 | 4335984 | protein | Increase/Decrease | SEQ ID NO:899 | SEQ ID NO:1621 |
| Senescence | leaf senescence | ZEP1 | 4336010 | protein | Increase/Decrease | SEQ ID NO:900 | SEQ ID NO:1622 |
| Senescence | Male sterility | CP1 | 4337353 | protein | Increase/Decrease | SEQ ID NO:901 | SEQ ID NO:1623 |
| Senescence | Male sterility | UDT1 | 9269572 | protein | Increase/Decrease | SEQ ID NO:902 | SEQ ID NO:1624 |
| Senescence | melatonin synthesis, stress resistance, yield \| Flag leaf senescence | SNAT1 | 4339123 | protein | Increase | SEQ ID NO:903 | SEQ ID NO:1625 |
| Senescence | Meristem | AGO1C | 4331253 | protein | Increase/Decrease | SEQ ID NO:904 | SEQ ID NO:1626 |
| Senescence | Micronutrient mobilization- iron and Zinc \| increase mineral contents in rice grains | NAS3 | 4344361 | protein | Increase | SEQ ID NO:905 | SEQ ID NO:1627 |
| Senescence | Oxidative and abiotic stresses | ALDH7 | 4347172 | protein | Increase | SEQ ID NO:906 | SEQ ID NO:1628 |
| Senescence | Oxidative stress response | CHS1 | 4350636 | protein | Increase/Decrease | SEQ ID NO:907 | SEQ ID NO:1629 |
| Senescence | Oxidative stress response | GST | 4349270 | protein | Increase/Decrease | SEQ ID NO:908 | SEQ ID NO:1630 |
| Senescence | Photorespiration \| Nitrogen content \| NUE | GRX6 | 4326324 | protein | Increase/Decrease | SEQ ID NO:909 | SEQ ID NO:1631 |
| Senescence | Plant growth/development | SWEET5 | 4339772 | protein | Increase | SEQ ID NO:910 | SEQ ID NO:1632 |
| Senescence | planting density | GATA12 | 4334668 | protein | Increase | SEQ ID NO:911 | SEQ ID NO:1633 |
| Senescence | Premature leaf senescence \| Salt stress \| Leaf senescence | NAC58 | 4332717 | protein | Increase/Decrease | SEQ ID NO:912 | SEQ ID NO:1634 |
| Senescence | Root hairs \| leaf senescence \| Stress response/early leaf senescence | APX2 | 4344397 | protein | Increase | SEQ ID NO:913 | SEQ ID NO:1635 |

TABLE 6-continued

| Trait | Trait subcategory | Gene(s) | GeneID | GeneProduct | Expression Change | Gene SEQ ID | Protein SEQ ID |
|---|---|---|---|---|---|---|---|
| Senescence | Root system architecture \| Male sterility | ERF3 | 4327621 | protein | Increase | SEQ ID NO:914 | SEQ ID NO:1636 |
| Senescence | Salt and drought | C3H35 | 4338037 | protein | Increase | SEQ ID NO:915 | SEQ ID NO:1637 |
| Senescence | SAM \| Premature leaf senescence \| Salt stress | NAM | 4340969 | protein | Increase | SEQ ID NO:916 | SEQ ID NO:1638 |
| Senescence | Seed quality-Carotenoid degradation during storage \| Seed storage and quality | LOX1 | 4333823 | protein | Decrease | SEQ ID NO:917 | SEQ ID NO:1639 |
| Senescence | Seed quality-Carotenoid degradation during storage \| Seed storage and quality | LOX11 | 4352505 | protein | Increase | SEQ ID NO:918 | SEQ ID NO:1640 |
| Senescence | senescence and yield \| Cytokinin activation \| Senescence | LOG1 | 4324445 | protein | Decrease | SEQ ID NO:919 | SEQ ID NO:1641 |
| Senescence | Senescence \| Cytokinin oxidase/dehydrogenase | CKX1 | 4325668 | protein | Decrease | SEQ ID NO:920 | SEQ ID NO:1642 |
| Senescence | Senescence \| Leaf senescence | DOS | 4327304 | protein | Increase | SEQ ID NO:921 | SEQ ID NO:1643 |
| Senescence | shoot apical meristem initiation \| rolled leaf | SHL4 | 4333232 | protein | Increase | SEQ ID NO:922 | SEQ ID NO:1644 |
| Senescence | ssenescence \| Leaf development | HOX33 | 4352777 | protein | Increase | SEQ ID NO:923 | SEQ ID NO:1645 |
| Senescence | staygreen \| leaf senescence \| Stay green | NYC3 | 4340988 | protein | Increase/Decrease | SEQ ID NO:924 | SEQ ID NO:1646 |
| Senescence | Stress response/ early leaf senescence | APX1 | 4332474 | protein | Increase | SEQ ID NO:925 | SEQ ID NO:1647 |
| Senescence | Stress tolerance | AHP1 | 4346300 | protein | Increase | SEQ ID NO:926 | SEQ ID NO:1648 |
| Senescence | Submergence tolerance | ERF108 | 4325981 | protein | Increase/Decrease | SEQ ID NO:927 | SEQ ID NO:1649 |
| Senescence | Tillering & size \| Branch development | D17 | 4336591 | protein | Increase/Decrease | SEQ ID NO:928 | SEQ ID NO:1650 |
| Senescence | Transcription factor biosynthesis \| Leaf senescence | PME1 | 4332625 | protein | Increase/Decrease | SEQ ID NO:929 | SEQ ID NO:1651 |
| Senescence | Yield \| Grain yield related traits (multiple QTLs) \| Plant height \| Senescence \| submerge tolerance \| Grain yield | GHD7 | 107276161 | protein | Increase/Decrease | SEQ ID NO:930 | SEQ ID NO:1652 |
| Senescence | yield \| salt \| glutamine synthetase suppression \| Leaf development \| Grain Quality \| Leaf senescence \| Senescence | GS2 | 4337272 | protein | Increase/Decrease | SEQ ID NO:931 | SEQ ID NO:1653 |
| Photosynthesis | | PsbS | 4324933 | protein | Increase | SEQ ID NO:1727 | SEQ ID NO:1728 |
| Photosynthesis | | VDE | 4335625 | protein | Increase | SEQ ID NO:1729 | SEQ ID NO:1730 |
| Photosynthesis | | ZEP | 4335984 | protein | Increase | SEQ ID NO:1731 | SEQ ID NO:1732 |

All cited patents and patent publications referred to in this application are incorporated herein by reference in their entirety. All of the materials and methods disclosed and claimed herein can be made and used without undue experimentation as instructed by the above disclosure and illustrated by the examples. Although the materials and methods of this invention have been described in terms of embodiments and illustrative examples, it will be apparent to those of skill in the art that substitutions and variations can be applied to the materials and methods described herein without departing from the concept, spirit, and scope of the invention. For instance, while the particular examples provided illustrate the methods and embodiments described herein using a specific plant, the principles in these examples are applicable to any plant of interest; similarly, while the particular examples provided illustrate the methods and embodiments described herein using a particular sequence-specific nuclease such as Cas9, one of skill in the art would recognize that alternative sequence-specific nucleases (e. g., CRISPR nucleases other than Cas9, such as CasX, CasY, and Cpf1, zinc-finger nucleases, transcription activator-like effector nucleases, Argonaute proteins, and meganucleases) are useful in various embodiments. All such similar substitutes and modifications apparent to those skilled in the art are deemed to be within the spirit, scope, and concept of the invention as encompassed by the embodiments of the inventions recited herein and the specification and appended claims.

SEQUENCE LISTING (1732 sequences)

SEQ ID NO: 1 - DNA, 11 bp, Artificial Sequence
  Description of Artificial Sequence: Synthetic construct
cctcgtgtctc

SEQ ID NO: 2 - DNA, 11 bp, Artificial Sequence
  Description of Artificial Sequence: Synthetic construct
ccttttgtctc

SEQ ID NO: 3 - DNA, 11 bp, Artificial Sequence
  Description of Artificial Sequence: Synthetic construct
  modified_base (10)..(10): a, c, t or g
ccttttgtcnc

SEQ ID NO: 4 - DNA, 6 bp, Artificial Sequence
  Description of Artificial Sequence: Synthetic construct
tgtctc

SEQ ID NO: 5 - protein, 5 aa, Artificial Sequence
  Description of Artificial Sequence: Synthetic construct
  MOD_RES (2)..(2): Any naturally occurring amino acid
  MOD_RES (4)..(4): Any naturally occurring amino acid
LXLXL

SEQ ID NO: 6 - protein, 6 aa, Artificial Sequence
  Description of Artificial Sequence: Synthetic construct
  MOD_RES (4)..(5): Any naturally occurring amino acid
DLNXXP

SEQ ID NO: 7 - DNA, 34 bp, Artificial Sequence
  Description of Artificial Sequence: Synthetic construct
ataacttcgtatagcatacattatacgaagttat

SEQ ID NO: 8 - DNA, 34 bp, Artificial Sequence
  Description of Artificial Sequence: Synthetic construct
ataacttcgtataatgtatgctatacgaagttat

SEQ ID NO: 9 - DNA, 34 bp, Artificial Sequence
  Description of Artificial Sequence: Synthetic construct
  modified_base (14)..(16): a, c, t or g
  modified_base (19)..(21): a, c, t or g
ataacttcgtatannntannntatacgaagttat

SEQ ID NO: 10 - DNA, 34 bp, Artificial Sequence
  Description of Artificial Sequence: Synthetic construct
ataacttcgtataatgtatactatacgaagttat

SEQ ID NO: 11 - DNA, 34 bp, Artificial Sequence
  Description of Artificial Sequence: Synthetic construct
ataacttcgtataatgtgtactatacgaagttat

SEQ ID NO: 12 - DNA, 34 bp, Artificial Sequence
  Description of Artificial Sequence: Synthetic construct
ataacttcgtataaagtatcctatacgaagttat

SEQ ID NO: 13 - DNA, 34 bp, Artificial Sequence
  Description of Artificial Sequence: Synthetic construct
ataacttcgtataagaaaccatatacgaagttat

SEQ ID NO: 14 - DNA, 34 bp, Artificial Sequence
  Description of Artificial Sequence: Synthetic construct
ataacttcgtatataataccatatacgaagttat

SEQ ID NO: 15 - DNA, 34 bp, Artificial Sequence
  Description of Artificial Sequence: Synthetic construct
ataacttcgtataagatagaatatacgaagttat

SEQ ID NO: 16 - DNA, 34 bp, Artificial Sequence; identical to SEQ ID NO: 15
  Description of Artificial Sequence: Synthetic construct

SEQ ID NO: 17 - DNA, 34 bp, Artificial Sequence
  Description of Artificial Sequence: Synthetic construct
  modified_base (14)..(16): a, c, t or g
  modified_base (19)..(21): a, c, t or g
taccgttcgtatannntannntatacgaagttat

SEQ ID NO: 18 - DNA, 34 bp, Artificial Sequence
  Description of Artificial Sequence: Synthetic construct
  modified_base (14)..(16): a, c, t or g
  modified_base (19)..(21): a, c, t or g
ataacttcgtatannntannntatacgaacggta

SEQ ID NO: 19 - DNA, 8 bp, Artificial Sequence
  Description of Artificial Sequence: Synthetic construct
cacgtggc

SEQ ID NO: 20 - DNA, 8 bp, Artificial Sequence
  Description of Artificial Sequence: Synthetic construct
yacgtggc

SEQ ID NO: 21 - DNA, 8 bp, Artificial Sequence
  Description of Artificial Sequence: Synthetic construct
bacgtgkm

SEQ ID NO: 22 - DNA, 10 bp, Artificial Sequence
  Description of Artificial Sequence: Synthetic construct
gacacgtaga

SEQ ID NO: 23 - DNA, 14 bp, Artificial Sequence
  Description of Artificial Sequence: Synthetic construct
ttdccwwwwwwggh

SEQ ID NO: 24 - DNA, 11 bp, Artificial Sequence
  Description of Artificial Sequence: Synthetic construct
ccatttttagt

SEQ ID NO: 25 - DNA, 10 bp, Artificial Sequence
  Description of Artificial Sequence: Synthetic construct
ccatttttgg

SEQ ID NO: 26 - DNA, 18 bp, Artificial Sequence
  Description of Artificial Sequence: Synthetic construct
  modified_base (1)..(1): a, c, t or g
  modified_base (11)..(12): a, c, t or g
  modified_base (18)..(18): a, c, t or g
nttdccwwwwnnggwaan

SEQ ID NO: 27 - DNA, 18 bp, Artificial Sequence
  Description of Artificial Sequence: Synthetic construct
  modified_base (1)..(2): a, c, t or g
  modified_base (4)..(4): a, c, t or g
  modified_base (18)..(18): a, c, t or g
nnwnccawwwwtrgwwan

SEQ ID NO: 28 - DNA, 16 bp, Artificial Sequence
  Description of Artificial Sequence: Synthetic construct
ttwcyawwwwtrgwaa

SEQ ID NO: 29 - DNA, 10 bp, Artificial Sequence
  Description of Artificial Sequence: Synthetic construct
ccatttttag

SEQ ID NO: 30 - DNA, 10 bp, Artificial Sequence
  Description of Artificial Sequence: Synthetic construct
ccatttttgg

SEQ ID NO: 31 - DNA, 6 bp, Artificial Sequence
  Description of Artificial Sequence: Synthetic construct
tgtctc

SEQ ID NO: 32 - DNA, 6 bp, Artificial Sequence
  Description of Artificial Sequence: Synthetic construct
tgtctc

SEQ ID NO: 33 - DNA, 9 bp, Artificial Sequence
  Description of Artificial Sequence: Synthetic construct
caatwattg

SEQ ID NO: 34 - DNA, 9 bp, Artificial Sequence
  Description of Artificial Sequence: Synthetic construct
caatsattg

SEQ ID NO: 35 - DNA, 9 bp, Artificial Sequence
  Description of Artificial Sequence: Synthetic construct
  modified_base (5)..(5): a, c, t or g
caatnattg

SEQ ID NO: 36 - DNA, 9 bp, Artificial Sequence
  Description of Artificial Sequence: Synthetic construct
caattatta

SEQ ID NO: 37 - DNA, 7 bp, Artificial Sequence
  Description of Artificial Sequence: Synthetic construct
ctaacca

SEQ ID NO: 38 - DNA, 6 bp, Artificial Sequence
  Description of Artificial Sequence: Synthetic construct
cacatg

SEQ ID NO: 39 - DNA, 6 bp, Artificial Sequence
  Description of Artificial Sequence: Synthetic construct
ggttaa

SEQ ID NO: 40 - DNA, 10 bp, Artificial Sequence
  Description of Artificial Sequence: Synthetic construct
ccwwwwwwgg

SEQ ID NO: 41 - DNA, 18 bp, Artificial Sequence
  Description of Artificial Sequence: Synthetic construct
gtttacataaatggaaaa

SEQ ID NO: 42 - DNA, 18 bp, Artificial Sequence
  Description of Artificial Sequence: Synthetic construct
cttacctttcatggatta

SEQ ID NO: 43 - DNA, 18 bp, Artificial Sequence
  Description of Artificial Sequence: Synthetic construct
ctttccatttttagtaac

SEQ ID NO: 44 - DNA, 8 bp, Artificial Sequence
  Description of Artificial Sequence: Synthetic construct
tggccgac

SEQ ID NO: 45 - DNA, 8 bp, Artificial Sequence
  Description of Artificial Sequence: Synthetic construct
ccacgtgg

SEQ ID NO: 46 - DNA, 8 bp, Artificial Sequence
  Description of Artificial Sequence: Synthetic construct
aamaatct

SEQ ID NO: 47 - DNA, 10 bp, Artificial Sequence
  Description of Artificial Sequence: Synthetic construct
aaacaatcta

SEQ ID NO: 48 - DNA, 15 bp, Artificial Sequence
  Description of Artificial Sequence: Synthetic construct
aaaaaaaatctatga

SEQ ID NO: 49 - DNA, 7 bp, Artificial Sequence
  Description of Artificial Sequence: Synthetic construct
  modified_base (5)..(6): a, c, t or g
acacnng

SEQ ID NO: 50 - DNA, 9 bp, Artificial Sequence
  Description of Artificial Sequence: Synthetic construct
taccgacat

SEQ ID NO: 51 - DNA, 9 bp, Artificial Sequence
  Description of Artificial Sequence: Synthetic construct
taccgacat

SEQ ID NO: 52 - DNA, 9 bp, Artificial Sequence
  Description of Artificial Sequence: Synthetic construct
  modified_base (8)..(8): a, c, t or g
drccgacnw

SEQ ID NO: 53 - DNA, 8 bp, Artificial Sequence
  Description of Artificial Sequence: Synthetic construct
tttcccgc

SEQ ID NO: 54 - DNA, 8 bp, Artificial Sequence
  Description of Artificial Sequence: Synthetic construct
tttcccgc

SEQ ID NO: 55 - DNA, 9 bp, Artificial Sequence
  Description of Artificial Sequence: Synthetic construct
tctcccgcc

SEQ ID NO: 56 - DNA, 23 bp, Artificial Sequence
  Description of Artificial Sequence: Synthetic construct
ttcaagggggcatgtatcttgaa

SEQ ID NO: 57 - DNA, 23 bp, Artificial Sequence
  Description of Artificial Sequence: Synthetic construct
ttcaagggggcatgtatcttgaa

SEQ ID NO: 58 - DNA, 23 bp, Artificial Sequence
  Description of Artificial Sequence: Synthetic construct
ttcaagggggcatgtatcttgaa

SEQ ID NO: 59 - DNA, 29 bp, Artificial Sequence
  Description of Artificial Sequence: Synthetic construct
ggattcaagggggcatgtatcttgaatcc

SEQ ID NO: 60 - DNA, 11 bp, Artificial Sequence
  Description of Artificial Sequence: Synthetic construct
taagagccgcc

SEQ ID NO: 61 - DNA, 6 bp, Artificial Sequence
  Description of Artificial Sequence: Synthetic construct
gccgcc

SEQ ID NO: 62 - DNA, 9 bp, Artificial Sequence
  Description of Artificial Sequence: Synthetic construct
aaaatatct

SEQ ID NO: 63 - DNA, 6 bp, Artificial Sequence
  Description of Artificial Sequence: Synthetic construct
wgatar

SEQ ID NO: 64 - DNA, 8 bp, Artificial Sequence
  Description of Artificial Sequence: Synthetic construct
ccacgtgg

SEQ ID NO: 65 - DNA, 6 bp, Artificial Sequence
  Description of Artificial Sequence: Synthetic construct
cacgtg

SEQ ID NO: 66 - DNA, 6 bp, Artificial Sequence
  Description of Artificial Sequence: Synthetic construct
gccgcc

SEQ ID NO: 67 - DNA, 15 bp, Artificial Sequence
  Description of Artificial Sequence: Synthetic construct
tgtgtggttaatatg

SEQ ID NO: 68 - DNA, 6 bp, Artificial Sequence
  Description of Artificial Sequence: Synthetic construct
ccgtcg

SEQ ID NO: 69 - DNA, 10 bp, Artificial Sequence
  Description of Artificial Sequence: Synthetic construct
  modified_base (5)..(6): a, c, t or g
agaannttct

SEQ ID NO: 70 - DNA, 6 bp, Artificial Sequence
  Description of Artificial Sequence: Synthetic construct
gataag

SEQ ID NO: 71 - DNA, 10 bp, Artificial Sequence
  Description of Artificial Sequence: Synthetic construct
cgtcaatgaa

SEQ ID NO: 72 - DNA, 13 bp, Artificial Sequence
  Description of Artificial Sequence: Synthetic construct
catacgtcgtcaa

SEQ ID NO: 73 - DNA, 8 bp, Artificial Sequence
  Description of Artificial Sequence: Synthetic construct
taaatgya

SEQ ID NO: 74 - DNA, 10 bp, Artificial Sequence
  Description of Artificial Sequence: Synthetic construct
acgtcataga

SEQ ID NO: 75 - DNA, 10 bp, Artificial Sequence
  Description of Artificial Sequence: Synthetic construct
tctacgtcac

SEQ ID NO: 76 - DNA, 7 bp, Artificial Sequence
  Description of Artificial Sequence: Synthetic construct
accgaca

SEQ ID NO: 77 - DNA, 12 bp, Artificial Sequence
  Description of Artificial Sequence: Synthetic construct
tctaacctacca

SEQ ID NO: 78 - DNA, 8 bp, Artificial Sequence
  Description of Artificial Sequence: Synthetic construct
maccwamc

SEQ ID NO: 79 - DNA, 8 bp, Artificial Sequence
  Description of Artificial Sequence: Synthetic construct
mtccwacc

SEQ ID NO: 80 - DNA, 9 bp, Artificial Sequence
  Description of Artificial Sequence: Synthetic construct
taactsgtt

SEQ ID NO: 81 - DNA, 8 bp, Artificial Sequence
  Description of Artificial Sequence: Synthetic construct
taactaac

SEQ ID NO: 82 - DNA, 7 bp, Artificial Sequence
  Description of Artificial Sequence: Synthetic construct
amcwamc

SEQ ID NO: 83 - DNA, 9 bp, Artificial Sequence
  Description of Artificial Sequence: Synthetic construct
agatcgacg

SEQ ID NO: 84 - DNA, 26 bp, Artificial Sequence
  Description of Artificial Sequence: Synthetic construct
atcttatgtcattgatgacgacctcc

SEQ ID NO: 85 - DNA, 11 bp, Artificial Sequence
  Description of Artificial Sequence: Synthetic construct
tacacttttgg

SEQ ID NO: 86 - DNA, 20 bp, Artificial Sequence
  Description of Artificial Sequence: Synthetic construct
tgacgyaagsrmtkacgymm

SEQ ID NO: 87 - DNA, 8 bp, Artificial Sequence
  Description of Artificial Sequence: Synthetic construct
cgcggatc

SEQ ID NO: 88 - DNA, 8 bp, Artificial Sequence
  Description of Artificial Sequence: Synthetic construct
gtgatcac

SEQ ID NO: 89 - DNA, 20 bp, Artificial Sequence
  Description of Artificial Sequence: Synthetic construct
ttggttttgatcaaaaccaa

SEQ ID NO: 90 - DNA, 15 bp, Artificial Sequence
  Description of Artificial Sequence: Synthetic construct
taattgactcaatta

SEQ ID NO: 91 - DNA, 5 bp, Artificial Sequence
  Description of Artificial Sequence: Synthetic construct
caaca

SEQ ID NO: 92 - DNA, 6 bp, Artificial Sequence
  Description of Artificial Sequence: Synthetic construct
cacctg

SEQ ID NO: 93 - DNA, 8 bp, Artificial Sequence
  Description of Artificial Sequence: Synthetic construct
catgcatg

SEQ ID NO: 94 - DNA, 9 bp, Artificial Sequence
  Description of Artificial Sequence: Synthetic construct
  modified_base (2)..(2): a, c, t or g
tncgtacaa

SEQ ID NO: 95 - DNA, 6 bp, Artificial Sequence
  Description of Artificial Sequence: Synthetic construct
actttg

SEQ ID NO: 96 - DNA, 16 bp, Artificial Sequence
  Description of Artificial Sequence: Synthetic construct
aggggcataatggtaa

SEQ ID NO: 97 - DNA, 9 bp, Artificial Sequence
  Description of Artificial Sequence: Synthetic construct
aaaccctaa

SEQ ID NO: 98 - DNA, 8 bp, Artificial Sequence
  Description of Artificial Sequence: Synthetic construct
tgacgtgg

SEQ ID NO: 99 - DNA, 5 bp, Artificial Sequence
  Description of Artificial Sequence: Synthetic construct
ttgac

SEQ ID NO: 100 - DNA, 8 bp, Artificial Sequence
  Description of Artificial Sequence: Synthetic construct
atacgtgt

SEQ ID NO: 101 - DNA, 16 bp, Artificial Sequence
  Description of Artificial Sequence: Synthetic construct
aaaacagaataggaaa

SEQ ID NO: 102 - DNA, 8 bp, Artificial Sequence
  Description of Artificial Sequence: Synthetic construct
aaattaaa

SEQ ID NO: 103 - DNA, 8 bp, Artificial Sequence
  Description of Artificial Sequence: Synthetic construct
aaattagt

SEQ ID NO: 104 - DNA, 8 bp, Artificial Sequence
  Description of Artificial Sequence: Synthetic construct
actaattt

SEQ ID NO: 105 - DNA, 12 bp, Artificial Sequence
  Description of Artificial Sequence: Synthetic construct
ccaatttaatgg

SEQ ID NO: 106 - DNA, 6 bp, Artificial Sequence
  Description of Artificial Sequence: Synthetic construct
actcat

SEQ ID NO: 107 - DNA, 19 bp, Artificial Sequence
  Description of Artificial Sequence: Synthetic construct
cttaaaccctaggggtaat

SEQ ID NO: 108 - DNA, 10 bp, Artificial Sequence
  Description of Artificial Sequence: Synthetic construct
ttwtactagt

SEQ ID NO: 109 - DNA, 9 bp, Artificial Sequence
  Description of Artificial Sequence: Synthetic construct
ataaaacgt

SEQ ID NO: 110 - DNA, 9 bp, Artificial Sequence
  Description of Artificial Sequence: Synthetic construct
tgtatatat

SEQ ID NO: 111 - DNA, 9 bp, Artificial Sequence
  Description of Artificial Sequence: Synthetic construct
ctcctaatt

SEQ ID NO: 112 - DNA, 10 bp, Artificial Sequence
  Description of Artificial Sequence: Synthetic construct
ttgcatgact

SEQ ID NO: 113 - DNA, 6 bp, Artificial Sequence
  Description of Artificial Sequence: Synthetic construct
agccac

SEQ ID NO: 114 - DNA, 5 bp, Artificial Sequence
  Description of Artificial Sequence: Synthetic construct
gggcc

SEQ ID NO: 115 - DNA, 9 bp, Artificial Sequence
  Description of Artificial Sequence: Synthetic construct
ctcaagtga

SEQ ID NO: 116 - DNA, 9 bp, Artificial Sequence
  Description of Artificial Sequence: Synthetic construct
gtatgatgg

SEQ ID NO: 117 - DNA, 7 bp, Artificial Sequence
  Description of Artificial Sequence: Synthetic construct
gagtgag

SEQ ID NO: 118 - DNA, 8 bp, Artificial Sequence
  Description of Artificial Sequence: Synthetic construct
cacgtggc

SEQ ID NO: 119 - DNA, 34 bp, Artificial Sequence
  Description of Artificial Sequence: Synthetic construct
gtttaattgagttgtcatatgttaataacggtat

SEQ ID NO: 120 - DNA, 34 bp, Artificial Sequence
  Description of Artificial Sequence: Synthetic construct
ataccgttattaacatatgacaactcaattaaac

SEQ ID NO: 121 - DNA, 34 bp, Artificial Sequence
  Description of Artificial Sequence: Synthetic construct
ccgacaaaaggccgacaaaaggccgacaaaaggt

SEQ ID NO: 122 - DNA, 34 bp, Artificial Sequence
  Description of Artificial Sequence: Synthetic construct
accttttgtcggccttttgtcggccttttgtcgg

SEQ ID NO: 123 - DNA, 68 bp, Artificial Sequence
  Description of Artificial Sequence: Synthetic construct
gccgacaaaaggccgacaaaaggccgacaaaaggccgacaaaaggccgacaaaaggccgacaaaaggt

SEQ ID NO: 124 - DNA, 68 bp, Artificial Sequence
  Description of Artificial Sequence: Synthetic construct
accttttgtcggccttttgtcggccttttgtcggccttttgtcggccttttgtcggccttttgtcggc

SEQ ID NO: 125 - DNA, 100 bp, Artificial Sequence
  Description of Artificial Sequence: Synthetic construct
ccgacaaaaggccgacaaaaggccgacaaaaggccgacaaaaggccgacaaaaggccgacaaaaggccgacaaaaggccgacaaaaggccgacaaaaggt

SEQ ID NO: 126 - DNA, 100 bp, Artificial Sequence
  Description of Artificial Sequence: Synthetic construct
accttttgtcggccttttgtcggccttttgtcggccttttgtcggccttttgtcggccttttgtcggccttttgtcggccttttgtcggccttttgtcgg

SEQ ID NO: 127 - DNA, 34 bp, Artificial Sequence; identical to SEQ ID NO: 7
  Description of Artificial Sequence: Synthetic construct

SEQ ID NO: 128 - DNA, 34 bp, Artificial Sequence; identical to SEQ ID NO: 8
  Description of Artificial Sequence: Synthetic construct

SEQ ID NO: 129 - DNA, 34 bp, Artificial Sequence; identical to SEQ ID NO: 9
  Description of Artificial Sequence: Synthetic construct
  modified_base (14)..(16): a, c, t or g
  modified_base (19)..(21): a, c, t or g

SEQ ID NO: 130 - DNA, 34 bp, Artificial Sequence; identical to SEQ ID NO: 10
  Description of Artificial Sequence: Synthetic construct

SEQ ID NO: 131 - DNA, 34 bp, Artificial Sequence; identical to SEQ ID NO: 11
  Description of Artificial Sequence: Synthetic construct

SEQ ID NO: 132 - DNA, 34 bp, Artificial Sequence; identical to SEQ ID NO: 12
  Description of Artificial Sequence: Synthetic construct

SEQ ID NO: 133 - DNA, 34 bp, Artificial Sequence; identical to SEQ ID NO: 13
  Description of Artificial Sequence: Synthetic construct

SEQ ID NO: 134 - DNA, 34 bp, Artificial Sequence; identical to SEQ ID NO: 14
  Description of Artificial Sequence: Synthetic construct

SEQ ID NO: 135 - DNA, 34 bp, Artificial Sequence; identical to SEQ ID NO: 15
  Description of Artificial Sequence: Synthetic construct

SEQ ID NO: 136 - DNA, 34 bp, Artificial Sequence; identical to SEQ ID NO: 15
  Description of Artificial Sequence: Synthetic construct

SEQ ID NO: 137 - DNA, 34 bp, Artificial Sequence; identical to SEQ ID NO: 17
  Description of Artificial Sequence: Synthetic construct
  modified_base (14)..(16): a, c, t or g
  modified_base (19)..(21): a, c, t or g

SEQ ID NO: 138 - DNA, 34 bp, Artificial Sequence; identical to SEQ ID NO: 18
  Description of Artificial Sequence: Synthetic construct
  modified_base (14)..(16): a, c, t or g
  modified_base (19)..(21): a, c, t or g

SEQ ID NO: 139 - DNA, 20 bp, Artificial Sequence
  Description of Artificial Sequence: Synthetic construct
gtgctctctctcttctgtca

SEQ ID NO: 140 - DNA, 20 bp, Artificial Sequence
  Description of Artificial Sequence: Synthetic construct
ctgctctctctcttctgtca

SEQ ID NO: 141 - DNA, 20 bp, Artificial Sequence
  Description of Artificial Sequence: Synthetic construct
ttgcttactctcttctgtca

SEQ ID NO: 142 - DNA, 20 bp, Artificial Sequence
  Description of Artificial Sequence: Synthetic construct
ccgctctctctcttctgtca

SEQ ID NO: 143 - DNA, 21 bp, Artificial Sequence
  Description of Artificial Sequence: Synthetic construct
tggagctcccttcattccaat

SEQ ID NO: 144 - DNA, 21 bp, Artificial Sequence
  Description of Artificial Sequence: Synthetic construct
tcgagttcccttcattccaat

SEQ ID NO: 145 - DNA, 21 bp, Artificial Sequence
  Description of Artificial Sequence: Synthetic construct
atgagctctcttcaaaccaaa

SEQ ID NO: 146 - DNA, 21 bp, Artificial Sequence
  Description of Artificial Sequence: Synthetic construct
tggagctcccttcattccaag

SEQ ID NO: 147 - DNA, 21 bp, Artificial Sequence
  Description of Artificial Sequence: Synthetic construct
tagagcttccttcaaaccaaa

SEQ ID NO: 148 - DNA, 21 bp, Artificial Sequence
  Description of Artificial Sequence: Synthetic construct
tggagctccattcgatccaaa

SEQ ID NO: 149 - DNA, 21 bp, Artificial Sequence
  Description of Artificial Sequence: Synthetic construct
agcagctcccttcaaaccaaa

SEQ ID NO: 150 - DNA, 21 bp, Artificial Sequence
  Description of Artificial Sequence: Synthetic construct
cagagctcccttcactccaat

SEQ ID NO: 151 - DNA, 21 bp, Artificial Sequence
  Description of Artificial Sequence: Synthetic construct
tggagctcccttcactccaat

SEQ ID NO: 152 - DNA, 21 bp, Artificial Sequence
  Description of Artificial Sequence: Synthetic construct
tggagctcccttcactccaag

SEQ ID NO: 153 - DNA, 21 bp, Artificial Sequence
  Description of Artificial Sequence: Synthetic construct
tggagctccctttaatccaat

SEQ ID NO: 154 - DNA, 21 bp, Artificial Sequence
  Description of Artificial Sequence: Synthetic construct
ttgggatgaagcctggtccgg

SEQ ID NO: 155 - DNA, 21 bp, Artificial Sequence
  Description of Artificial Sequence: Synthetic construct
ctgggatgaagcctggtccgg

SEQ ID NO: 156 - DNA, 21 bp, Artificial Sequence
  Description of Artificial Sequence: Synthetic construct
ctggaatgaagcctggtccgg

SEQ ID NO: 157 - DNA, 20 bp, Artificial Sequence
  Description of Artificial Sequence: Synthetic construct
cgggatgaagcctggtccgg

SEQ ID NO: 158 - DNA, 21 bp, Artificial Sequence
  Description of Artificial Sequence: Synthetic construct
gagatcaggctggcagcttgt

SEQ ID NO: 159 - DNA, 21 bp, Artificial Sequence
  Description of Artificial Sequence: Synthetic construct
tagatcaggctggcagcttgt

SEQ ID NO: 160 - DNA, 21 bp, Artificial Sequence
  Description of Artificial Sequence: Synthetic construct
aagatcaggctggcagcttgt

SEQ ID NO: 161 - DNA, 20 bp, Artificial Sequence
  Description of Artificial Sequence: Synthetic construct
gtgctctctctcttctgtca

SEQ ID NO: 162 - DNA, 20 bp, Artificial Sequence
  Description of Artificial Sequence: Synthetic construct
ctgctctctctcttctgtca

SEQ ID NO: 163 - DNA, 20 bp, Artificial Sequence
  Description of Artificial Sequence: Synthetic construct
ttgcttactctcttctgtca

SEQ ID NO: 164 - DNA, 20 bp, Artificial Sequence
  Description of Artificial Sequence: Synthetic construct
ccgctctctctcttctgtca

SEQ ID NO: 165 - DNA, 21 bp, Artificial Sequence
  Description of Artificial Sequence: Synthetic construct
tggcatgcagggagccaggca

SEQ ID NO: 166 - DNA, 21 bp, Artificial Sequence
  Description of Artificial Sequence: Synthetic construct
aggaatacagggagccaggca

SEQ ID NO: 167 - DNA, 21 bp, Artificial Sequence
  Description of Artificial Sequence: Synthetic construct
gggtttacagggagccaggca

SEQ ID NO: 168 - DNA, 21 bp, Artificial Sequence
  Description of Artificial Sequence: Synthetic construct
aggcatacagggagccaggca

SEQ ID NO: 169 - DNA, 21 bp, Artificial Sequence
  Description of Artificial Sequence: Synthetic construct
aaacaatgcgatccctttgga

SEQ ID NO: 170 - DNA, 21 bp, Artificial Sequence
  Description of Artificial Sequence: Synthetic construct
agaccatgcgatccctttgga

SEQ ID NO: 171 - DNA, 21 bp, Artificial Sequence
  Description of Artificial Sequence: Synthetic construct
ggtcagagcgatccctttggc

SEQ ID NO: 172 - DNA, 21 bp, Artificial Sequence
  Description of Artificial Sequence: Synthetic construct
agacaatgcgatccctttgga

SEQ ID NO: 173 - DNA, 22 bp, Artificial Sequence
  Description of Artificial Sequence: Synthetic construct
tcgttcaagaaagcctgtggaa

SEQ ID NO: 174 - DNA, 21 bp, Artificial Sequence
  Description of Artificial Sequence: Synthetic construct
cgttcaagaaagcctgtggaa

SEQ ID NO: 175 - DNA, 22 bp, Artificial Sequence
  Description of Artificial Sequence: Synthetic construct
tcgttcaagaaagcatgtggaa

SEQ ID NO: 176 - DNA, 22 bp, Artificial Sequence
  Description of Artificial Sequence: Synthetic construct
acgttcaagaaagcttgtggaa

SEQ ID NO: 177 - DNA, 21 bp, Artificial Sequence
  Description of Artificial Sequence: Synthetic construct
cgttcaagaaagcctgtggaa

SEQ ID NO: 178 - DNA, 300 bp, Artificial Sequence
  Description of Artificial Sequence: Synthetic construct
ggacaacaagcaccttcttgccttgcaaggcctcccttccctatggtagccacttgagtggatgacttcaccttaaagctattgattccctaagtgccagacataataggctatacattctctctggtggcaacaatgagccattttggttggtgtggtagtctattattgagttttttttggcaccgtactcccatggagagtagaagacaaactcttcaccgttgtagtcgttgatggtattggtggtgacgacatccttggtgtgcatgcactggtgagtcactgttgtactcggcg

SEQ ID NO: 179 - DNA, 104 bp, Artificial Sequence
  Description of Artificial Sequence: Synthetic construct
ggacaacaagcaccttcttgccttgcaaggcctcccttccctatggtagccacttgagtggatgacttcaccttaaagctatcgattccctaagtgccagacat

SEQ ID NO: 180 - DNA, 80 bp, Artificial Sequence
  Description of Artificial Sequence: Synthetic construct
ctcttcaccgttgtagtcgttgatggtattggtggtgacgacatccttggtgtgcatgcactggtgagtcactgttgtac

SEQ ID NO: 181 - DNA, 184 bp, Artificial Sequence
  Description of Artificial Sequence: Synthetic construct
ggacaacaagcaccttcttgccttgcaaggcctcccttccctatggtagccacttgagtggatgacttcaccttaaagctatcgattccctaagtgccagacatctcttcaccgttgtagtcgttgatggtattggtggtgacgacatccttggtgtgcatgcactggtgagtcactgttgtac

SEQ ID NO: 182 - DNA, 184 bp, Artificial Sequence
  Description of Artificial Sequence: Synthetic construct
ctcttcaccgttgtagtcgttgatggtattggtggtgacgacatccttggtgtgcatgcactggtgagtcactgttgtacggacaacaagcaccttcttgccttgcaaggcctcccttccctatggtagccacttgagtggatgacttcaccttaaagctatcgattccctaagtgccagacat

SEQ ID NO: 183 - DNA, 16 bp, Artificial Sequence
  Description of Artificial Sequence: Synthetic construct
acgtaagcgcttacgt

SEQ ID NO: 184 - DNA, 12 bp, Artificial Sequence
  Description of Artificial Sequence: Synthetic construct
gtaagcgcttac

SEQ ID NO: 185 - DNA, 43 bp, Artificial Sequence
  Description of Artificial Sequence: Synthetic construct
aagagatgagctcttgagcaatgtaaagggtcaagttgtttct

SEQ ID NO: 186 - DNA, 43 bp, Artificial Sequence
  Description of Artificial Sequence: Synthetic construct
agaaacaacttgaccctttacattgctcaagagctcatctctt

SEQ ID NO: 187 - RNA, 34 nt, Artificial Sequence
  Description of Artificial Sequence: Synthetic construct
accuuuugucggccuuuugucggccuuuugucgg

SEQ ID NO: 188 - DNA, 38 bp, Artificial Sequence
  Description of Artificial Sequence: Synthetic construct
tcggtccgacaaaaggccgacaaaaggcggacaaaagg

SEQ ID NO: 189 - DNA, 38 bp, Artificial Sequence
  Description of Artificial Sequence: Synthetic construct
accgaccttttgtcggccttttgtcggccttttgtcgg

SEQ ID NO: 190 - DNA, 117 bp, Artificial Sequence
  Description of Artificial Sequence: Synthetic construct
atgggagtagaggcgggcggcggctgcggtgggagggcggtagtcaccggattctacgtctggggctgggagttcctcaccgccctcctgctcttctcggccaccacctcctactag

SEQ ID NO: 191 - DNA, 15 bp, Artificial Sequence
  Description of Artificial Sequence: Synthetic construct
aaaaaaaaaaaaaaa

SEQ ID NO: 192 - DNA, 25 bp, Artificial Sequence
  Description of Artificial Sequence: Synthetic construct
cacatacacacaaaaataaaaaaga

SEQ ID NO: 193 - DNA, 16 bp, Artificial Sequence
  Description of Artificial Sequence: Synthetic construct
gaatatatatatattc

SEQ ID NO: 194 - DNA, 618 bp, Artificial Sequence
  Description of Artificial Sequence: Synthetic construct
gtgaacaaccttatgaaatttgggcgcataacttcgtatagcatacattatacgaagttataaagaactcgccctcaagggttgatcttatgccatcgtcatgataaacagtggagcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaattgcaatgcgggcattgacagcagctgttactgctgctggtggaaatgcaacgtatgtttcctctctttctctctacaatacttgcataacttcgtataaagtatcctatacgaagttattggagttagtatgaaacccatgggtatgtctagt

SEQ ID NO: 195 - DNA, 84 bp, Artificial Sequence
  Description of Artificial Sequence: Synthetic construct
tactccctccgtttctttttattagtcgctggatagtgcaattttgcactatccagcgactaataaaaagaaacggagggagta

SEQ ID NO: 196 - DNA, 84 bp, Artificial Sequence
  Description of Artificial Sequence: Synthetic construct
tactccctccgtttctttttattagtcgctggatagtgcaaaattgcactatccagcgactaataaaaagaaacggagggagta

SEQ ID NO: 197 - DNA, 28 bp, Artificial Sequence
  Description of Artificial Sequence: Synthetic construct
acacgtgacacgtgacacgtgacacgtg

SEQ ID NO: 198 - DNA, 36 bp, Artificial Sequence
  Description of Artificial Sequence: Synthetic construct
ttatttattttatttattttatttattttatttatt

SEQ ID NO: 199 - DNA, 36 bp, Artificial Sequence
  Description of Artificial Sequence: Synthetic construct
aattttaattttaattttaattttaattttaatttt

SEQ ID NO: 200 - DNA, 36 bp, Artificial Sequence
  Description of Artificial Sequence: Synthetic construct
tctctttctctttctctttctctttctctttctctt

SEQ ID NO: 201 - DNA, 92 bp, Artificial Sequence
  Description of Artificial Sequence: Synthetic construct
attaaaaaaataaataagatattattaaaaaaataaataagatattattaaaaaaataaataagatattattaaaaaaataaataagatatt

SEQ ID NO: 202 - DNA, 92 bp, Artificial Sequence
  Description of Artificial Sequence: Synthetic construct
agatctaggagactgacatagattggaggagacattttgtataataagatctaggagactgacatagattggaggagacattttgtataata

SEQ ID NO: 203 - DNA, 8 bp, Artificial Sequence
  Description of Artificial Sequence: Synthetic construct
ctccdccd

SEQ ID NO: 204 - DNA, 9 bp, Artificial Sequence
  Description of Artificial Sequence: Synthetic construct
hkcmrmckm

SEQ ID NO: 205 - DNA, 11 bp, Artificial Sequence
  Description of Artificial Sequence: Synthetic construct
  modified_base (8)..(9): a, c, t or g
sacgtggnnvw

SEQ ID NO: 206 - DNA, 9 bp, Artificial Sequence
  Description of Artificial Sequence: Synthetic construct
araragarr

SEQ ID NO: 207 - DNA, 9 bp, Artificial Sequence
  Description of Artificial Sequence: Synthetic construct
cahcamcah

SEQ ID NO: 208 - DNA, 9 bp, Artificial Sequence
  Description of Artificial Sequence: Synthetic construct
raacccwar

SEQ ID NO: 209 - DNA, 8 bp, Artificial Sequence
  Description of Artificial Sequence: Synthetic construct
  modified_base (2)..(2): a, c, t or g
  modified_base (7)..(7): a, c, t or g
gnatatnc

SEQ ID NO: 210 - DNA, 4041 bp, Oryza sativa
tagtaaacaaatcttgggattgtcagcaagtgccaagtccacgtagaggaaaatcttccaaaatatatcgtgggtcatcagatgagagattctcgcacaaaacatgcttacgtgtcaaacgaggcacgctacgaaaaaagaggaagctgaccaatcgacggcccctccgtggccacatgtttttgcccgcttttccaaaaaaaattccgttccgttttacggtgcccgtttaccttggccctcaagttagctggaaacacaaaatccttccaattctgtcgtggggcctctcacgataatttcagcattaagtactttatttattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcagtgtgatggggtgggggataggcgcgtgagggagaggaatgggtggaggagtgggaggggattaaatatcggcggaggagacgagcccaaccccttttgctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcaggtgcgtccgggtgccccttccccaccgtgaaatttttcatctttggcgaggtttacgccgatctggagtggatttgaccgggtttcgcggccggttcgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctaccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggtcatgtcgtcgcattgcaactcgtctcgtctgtatgcattttactctgctggtttaatgttgagattgtgtagttaatgagctgttaccctgagattcctgcactgaggatgtgcagctaattttatgagtttgactaatgaggctagatattttacctatgctgtgatcgtgcagctggttgttttggacgctggtgggcagatcgtgcggtttttttttacaggtgctggtatacaagatgcggctagatccgatacgcatgcgtacaagctgctagacaaagtccgggttcagtgttagctgtgagcagtgatgcgttttgtttatgtggagagagcttggtcgttgcacggtggtgcgtactaaaagtattttcagaggttgtgacctgttagagagggactgagcgagtatactagtattagtacagtagtagtgagctgagccgcctgagatttttattgcgagacttgagcatattggagaatggagagagtatcaagcaagttggccataggcatcgaccgagtgagtgagagagtgctcactcctttcttcgtttataggtgcacttttgtgaaggcggcgtgggggagagtaggccgcgacaggtggttcgctcgccctgtgccaaacaaaactgagccccacgtgacaaggtacagcaaatgcgtacccagctcacggctgggagcagtagcatttggtgtgagtcacggaggtgtgggcgtgagtcacctcgcagtcgcaggccagccgctgcttgtctcgttttggcgcggcgcgcggcgacgcgagacggctggccggctggggccatggtttttcccccgcgggggcgtgtggtgctgtgtggtgtggcgccgcgcgcgcgggtggtgataaggttcccgatgagaccgcggctcaccagggcaaatcccgcgcgtggtcacgccccgcgcgcgtccgcgcgtcctatccccggccgcgaaa

SEQ ID NO: 211 - DNA, 3122 bp, Oryza sativa
gcactcgcgttcggacgcttttccccgcgcgcccccggcggccggcggaagcatctcgttggttgcccagccgtttcatttcccaccagccaccattagggctccctgcaaaagcagagtttcactacataagacctgttgtttagttcccaactttttctttaaatttttaactttttcatcacatcaaaactttttcacacacataaatttttaacttttccgtcacatcgtttcaatttcaatcaaacattcaattttagcgtgaactaaatacaccctaaatttgattagtttaggtttcaattgattttttccttaaaaatataattaatcacttactccttccgtcctaaaatataagaatcttttattcaaattttctatcacgatacacataatattatattgattcatatgattatcattatttcaataatgctaaaaccaatcaaaagcctagaaagggaatctatgcaattcaaaatttaaaaattaacaagttgaaacaactaaaaataaagcattttagctaaccttaatattttttaaataggctaaaaatcgttatattttgaaacacacttctttcgttaaaaaaaacaatcctgaagcggcgatagggaacggaaggagtatattttcggacggaggggtaatttcacataacaagctttgtggcatgctatacagtcccactagcgtgacagccaaaaattttaccgtaaaacaccataaatcatggggactgagatgcaaaactgaccctaacagctgccatacgtttccaaaattggtgcagttgtagtggccaaaacggaaaagcgctcgcctaattttaatgccgcctcgctaaagacgaggggcggcggcaaggagaggacagtcaaaccgctcgctgactgcgccgagttttattccctaccgccgctccaccactcgcttccctttttcccagctgcgttttttttaacccctcgcccttctataaatacggcctcccctgtctctccttatcctagacgccacacacacccaaacccaacctcccaaaacacccacccggtttaccagagatccgcgcccgccacttgtaaacctgctgcacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcggctgctgtgactgcagtcgccggcaccggcgttcgctttcctttcagaggatatcccgttgcacgtccagcaacgcatccttactttttctatgagcaggctgcagcggctgccgcagctgaggctggataccgtatgatgaagcttgcaccgccggtcaccgtggcggcggttgcacaaagtgactccgactcctcgtcggtggttgatctcgcgccgtcacctccagcggttacggcgaacaaggcggcagctttcgatctggatctgaaccggccgccgccggtagagaactagctcaggatgggttagctgacgactttgtagtttctctcttattttcttctttgatggatatttctctccgatgttttggtcctctgtgtttttgtttagtagcctgtgagagacggaagagccttgtaaatagtttttctgccgagggcgaaattcatcttgggatctgttaattagaacagatcatgccggcgatgagatggactaaaccgtggagtgtatgtattcctttatattagtatgaagaaattattcagaaagtcacaaaaatatctgtgcacactgagtttgattgacgtttttatttttggtctttcgatccaaaaggtaagatgcatggttgagaaacatacgctctcatttattagcgccggtgcgtttttgccgtccatcatagtgagagtactcgcaggagtagtagtttgttgccatctatgcgacacgacgattaatggctatgcaaatgacgcatttcattggacgaatgctactactcaaacagggcttgtttaacgctccttcacttttcatcttttgacggttggcagggtagaggcgcgccataaagttactgcaatgtgtttctagtcgaaaacaacagctcagcgctgcacaaattccgttcctagcagtacaattgcggcgaagaattattatcaaatcgttcacattactgacacgcggtatagagacggtggtggttagccggagatctaatccatgaaaagcaacgtaaatagtggctgtacaggcagtgggcatggaaggagacaagtgtggatgggggagcgccttgtgcggtggggtgcctgcatctttcgctagcaccgtcgatctattcgtacgatggaatcgcggctgcgttgttgttctcctcgtgaccttgagaataacgtgtgcgtgtgggcgacgtctccaggctacgtgtgcgcggctgccagccccccatccaggccgcggccggtgatcagcgcgcgctgctcggcctgtggcccgtgtgggtgtcgaggcttcggatggcgtggcgggctcgtagtgggcggtgcgggaggcgcgtgttcgggcgggcgcatggcgatatgcgcgaggaccgggcgtggtctcggccgacagacgtgggccagcggcgcgcgagggcgggcatctggaggcagtgattcgcgcggcggcagcttctcctcgccgtgggacccaccgcgcgcgccccgccttcggaagctttgccgctttccccgccttttactaccgctcgcttgtttgttctggcctgtactggtggtaggagtaccatttcttccggagga

SEQ ID NO: 212 - DNA, 3298 bp, Oryza sativa
ttaagttttgacatgatttatcttgatttcattttctttttgttatcaactgtttttacaaaatccaaagataccactcgtgagaggttttgatccaatatcaaaattgcgaatcccaactcccggagtggaatgaaatcatgcatcaataattccatcaaggtgctaaaggtgtgcattgtgctttcctataaatcattttttttgaacgaattataaatcattttttcaatcgatcactaatgtaccggaagtgttctcacctagacgctcaaaggcaactcgtcaccaagaaagccatcagagttaaacatgtagtcattccaagagagacggagtataacaaatatagtacctcatctgtctcaaaaaagaaattttacatggatgtgatagtatttgctagtactaggaagtgttatatcccttcaaaatctcttatactccctccgtttctaaatatttgataccgttgactttttagcacatgtttgaccattcatcttataagaaaaaacttttgtgaaatatgaaaaactatatgtatacataaaagtatttaataataaatcaaatgataggaaaagaattaataattacttaaattttttaaataagacgaacggtcaaacatatttaaaataatcaacggcgtcgaatatttagaaagtagtatttagcaatagcttagtgcattggctttaatgaacagattcgatgaaaaacaattcacaaacaagtgcgttttccagatgtcccatattgatgacaaacccgcacacccatgaattgagtcccaagagttcatcgcagacttgcaatgaaacctgccactaacatcgaggcagttcaatcgcaaaaaaacaacgcggctgcagaggtcctcaaaacccgtggtgattctcacccagtcgctctcacccattcgcattctccccgcactattccccgccttgtttccctctttccacgtcgcgagaggcctctgcgccccatccgctcatcataaaaacccaccactcccactgctttccctcccacctcaccacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgcccccgccgccggacgccgctgacgacgcgctgttcgacctccccgacctcctcctcgacctcagatacggcccgcccagctcgggcctctcgtgcgcgtcgtcttgggaagacgaagtgggcttaatctccggcgccggtgccgccgccgccggcgtgttccgcctggaggagccacttctgtgggagtactaaaagccaaagcgccgccggtaaaacactcgtcagtgctaaaatcgagcagcctgcatgtacaacccgtaattttccacgcatgaccaaaagaattcatgcatgcaagccagctacggcctacggcgcacagaaacttgagccaaaaaatcagcgtcgttttgtcctgcgtttgcgtcgccaaatttgggaagcagaccatgtataaaaaatcatccttcttttccttcagtctctccttcctttgcttggattgtggggcaagaatatgtgtccggttaattaatttatcagcgcatctccttttcctccgggggtcatcctatattttttctatctttagcgggtagtgctaaaggtgatgatctacccgggatttggacctaatgtgacacgaaagaaagtctctaaataaagatcgatgctgcatgcatttgcccgcacctttgaaattacggcaaggttcgatcgatccgggcccctccacttcgtcccatcccaaagcgcgaacaatcacggcagttgtaattaaccttgttccggcacagacagagagagccagtcacttcctttctctctgcagccgcacggaaacaaaaacacaacggataattcgatctgcggcgtgtgcgagaaacgcacgaaagatgggggtgtagtacgctgaggcgtacgttgacgcggacggccatgcgtggcgccacgccccgcaccggccgggacacggacatgcaggcagcgtcgcagcgaggacagcggggtggttgcgcgcataaatatggccgggccgcgcggacagtgagacgacgggcgacgccgcgcgcgggggggataaggcgagatcccatcgcccaatcgatcgatcggtgaagccaacgcccctgtactcgcgaccctgatctccctccgtctccgcccatgtcgtaacgcattcgtcatttcgtcttgggcttgtttttagggatgcttcagctttataccagctcgagttttttttcccaaaattaaaagaatttttagatatatttgtgtgttcttagaattttaaactctttcaaacagaagcttggactcgtggtgcgtagctgtgtgactgtgttgatacatgcgcacgagcaagggcatggaggtgatgcggtgatgctgctactactgttctgggggaacggagggatgggagtcgttatttttcttcaaagggacctcgttttcatgtgatacgtactatacgcgcgcgcgtgcctactcttctggggggaacggagggatgggagtcaagatgggttgcttgtggtcatccgtgttaccggtagtgggaagttgggatccttgtttcaggggttaactccggtgagcccgttgtttgtttctccttgagaatgaagcttctaaaccgcgtgctttaattcgtgattttcattgtcatggctgattaggtacgat

SEQ ID NO: 213 - DNA, 3019 bp, Oryza sativa
tgatgatctctggtttcagaattggtacaaagggctcattcagaaaagtcttgaaattcacgttgtcatcaacggaaaataggacggttggccgcttggcccaaatcacaccgtggggccatgagttgttgatctaatgaacttttttgaaaccttgatccaatgaactaggcactcgaatttgctaggggttaaggtataaaagtggttcggtgaaaatattttactcacgataaaggtagaacaacaagtaatttcaaacgaaagaaaaatctgtaggtttgaacccacaggtacaagttaaaaggatgtgcttgaacaactcatgcagttttaccgttcattttctgaatcttaatttttgtatccttagctctgaagaaatcaagaaaccgagttcaacctactttgtcctgtcgggctgtctctatccgggctgataagaaccgagggagtgtgacaaaacccaactggccaatccgcgtgttgattacatttccaaatccttggtcgacgctaacaaccattgtccatgtcgatgcttagctgatgaatcttgactttgtttgcatgtccttccaccaattaaggtgaagatctagcagatgagctgtaatagccatcacactgcttcatttctgaaagacaattcaagcagtaacaaattaatggcaaacttataactcctatgtacaccattgtactgtgtacaaacaactaaacgtattcggtaatttcagtaactaggtttctgaataatcatgccagttaattagtagtagtattgatgatgcatcttaggtcaccagctggcacgtcccattcggataattgcagtggctgactggctctgattaattaattgatgatcgatcgagcgcgccattacgcggtgagtgaccatgaacgagtctttatcaaattaaataggccattagctaattaacctaattagatggatatatccattatcccaaacagtatatctctctcttgattccttgagacttttgagggttcatagttcatacctgcaacaacaactgcgcgtaacacataccacacgcccaagtacgccctccccctctaaactgagatttgaggcccaaactaatgttattagcaagtagctgatgctagccgctccttgctataaatacatgtgctttgctagttagcttttgcacagatcaacaccggcaaccgactaactctgtctgaaggaagctaagattattaatcagtgagtagctagccatggctgaggagaagaagcaccaccacctgttccaccacaagaaggacggggaggaggagagctccggcgtggtggactacgacaaggagaagaagcaccacaagcacctcgagcagctcggcggcctcggcgccatcgccgccggcgcctacgctctcgtaagtcattaattagtacatttgaccaccactattacaagaaaatcgattttcgcagacgtatatgtcatcccccactttaactaacctatatgttttagccgcttggaaaaatcgattatgtagtggtgaactatgatctaatgataactacctagccatagctgattaattaagagataattaacggagaatttatttgtggtacgtcgttgcagcacgagaagcaccaggcgaagaaggacacggagaacgcgcacgggcacaaggtgaaggaggaggtggcggcggtggccgcgctgggcgccgcggggttcgccttccacgagcaccacgagaagaaggacgccaagaagcacgccgccgaccaatactagatcgatcccgatcgaatgaacgcaagaacgaacggtttatatgcttaattactttctccccataattacatgtatgcatgtggttgatggcttaatttgcttcttcttgttcgtcgtcatacgtcgtcgcttttacttcgtgttcatgtacattaattctgtatccgcactgagtattaaataagtgcgtttgtgctgcacacagaaattttggtttcgttttatttttcttctttgaaatgaagggcgtaagacacggctaagcttgtgaaatgtgcaatatctcacattctcacctaggctctccggcctattaatttgcatggttgagaacttagagatcaatcaatacggcgcgtgtcattctcaacggagtgaatttgcatgcatggcatggcgctaccgatactgactgttatggaatgttattttcgaacataaattcatttcttgtgaatcaattaagtcagagtagagataagatttatttctctttaagacacctctatatacaatgtataaggacagggtaagaaatttagttgcttctactcaagaacggatcaatacttaaaaaaagagctacaccccatatctatgtctcttcacaactcatgtaatgtttgtgagagcaaagagaaggacacggtctaatattgtaggagaaaaagaattcggtgatccactattaggcgtgttaatttaaacactgaccaggcacggtcggtggatcgattgtcgaacgatgggccggatggtgccagcaatgggcccctgtaatactaatgaataagccacacaacccacatatgagatgtgtttgagctaattcgtcttggcccaaaagagacaaaacccgccctttgatcttcagtaggtgtaagttcatgtaggtcccttaatttgacagcgagttcaatttttatccttcaaccaaaataccagatataatgggtcccccaaatattaaaaccggtgtaatatagattccatggcagtacagcgggtggttctgtctgacgtggcaatttgaacaagtcaacagtgctgagttagcatgggttccatgtatcagacctctttcacctctatccctatcttcctccctcgtttccatctcagcggcggccggtgaggaggacggcggccagtggcgggtagtgaggcgaagagaagatgagaggaacaacatgtcaccggcatcaacgttgggatgcagtcggtgc

SEQ ID NO: 214 - DNA, 3019 bp, Oryza sativa; identical to SEQ ID NO: 213

SEQ ID NO: 215 - DNA, 2966 bp, Oryza sativa
ttccatgaggttagacctcatgttaaaaatccttcaaaacttatatggattaagacatttcttattagaaagttttcaatccatggtttcaaagggctgtatagaaaaaaaaacctacaaaataaaaatgctacaaaattccaataatacttttccttcaaatcaaaggaggtcataagtttcttatttattgtatgcctatggcagagatcgtagagataaacaattttcattattggaaagaaaatgcttaattagttgagctgctaccttcgacttcgcgcggctttatccggtgcggattcgatcctcgttcacgcaaacaaatatcccgtcccggttcatccgcacacgctctatcagcgacttgcactacactactcatctgccgacacaagacaaaaaaacccatgtggggcccacatcaacccaagtagtgtagtggtcggtgggcctgcacaccgtccattgtccgctcgcggcgtacgtgtacgtggatcggtggtactacgtctccatcgatacattttttatttttgcccaatgcccatctctctctctcaggacgaattaatcaataataataatgcagatggccatttcctttcatgattatatatattgttctctccgttctaaaatataagcatttttagtatagtaccaaatcaatcatttttaacattaattattaatagaaaaaaataaaaaaagatcaaccatgtaaaattaatattattagattttatcattaattaaactattataatatgtaactctttttatttaaaacattttatttttatagatatggttagttaaagtagcatcttaaagactacgtgaaaatctaaaaatgattatattttggaacgaagagattattaattaatccaagttaacaccggattagttactactccagtaagctagctttacgcctacggttactttagctctttaacggtggcctccgcctataaaagcaggccagtaggacgccaataagcaagcaagcaaagccacatcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctggtaattaactaattaattaaccactaattaattgatctaacgccgccttaattaatcaattaatttgctaagaaatcatcaagaagtaattaattaagctgattaatcgtggtgtgtagtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccattctatttgaaaaaccattaaagttgagtagattttagtgtgttaaattatatcgagaactacagaagtgctataggaatctatcagaaagataaccatctcttggggacaatcaattctccataagaggaggcaagataatcgaacaagaacgcgcatcgaaagatcaggattaattcatgtttaacgaacacaaataaaaatatcacacatatggtattcataattaaagtggttggtagttgaaattttgcactcaaattaaagattttaaagaaaaatcaaattaaagttgatagtgataagtggttgcattggaaaccacatggatccaatgttgacactgatgtaggagaatgcatttcctaaaaaaaattccttggaaaacaaatgttgtcttttttttctaaaaaaaaattgtttgtctgttggagtagtaaaatgccacaaccaaagctattttgctaaccaacaagtattacactcgcaaataaaaaaaaaagactaaggacagcaacatacgacaggtagagattttgctgagtagcaggcacaatgtaaaaaatttagtgaagagataagagcgggtgcgcatgggtaaaaatgttcacatatcaaatgggatcaacttttcttgctgtcatcttcataaacaaatcactaaatttatttttttcttaaggaaaataaagtcgcagctttttttctctactgactcatcctcttctttcccctcctccacacgcgcaatgcttacttcgcatgagtaatcaccagatgcaatgatttattttcaatcaccctcgctagtccaattcggggagcgcaatgcttacttcgcatgggtaatcaccagatgcaatgatttattttcaatcaccctcgctagtccaaatcgggggtggaaataggcgtggggcagttagggcttgagcttaatacctagctccataattctcattataatcttgaaaaatgttatgtaatatatgaaaatatttga

SEQ ID NO: 216 - DNA, 6737 bp, Oryza sativa
gtttagacttttggagggagagggagagggaggaaggaaaagcgcgcaataatgctgcgatggatctgccgcaaagcctccggagttggtggagcaacaggctgtaactctgtgtacgtggggccgtagcaaagtgcgtatgcactcgctggctttggctttgttgcccgtctcggaagcaggcgtagtcgggggtacgctttgcacggagcacacacggcagcatctcgtctttgtgtgtgccccgtgctgtgctatgctatgctattccgttagcgttaggcttttggagatggctcgcgtggtctcgcatctcccggcagaagcaagcggggcatgtgcggccgtccggccgggatcgcgccgcgcgggccaagcaagtttagcgtcgcgcgcgctcgtgacgagtcgtggaccagttgttaggtcgtcggacgtacgggggttcggttggtggtgaatagatagatagtgcgcgcttcggccggtccccgactccccccgagtgaggcgtgttatagctatccatgtactgtatatgtgcctatctagaatgcttctagctggcgcgtcgtgctgcgtgcgttcctgccgaccaccggatcggaagaagggaagctacaggagaaaggcatgttgcgtttcgtggcaccggcacagattgtaactctccatccgtttgtgcgttctggactttgcgtgtggtctggtggctggtcccgatgaaccaggcgattagtcgtgcacgtgaaacgcgatagccccagacctgacggagagcgactctgcagataggccgaaccacaacgccgcagcccgcacgttcgccgcaatccagttcctggcccaactaaaacggcccacacataaaccacaatcccgtgacggcccgaataaaacgggccgcacgtccgccctaacagccatttgagcccaactgtaatgggctgcacgacgaggctatccagcccggcctacgaggctgcgcgtcaccgcggcagaggagtcggcggtgcgggggagacggcacggcagattcacgcgaaggggcgacctcctcgcgtacggtttttccccttgcgagatccatctccggctccggcgccggcgcgcgcgcgaggcgtggaggtggggtgggggaggggggaatgggttggggcgcggtggtgtacggtggcggcgtggtgggggcgtcgctggtggggctcggctgggcggggctgtggttcctcaaccggcggctgtacaaggagtacgaggagcggcgggcgctggtgcagatcctcttcggcctcgtcttcgccttctcctgcaacctcttccagctcgtcctcttcgagatcctccccgtcctctccaagcacgcccgcttcctcaactggcacctcgacctcttctgcctcatcctcctcctcgtcttcgtcctcccctactaccactgctacctgctgctgcgcaactcaggtgcccgcctgcccatcccgaatcccctgtctcctcaattggctcatcggtttttttttttgcgttccgtggttggtctgatcggctgatcgttttggggggcttcgcaggggtgcggagggagcgggctctgctcgtcgcggcgctgttcctgctggtcttcctctatggcttctggcgcatggggattcatttccccatgccttctccggaaaaaggtatggtgttgcaatcatggcgacggttgctactctcaatactagcggattgagcttagccgcagtaacttacgatattggcctcagaggccctcattgacttcacgactggactaccttgtgattgggttcgattggcttgcgcattttgtagggtttttcacgatgccccagttggttagtaggattggcgtgattggagtaagtgtcatggctgttctttctggttttggtgccgtcaatctgccttacagctatctgtcactgtttatcaggtttgaactttgatatacctataagctgatctctctcaaaagttgtatttccacacagtgtgctttgatttcagtttaattctatgctatgcgtgccaatcctggcttacagggaaattgatgaaaaggacatcaaaacattggaaaggcagctcatgcaatccatggagacatgcatcgctaagaaaaagaaaattgttctgtccaaaatggagatggagaggattcaaggatcagaagaggtgtgcttactattcaaatggatgtgaattaaaataactgttggattgcaagcatggaagtttgctctcattgcaaaatgtacagatatttagctatgcagtcatattttgttgcctgtacttgcatctagtaggattgaatagataagacactgttcaattaataagaagtactaaatgcatatgattgtactatgcagaattgtctgcatgtggcgagattgatgggatagggatctgttctatcaataagcaatgcaaaatatactatcacattaactcaacaaaatgtcatcttggaagtagaatggtctattattatgttgatgtttaccctttgtggcttgactgaatacaaaatttaatacttgcagaagctaaaagccagatcatttctaaagcgtatcgttgggacagttgttcgatctgtgcaagaagatcaaactgagcagggtatgttgtatttattttctttctgtttttgtttggtacaccatttcacttgtcagtcatatgcatgaagccctatttgtttcttggaagatatcaaaagcttggatgcagaggtccaggcactagaagaactttccaaacaactatttcttgagatatatgaactccgtcaagcaaaggtatactttttgcacctttcatcacaatgttaagattgaaaacgaaaacgattggcaggacatacccctctactttcttaaccttgtgctgtttagttctatgattgtgatggggttgccatcattgctttattgtggtgttggctacttaacattgatttggttagatagtaagagaactgttactctatcccaacaaatcggatcagccgcataaatgttacaccacttgctaaagttcattggttattgtaccttacaattgaatattgtgaatatttctccctatagattagcataacttccttccattatggtgatttctgatgtattggctgatgttttcatttcattttcgcattaaggcactgacatatatctgagaacttataatttctgggagaatcattcaataagattgcatttctttttggttacatacattttaattatgcggactcttatatcctgtacatcattttactgcagtaatgggtctcctttttttctttctttagagttttctatatgcacaatttctcgatgcttctttgaatatatgagctaaacttttctacaccgttcttttcatttttccagatagctgctgcgttttctcgaacttggagaggccatgctcagaatctactaggatatgctttgtcagtgtattgtgtttataagatgctcaaggtattactaaatgtggcatatttttttggtccatgcatttcaccaattccacatacctatatgtagccctgacaagaccacaaagctagaactacagaaatagttgattaatcaattcattcgtcatgtcattaaaaagattgtgtggcttccatatgctggttgccaagtgttacagttttgttttgtgagattgtgttctattctttactcaattgtaatcaaccttgtggacagtatcttacatttctttttcttgattttgcttcagtccttgcagagtgttgtctttaaagaggtaaaatcacttctttccttcgtcaaactcaaaccaattgcttgtttcttttttcctaattctggaaatttccattgttaacctacatactatttcccccctttccaggcaggttctgttgatccagtaaccatgacaattaccatcttcttgaggcattttgacattggtattgatgtcactcttttatcacaggtacacatgctaaaattaaaaggtgaacaattccagaatcgagaataaattcattattactctgaactgcagttctctgtacatttgatgttaattggaaccgctatgtaagttgtaagcaattttcaaaattcccataaaataggtatacagatattttttggcatgtcctttgcgttttggctctttccataaagtaccatatgtagattaaacattaattttgaggtgctttgaattggcttggtttgactttcatgcaacctggttacctcctttcctttttgcttctttgttcatgttctatagcttacatgtgtcctgcctgttcactttttgttgcagtatatatctctcatatttatcgggatgttggttgtcatatctgttcgaggtttcttggcaaatgttatgaaggtgagttatttctttcagttatctatacatacagctgttagttgttactgtacccttgttaatagagcattagaacgcaattctatggtgtctcactttctatgcagttcttctttgctgtttctagagttgggagtggttcaacaaccaatgttgtcctttttctatctgagatcatgggaatgtacttcatatcatctattcttctcataaggaaaagcctggcaaatgagtataggtatatctctattgcttgagggtgtctttccctatatccaaactgatgttcgttcatataaatggtttttattctccatttgcgtttatatgatcctaaagttgctgaggtatacacaaagttatggaacataactcctttgtttagaatctgcctctgttgggaattggaaaacacaaatatttatgtgaaggttttgaagataacaatgaatagtgactgttgactgaaaatggagctatgcaacttaatcttctgtgcattgtgtttggtagtacttgtaatttatatcacaaaagcattctattgtcgacattgatgttttaaatgcctgtttgcacagggtgatcattacagatgttttgggtggtgatatccagtttgacttttaccaccgctggtttgatgctatatttgtggctagtgcatttctgtccttgcttctgatttctgcccaatacacctcccggcaaacagacaagcacccaattgattgatgcttttgtaccatttgtgcatagtgttcttttaaccactttgtccaaggtatgtgcctctcctttttcctgcactaattgaatgatccgactttggctgatatatttgtgtttgtttgttcaggttgacccattcattctaccagtttccaaaggttgtcgtttctccatggacttccatatacagttacagaacataatacatcagttaacttgaaggtgtctccttgttttggagtatgtttcctgacgttgaatcatggtgaaacagtttctccatatgcaagtcattaggaatgctttgcatcgtgatgatgcagaactgcaaatggggccggttgtaatgttgtgtccacatgataattgttttttgaagacaagaggatgtcctttcttaggaatgaagtattgactatgtaaaatagcttgagaatagcgttgctagcatgatatgaagtcggtgtatctcccacaattcttttttggctattactactacatgtgtagtgtaacatttgcccaacttcaaaaggtagatattattcatgtgacagcaatctcttcgttagtactctctccatcaaaaaaaaaaaagtactctctctatcataaaaaaaaaactagtacaatgaatctggataatcttttgtccaaatcgttatactaggaggggtcacatgttagttttttttgggacagtttgtttcttctgcagtactttgaagtgatttcttggataattttgttatactgatgatgtcttattcatcataatcccttgcctcaataatcatacttctagactgaaatgcagatggactgtcgtttgtgggagtttgtccctgcttgctaccactggagtcctcctgcttcctgctgctagccaaaagtcacgaaaacaaagaccggttctcccaatgcatacaagtgctatcgattggttgtttcttattgtgaaaaataccgcccaaaaagacgggagcacttgaatttgttctcttacggccatctcttttgcacgtaatggattctgccacgattcaaagatggggcgtctccagtttccacttatagacccgtcaaaccgcggcgagacgatcaagcaagtaccagtgtacggtgtaccagaggcgcatgacaaccgaagcattccatcgctgcgcaccaactgcggcatgcctggcagagcgtacgtacaaacacgccgccaaagcccgtgccgggcaccgcgcgcgtagcacagtactcggactcaggacggagtacgtggtggctctggaccgcactagcgcctgtctccccgcgctgcgccgctgcccgtgccgcggcagtgccgaccggccgatgcgctcagctttgccacacatgagacacgcccggggccgccggcatcgcgagccgcagagacaaacctgaacattgctcccatcgatcgcgagtacgtccgtacacgcccaagctgcgcacgcagcatgctgcgggctgtgtggctgctgcacggtcgcgtgcatgcatgcatgcatgcaacacgtacgtgtcctttggtacgtgcgacggtgtgagtcttt

SEQ ID NO: 217 - DNA, 6615 bp, Oryza sativa
ctgaatatacaaacttcaaacctgcagtcttacttttcaaactgcattttaacgttttgtccccctctgaatacatacaatcctgaccaacctatgtacatactcccttgacttgacttcaagactatttggccaaaaaaatagtatacattagcctttgtacggtcgaacattgcctataattattttgggtgttaattttcggaaacaaaccctacctttttgccgcgcatttcatgggatttaatgctgcttttgccctcactgatgaagcaagcaaaattaaattgtcaacattcaatcgacttgtgcaggggacacaacaccgactggcttccccacaagccgcttgctttctaaagccatgaagatcacccccatcaaccaacaccagtaccacagaaagccacaaataacatttattagagcacacaattaggacatgtttagttgccagccacagcttagcacaatttaccatatctagagttagacaagtttgataaatacagatactaactgtttggttgcattcgtaattgtggtaaaattccttttcaacaaattagatcgcacgtggtaataataactaaaaagagaggcaaaattctatctacgatatgaccaagattttaagcacataaccttaggtaagtttgataatttctattgataaaaaggtagcaacctgtagttgccaatcaaacatgtcttacggcctgtttggtggaacttaaaattctgagaagtagttggttgatagccagcttctgaggatctggaaaagctgggttttccagtttctggctttagttcattttctggattctagaactacagcttctcaaaatctggaccaaaagatgtactgtttgtgagagcttctgattatgggagaagacgcagccgcacaaattaagttaagtagttgacaactaagtcaagattttaatctcaaccatagatttacaaagccaagatacacatcaagattggtgcgattgagaccaaaagcatggtgtacatgctccacatgagtgtagcattgcaaattgtttgcaatttgacaatagaaatacttgatcatagccaaagggcagctgcacactagagactagagtagctaagctcccattgtcagtgccacacccaattttcttctcccttcttccctccccccaatgcacccccttgtctctctctctctctacacacacatcaccaattgaatagagagagaagaagcaaaactttgttaaattgtgttggggagaagcccaatgcattgaagcaagcacccacatttcaccatgacaccaccaccaccactatccatctggagcaagcaaccaagcaccaagacacaagcaaacagctcaacctgttgagtgttttgaggaggaaaagagagagagagtagctagagagagagagagagagagagagagagagaaacaaggtgtttgttttcactcttgaaccatggtgagtgagtgaagagtgagagtgaagttcatagagatcatcacctctcttgaaccaagcaagcttggttagcatagtgtattgtgcactgccccaagcaagcacagcacgatttttgatgcagctgccattgccaccattgttgccaagccccatgcacttccttctcctcttactccacctcctctccttctcctcctccaccgccgcctcggcttcatcggaggtcgccttcctgacgcaatggctcaacaccacggcggcgcggccgccggactggtcgccgtcggcgtcgtcgccgtgcaagtggtcgcacgtcggctgcgatgccgccacggggagcgtcacctccgtcacgttccagtcggtgcacctcgccgcgccgctcccccccggcatctgcgccgcgctcccgtcgctcgcgtcgctcgtcgtctccgacgccaacctcaccggcggcgtccccgacgacctccacctgtgccgccgcctcgccgtgctcgacctcagcggcaactcgctctccggccccatcccggcctcgctcgggaacgcgacggccatggcgtcgctggcgctcaactccaaccagctctcgggcccaatcccggcgtcgctcggcaacctcgccgcgtcgctcagggacctcctgctcttcgacaaccgcctctccggcgagctcccggcgtcgctcggcgagctgcggctgctcgagtcgctgcgcgccggcggcaaccgtgacctcggcggcgagatcccggagtcgttctcgaggctctccaacctcgtcgtgctcggcctcgccgacaccaagatctccggcgcgctcccggcgtcgctggggcggctccagagcttgcagacgctgtccatctacacgacgatgctgtccggctccatcccggcggagctcgccggctgcggcaacctcaccaacgtctacctctacgagaactcgctctccggcccgctcccgccgtcgctgggcgcgctgccgcggctgcagaagctgctgctatggcagaactcgctgacggggcccatcccggacaccttcggcaacctcacctccctcgtctccctcgacctctccatcaacgccatctccggcgccatcccggcgtcgctcggccgcctcccggcgctgcaggacctcatgctcagcgacaacaacctcacggggaccatcccgccggcgctggcgaacgcgacgtcgctcgtccagctccagctcgacaccaacgccatctccggcctcatcccgccggagctcggccgcctcgccgcgctgcaggtggtgttcgcgtggcagaaccagctcgagggctccatcccggcgtcgctcgccggcctcgccaacctccaggcgctcgacctctcgcacaaccacctcaccggcgccattccccccgggatcttcttgctccgcaacctcaccaagctgctcctcctctccaacgacctctccggcgtcatcccgccggagatcggcaaggcggcgagcctcgtgcggctgcggctaggaggaaaccggctcgccgggacgatcccggcggcggtggccgggatgaggagcatcaacttcctcgacctcggcagcaaccgcctcgccggcggcgtccccgccgagctcggcaactgctcgcagctccagatgctcgacctcagcaacaacacgctcaccggcgcgctgccggagtcgctcgccggcgtccgcggcctgcaggagatcgacgtgtcacacaaccagctcaccggcggcgtccccgacgcgttcgggaggctggaggcgctcagccgcctcgtcctcagcggcaactcgctctccggcgccatcccggcggcgctgggaaagtgccgcaacctcgagctcctcgacctcagcgacaacgccctctccggccgcatccccgacgaactctgcgccattgatggcctcgacatcgcgctcaacctcagccggaacgggctcaccgggccgatcccggcgaggatctcggcgctgagcaagctctcggtgctcgacctgtcgtacaacgcgctcgacggcggcctcgcgccgctcgccggcctcgacaacctcgtcacgctcaacgtgtccaacaacaacttcaccggctacctcccggacacgaagctgttccggcagctgtcgacgtcgtgcctcgccggcaactccgggctctgcaccaagggcggcgacgtgtgcttcgtcagcatcgacgccagcgggaggccggtgatgagcgccgacgaggaggaggtgcagcggatgcaccggctcaagctcgccatcgcgctgctggtgacggcgacggtggcgatggtgctgggcatggtcgggatcctacgggcgcgcgggatgggcatcgtcggcgggaagggcgggcacggcggcgggagcagcgactcggagtccggcggcgacctggcgtggccgtggcagttcacgccgttccagaagctgagcttcagcgtcgagcaggtggtgcgcaacctcgtcgacgccaacatcatcggcaagggctgctccggcgtggtgtaccgcgtcggcctcgacaccggcgaggtcatcgccgtcaagaagctctggccaagcacccgcaacggcgccgacaaggacgacgtcgccggcggcgggcgcgtccgcgactcgttctcggcggaggtgaggacgctggggtgcatccggcacaagaacatcgtgaggttcctcggctgctgctggaacaagacgacacggctgctcatgtacgactacatggcgaacggtagcctgggtgctgtgctccacgagcgccgccatggcggccatggcggcggcggcgcgcagctggagtgggatgtgaggtacaggatcgtgctcggtgcggcgcaggggctcgcgtacctgcaccacgactgcgtgccgccgatcgtgcaccgcgacatcaaggccaacaacatcctcatcgggctcgacttcgaggcctacatcgccgacttcggcctcgccaagctcgtcgacgacggcgactttggccgctcgtccaacaccgtcgccggatcatatggctacatcgccccaggtaagttttttctttaagataatggaagctttatcgaaacttattcaattacatcaagatggtacaaccaattgagcccactccgcttaaaattcacgcaaccaaaaaggacaaaccacccatcttaagcacaaatgttgaacagaatcatatagttcagtggctttcaatactatgtcacaaaagttacttcaatctttcaccttctgattaacaaacattgcagagtacgggtacatgatgaagataacggagaaaagcgacgtgtacagctacggggtggtggtgctggaggtgctcaccgggaagcagcccatcgaccccaccatccccgacggccagcacgtcgtcgactgggtccgccgccggaagggcgccgccgacgtgctcgacccggcgctgcgcggccgctccgacgccgaggtcgacgagatgctgcaggtcatgggcgtcgccctcctctgcgtcgccccttcccccgacgaccgccccgccatgaaggacgtcgccgccatgctcaacgagatccgcctcgaccgcgacgactacgccaacgtcgacctcctcctcaagtccggcgccgccgccgcctcgccgcctcgcgccgccgccgccgccacgtcgacgtcgtcgagcacgccgccgagcagcagcagcttctccggctcatccgccatgatctacaactcatcatccaaggccaagtcgccattcgattgaaaccaccatataactctgaacagaaaacataagaaaaatgtttgtgccttcttgggcttgtttgatgatcttacatgtgtttgtggtggagaatttgatgcgagtttgttgtgaatttgtgatggtaggtggtgagctgtgtaaatgaatggggggaagaggaggagaaggataggctgtttgaattcgtttctttttgttttgtttttggagagtagaagtagatggagctgaggaattaggaagaactagaacctgcagaagcaaaaagcttgatggctttgttttgttagtgttcagtgtatgcctgttgaataaagatccaagattaccttacattcctaatctggctatgcagatgctcaggattattgttccacttcagattaatcaagaatggttatccaatacatgtagaattagtttcacatctgtaggaaatgcagttccagggttttgttcttcagcagtcagttcggaacctctgaagtgaaatcctgttacttcagtggtccaagtctacagatagctcaattgaatgattcaaaaaatggctagacatttcaattttgaaacttggattcagagtttcaggttacctgaaacatacatactgtacatcccaagtccaaagcatgatcctgcgcggagtgcgggcggacaataattgaaagaattaacagctgaaattttcaacacataactaaattttgacagcaaattcgaaaagtcataactgattatgagggcctttcatgacaactcttttgccccagactcaagcctccatccctattgaccactggttggtgtaacatgtaccagtaaatattaagacctactccaggattcaacagagcaattatttttgagactctgacaattatgaaaactcagttgaaccatactgtataccctagtgaaaaaagttaccatgactggcctgctgctgttcattttcgtcagttaccctcatattgggcaatggtcataggctgggtttagtcagcgcaaagtttggattttggtttatattggagatgatgtgactgaaaagttgggtgtgtatgacaggttgatgcgatggaaaatgactgaagtttggatccaaactttggatataaacacagccataaactaatttccaagttaaccttacccatgaaacttggattatgagtttgaggttacctgaaacataaacttggactcagagtttcaagttagcaccagtcttgattctgggcaaaaaagatgtcatgacttattcttaatgaaaaatcgtgtggacggtcacccccccccacccaaccccaatcgagctcacgactaatgaaaaata

SEQ ID NO: 218 - DNA, 3395 bp, Oryza sativa
cagcgatactgcgatggcagaaataatctaagcaaaattcaaccttaactcaatgacgactacagaatatataggttatagggtatatcttggacccttggacacgtccctattatactacatcataatacacggcccaacaatcccaaagacggtgacgcggaacccgaacatattctgagccgcctcccgcccgctcctggccgccgcctcggcggcagcagtgagcagagcgcctccagcgccccgtgcacttggtggggagtggaagagaggagagagagaggagtggtggggaggggaggggaggggaggagaggaaaggcagagagagaggagtgatcgagggagaacaaaaggggaaaggaaaagagaaggtgaaaaatttgaagtgaaggagagggaaaaaaaggaagagatattttcgcgtgcggtccactggagaggtccgcacgtaaaaatcgatttttccgtacgggtctcttaaggatccgcgtgaaaatagaaggctaattttttatagacgaacatgaaagaggtccgtataggaaaatgggagctccttgtgtaggaaaatttttttgtgtactagtgacaatgaatttaacgggaaagctgacaaaaagaatatatgtataataagggtatagaaatctgttttaaaattatttaacctggactatggtgtaaaagcaagttttttttttgacaattcaaaagagttaagagttccattgattcagaacaagtatatggtacggcacgggctttttttttaaaaaaaaagtatggtacgacacgtattgttaagtttcgcaacaaagcaagcctattgcactgcagggcacgacaagcaagctactagctagctagaatgctctactagatcgttagctagcagccggctgcgacgtcgactcgacaatattctagacaaattaatgagcatatatatatcaggaggatcatatctgtgccaagataatatattgaacacaactcatcaagtgacaggtctcacacaccaacctcttggagaagacactagagagattaggcagccatggctgtgatgctagtgccaattccactactactcttgcaccagcaccacaaccatgagcatgagcatccatcgccggtagctccacagccaacaatggcatcctactacactctcctgctggcgctcctgtgccctcttctcctcctactcatcaaactttgccgggcgaaaaccagggacgacgagctgtttgacaagctcccctcgccgccaggaaggctccctgtgattggccaccttcacctcattggctccctcccgtatgtctccttccgtgaacttgccatcaagcacggccctgacctaatgcttctccgcctcggcaccgtcccgactctcgtggtgtcatccgctcgtgcggcgcaggccatcttgcggacgaatgaccacgtgttcgcgtcacggacctactctgccgtcaccgacatcctcttctatggctcgtcagatgtagcattctctccctatggcgagtattggcggcaagtcaagaagattgccaccacacacctcctcaccaacaagaaggttcgctcctacagcagggcaagacaacaggaggtgcgcctggtaatggccaggatcaacgaggcagcggtggcacgcactactgtcgatctgagtgagttgctcaattggtttaccaatgacatagtgtgtcacgccgtgtctggtaagttcttccgtgaagagggtcaaaaccaaatgttttgggaactaattcaggccaactcattgctactcggtggtttcaatcttgaggattacttccccaatttggcgagggtaactactgttaggaggttgctttgcgccaaggcccataatgtcaacaagagatgggaccaactgctcgacaagctcatcgatgatcatgccaccaaacggtcctcctcggtgctagacctagacaatgaagagagtgatttcatcgatgtccttctctccattcagcatgaatacggtctcactagagacaacgtcaaggcaatcttggtgatcatgttcgagggcggcacggacacggcgtacatagagcttgaatacgccatggccgagttgattcggaagccccaactaatggccaagctacaggccgaggttaggagtgtggtaccaagagggcaggagatagttactgaagagcaactgggaagaatgccctactaaaggcagtgataaaggagatgcttcggctacacctcgcagggccacttctcgtaccctacctctctattgctgaatgtgatatcgagggctacacaataccctctggcacacgtgtcttcgtcaatgcatgggctctgtccagagaccctagcttttgggaaaatgctgaagagttcataccagagaggtttctcaatagcatagcacctgactacaatgggaacaattttcatttcttgccattcggtagtgggcggaggatatgcccgggcataaattttgctattgccaccatcgagatcatgctagcaaaccttgtttaccgttttgattgggagataccggcagatcaggcggcaaagggaggcatcgatatgaccgaggcgtttggactgaccgtgcaccgaaggagaagctcctccttgttcctcggctcacacaagattaaatagtcaatctatatatcttatctaagtagttgtggtgatctcatttttcatcgtgtaagtggtgtgcttgttcactggtatctatttatctataataagagaaaaaaaatggaaattcccctatatgtggagcgtgtggtcctggactggaggcatgcagattcgacgagtcagcggttcacatctatatagatagtatcctctagtgcgttgcacggatcttaaagcacttggatggtggatgagcccggacactatggtgtccctaacaaatttaatatatataatgcacatagtaccaatttaatacgtacgctaatttaattagcactaatctttcatgataaattaggaagctacatatatacatatatataggacttatgcaaaatccgtttttttttcatttaataggttgttacattacaccatctttatcgtacatagtactccctccgtcccataataagtacaattgtgagtttcagcgttcaattttgaccatccgtcttatttgaaatatttttatgattactatttattagatgataaaatataaataatactttatgcgtgacttaacttttaatttattttcataaattctttaaataagatggacggtcaaacgttgggtacgaaaacttatggctgcacttacagtgagacggagggagtatatcattaagtggaactgtcctggcccagtt

SEQ ID NO: 219 - DNA, 3785 bp, Oryza sativa
aagtgggtttttatgtggatagcgggactacccacttgcatccctacttttaaccctccttcttaatctctctgactagctaagataacattctttttggggacagaacaaatatatgcaattgaattatttggaatgggaactataggctaaattcttgctgtttttcccaaatcttattcccttctcatgtggtggaattgagttactttatactacaaatcttattgttgcttcctttttagccatgctaaataattactcccttcgtttcgaaatgtttgacgccgttgactttttagcacatgtttgaccattcgtcttattcaaaaaatttaagtaattattaattcttttcctatcgtttgattcattgttaaatatatttttatgtaggcatataattttatatatttcacaaaagtttttgaataagacgaacggtcaaacatgtgctaaaaagttaacggtgtcaaatatttcgaaacggagggagtatatcccacaattggtggacaatttcttatgtacccggcctctctctctcaaaaaaaagagagattaatttctttccagaagtggctatctatttttggcatcttttcctaatataaatgttcttgcttaaaatattcacaaagtctctaaacacaagctagctcagtagctcactcttatgttgatctcacaccaatgaaccaaaaatctttagatatgaatgagatatcacacatcaacgatattttcaatatcgcaagtacactaaatttagctatccacacacaaaaaaaattatgttaccatggcccacctgtcatacaggtggtcaacatgagctgggggcaatgagcaggtgtacacgtgacgaaaatacaatgccagtgctgcgtggaagaattagtaattgtttaatatttagcgcacgtgtcccatgtgcgtcttcctcctccatacgcgtgtatataagccatggcctccttgactcccccctcccacacaacacaagctccacattttcctcctctcttcttcttcttcctccgatcgacgattcgctctctcgctctcgctcgatttccgtttctttgattattgttgtcgagtgtaactgatccgccatggaggtggagttgccatggggcgcgcggtgcgcggcggcggcgttcttcgtgtcctcgctgtgcgtggcggcgctcggcgtcgtgctcctgctcctcaggcggtggccgtggtgcggctgccatgtctgccgcgcctacctggccgggtcgtggaggagggagttcgccaacctcggcgactggtacgccgacctgctccgccgctcgccgacgggcaccgtccacgtccacgtcctcggctgcaccgtcacggcgaacccggcgaacgtggagtacatgctcaagacgcgcttcgacaacttccccaaggggaggccgttcgccgcgctcctcggcgacctcctcggcgacggcatcttcaacgtcgacggcgacgcgtggcgccaccagcggaagatggccagcctcgagctggggagcgtcgccgtgagatcctacgcgtacaagatcgtcgcccaggaggtggaggcccgcctcatgccggtgctcgccaacgccgccgacagcggcgccgtggtcgacctgcaggacgtgttccgccgcttcgccttcgacaccatctgcaagatctccttcggcctcgacccgggctgcctcgaccgggagatgcccgtgtcggagctcgccgacgcgttcgacgccgcgtcgcggctgtccgccatgcgtggcgcggcggcgtcgccgttgctgtggaagatgaagcggtttctcaacgtcgggtcggagagggagctcaagaaggccatcaagctcatcgacgggctcgcggcggcgatgatccgggagcgccggaagcttggcgtcgcgaacagccacgacctcctgtcccggttcatggcctcctccggcgacgacgcgcgcggcgccgccgacgacaagttcctccgcgacatcgtcgtcagcttcctcctcgccggccgggacacggtgtcctccgcgctcaccactctgttcatgatcctgtccaagaaccccgacgtggcggccgccatgcgcgcggaggccggcgccgccgccggcgagagcgccgccgtcagctacgagcacctgaagcggctgaactacacccacgccgtgctgtacgagaacatgcggctgttcccgccggtgcagttcgactccaagttctgcgccgccgccgacgtgctccccgacggcacctacgtcgacggcggcgcgcgcgtcatgtaccacccctacgccatgggccgcatgccgcgcatctggggcgccgactgcgacgcgttccggccggagcggtggctcaccggcgccggcggcgcgttcgtgccggagagcctcttcaagtacccggtgttccaggccggcctccgcgtgtgcctcggcaaggagctcgccatcaccgagatgaaggcggtcagcgtcgccgtcgtgagggcattcgacgtcgaggtcgtcggcgagaatggccggtgcggcggcggcgccgccgccgcgccaagattcgtgccggggctcaccgcgtccatcagcggtgggctcccagtgaagatcagacgcgtttagacttgcacacagcatagtagacagacttctttttcattcactgtatcaacaaattggataagaaattaaataggcatgtacatagaacaaaaaagggagaaatcaatataccaaatttttcatctattttatgttcactatgtttcacttttctatgaattttctgcaatttgatgttgatagaacttgaaatcacaaatttgtcagtcttgttactatgagctcaagtgctagtcagtctactacagtgttcacaagttagcccattggtatcttctgaaagataatctatcaggttttgctatatggaaatgggctggttggccttgtcgctgttccagaaattgagcagattcaatcatatatttcatttggcaggtttctttacttttacttcttctgaagccaaaccggccagctgctaggaaattctcctgaaaatccacctttatttttaagcacagtgaactaacactccctccgtcctattctaagtgcagtttgagcttctgtgttcaacgtttgatcgtccatcttatttaattttttttatgattactatttttattgttattagatgataaaacataaaagtactttatgcgcgatttttttaatattttcatttttcttaaaataagacggatgtttaaacgttggatattgaaacccacgactataatacttaaaatggaacggaaagagtatgtttattgaattgcctggtatataacacattcaaccctaaatacataaggtttgtcttcggtcaattccattccttcgtaacacagattttattttagagttaaaaatttgtcccgcaaaaactttatttttggagctatagacaatcaacctaatatgtatgtttttaattagagcctaggaaatactccctccatctatttttaataggcatatttttaaatatgacaaatttacttttgatagacatatttcaattcaaccacctaccatcttaatgactttcttagatttaatgcatgagtctctatttttccgcacaagattagctacatgggcatcgagaaatgtatatattaatgaaatcgcttgtttacaagaaatgtaaatattaatgaatcgcttgtttagttattcttgatcattgtg

SEQ ID NO: 220 - DNA, 5545 bp, Oryza sativa
cctacacatccctatccccatccaacgtgtacctgacgcctgacaccgtaatcctcatcctcgccctcacccagtaacggccggggccccacctcccggtgtgccttttcgtgctctgtggggcccactcgcattgccgactcatacgaaaaccgtttgctctcgcgccaccctatgggcaaccagccgctgactgttagtggattctagtagtagttgtttatctttgttctgttgtttcttatgaggcgagatcgatgaaagacaggttccatttagctgtgaatggtctggtccatgattgcattgaactatgcaggcagatattttccagctcacggcaagtgcgttcaaccaagttagctattccatcataaaaatgttaattacctccatcccaaaacactagttgttttgagtttttgtttgatccttcttcattttagaaaattataaaattattatttgttttatgtatgacactttattatcagaagtactttaaatatgattttatcattttctatatttgcactaacttttaaataagatgaactgtcaaacgttataagtaataagtcaaaacgacatctaatttgggatgtaggtagtatttttagagcaaattacgcttttggccacatatttgctctaagctttttcttgaaagtatgattccaagaaacaattcttatgttacattgttgagattaattgttctatactactttctctatctaaaatgaatccaattctacggatgaatttggatcaatatttatctaaattcatctataaaatttatttattttgtttgagacagtcggcatttgaatcatgtgccaaagagatgtcgttcacgccatcttggggggacaagcacaaacaaaagataggagaggaaacacagccgttaccgccatatttgaaggaggaaaaaaaaaactagagagagaaaaaaaaacgtgtttccccactataaaacgcggccgcacgcgcgcaagctcccctccctccttccctcccgccgttgccaaccacccccttcccctcccccctcgccctcgccgccggcggccgtctcgtcgtcggtgagacctagagagccaaacagcgcgttggttgttgagctcggagagggagagagagagagagagaggatggaattggagtcggagcagcacgggtaagcaagaaagagggaatcgatcatgtggttggctgcgagatttttattaccctctgattcgagagctttggttctggaaatctcatctcacctgtgtttgtttgcttgggcttttttgttttttttttgttttttttttctggcgggtgaagctgcgagcattacacgaggggatgcaggatcagggcgccgtgctgcggcgaggtgttcggctgcaggcattgccacaacgaggccaaggttggatggattcttctctcttcttccaatccatttcgcttttgaattttgattctgtttttctttttttgttggctcctattgaggagaggaaaatcgttcaaacggtactgatattggcttttgattatttgctgcagaattcgctcgagatccatctcaatgaccgtcacgagatcccccgccacgaaatcaagaaggtgtttgtttgttctcactcttctgtttgattttagcatcagctttcccttttgttttcaattcgtgtaagctttgatgcttgtcatacccaatttcatccgatataatccgtgtcaaatttatctgaattttgcttggacacacaacgcctgatagacaaaaaagaaaagaaaaaaatctgcggtcaatatttgatggcgtgtcgccggagagatcatacctcagttttcacaaacctatcaatttcttcagtccaaaattcaaaatccgattagtaattgccatttcagtctgatgctgatgcatgcctctggagccctggacaatgatgtttgggacccctgccatgaagtggccaagaatgcccccatcccaagaattttttttttcctttcctttccttctcccccccttcttcagataaggttgtctaattgtcttagtgctccatggggacagattcttcttgatattttccattccacaactcaacttgcacactaggttagtttctgctactagtgaccattgtctggtccacatgattgattgcttgcttgcttgcttatctccatgtgacaatgtcactagaaggatgacggcagaggaggaaagggaaatgacaaaggcatgtctcaccatcagccaagattaacttgagtgcggtcagctgattgattcctgaataattgagtagcagcacatgattgattcgtttatgtggcccaacaggtgtccatagctaacagtgcctcaaatagtcaaactgattgtgcaattatcacagcactaatttcctgggggaatctagtggataagaatttcaatggctgttacgcttttgtcattatcactaactttcttaaccagattgtggagttactgaaactgttttactttatggtgtatcacaggttatctgctctctctgcgacaaagaacaggatgtaagtagtttatagaaaggtgcaatagaatttctcgagtgtacaacagtagaatttctggattgtgctaacttttttttttctgtactgatcacatgaaaattgttcactttgatcgacaggtacaacagtactgttctggttgtggggcatgcatggggaaatacttctgcgaaaaatgcaacttctttgatgatgatgtaagcatgtttggattacaaatgatgattctacgttacatctaagtttctaatgtggcaagtatggttcataaatgtatgatgatgcttaacaacctgactaacatatttgtttggtttgttccaggtctcaaagaaccagtatcactgcgatggatgcggcatatgcaggcaagtcctaaatctatctctatgaattattttctgcatttactattttattcagtttgatcaattttggatatgcccattttttttccagaactggtggtgtggataagttctttcactgcgacaaatgcggtatgttctgcatgatcttaatgcaatgagccagtgatgcgtattccccaaaattttttgacattctcgccacatgtcgctgataaacaagattggtctaacatttgctattcctcactaaacagggtgttgctacagtaatgtcttgagggattctcatcactgtgtagaaggagcaatgcatcacaactgtcctgtctgcttcgaggtgagccttgctttccacaaatgcatttggtattcagaaaggtagagaaaaaaaaacaacattctcaatttgtttccagttcttgagatctgacataaaaaaatttgctctccttttccaaatcacagtacctatttgactcgacgaaggacatcagcgtcttgcactgcgggcacacgatccatctggaatgcctgaacgtgatgagagcgcatcatcagtgagtgttcttcagacaaaaaacttcacctgataaaactttctcctaaccaaaccaatgcaatgattctgatatcccccagcttcgcttgcccggtgtgctcacggtcggcctgcgacatgtcggacgcgtggaagaagctcgacgaggaggtggccgcgacgccgatgccggagttctaccagaagaagatggtcagtaaaacaccaaacatttctccaaaatctcgtgtgccattcttcagtgaacatttttttagataatggaaatggattacatctccggcctctgctcgtaggcacacaactaaaaagtccagaagtgaatagaaaagagcttaaaaaaagacgagatgggacaaaccctcaacttctaccaataatatgatctactaaaataatgtttctaaaatcatgtagattctatcacaaaattctgtaggtactacgccatccagactggaataaaagttctttggctaccaattcttgagtgaacatggctgggactctgaacaatcctttgatgattcttcttcttcctcctcattcagatatggatcctctgcaacgactgcggcgcgacgtcgaacgtgaacttccacgtcctggcgcagaagtgccccggatgcagctcctacaacacccgggagaccagaggctgcggccgccctgcagccgcgcgctccacggtttgatttcagcagcaggagcagcagcagcagagacgagttggcatccatctcacaaactaaggatgaaatcgagagcgacaaacaagatgcagagacggcttcctctgaacttagccgtcgagcaaaagctgcaaaatcgatcggcgtcgagtttggtagacacactttgcgccaagaggagtatggtgattttggcgcagtatgcagcgagttgaatagcccatatatgttgtgttttctctctctctcttttttgtgaggatatatgttatgttttgaaactccaactattattattactaaatgatactcctaataaaagagagacatcttctcaagaaaagaaaagaaaagaaatgatagacacagtgccatgctgatatacatttctggtcaaagtgaagcgatgctactgatcaacatctttaaaaagttggacaccaaggaaagatttggtgttgatgattttaagaactctctccgtttctaaatatttttctaaatatttaacaccgttaactttttagtacatatttgaccattcatcttattcaacaactttgatgaaatatgtaaaactatatgtatacatataaatatatttaacaatgaatcaatgataggaaaataattaatagttacttaaattttttgaataaaacgaacggtcaaacatatttaaaaaaattaacaacgtcaaatatttagaaacagagggagtcaaatattttcagagggagcaagaagcaaatatttcagatgaacgtgctcgaagagaatcgaatccgagcggatagggtgcatgccagcacccctgccattactctacgagtgcatctcactgctcaacatctttgctaggccgtctcagattgttgctttacggcccaaaagactatataaaagcccaacaatttcctctggtccaagagagtttgcaaggatgaaaatcttctctaacataaaagaagccgcatttccacattttttctcccaacccctgtcattttcagtttcacatattattggtacttaattacaggaataagttgtgggctcggttggtcaaagccatgcactggatattggtagcccatttattgctagtgcactatccagatgtcatgaaatccgtacagcaaatgacacacaactggagtactacggcccagtttagttcacaatttttttttcctaaaaacatcacatcgaatttttggatagatcaaatttttagatacatatatggagcatcaaatatagataaaaacaaaaaccaattgtgcagttagggaggaaatcgcgagacgaatcttttgagcctaattagtccatgattagcc

SEQ ID NO: 221 - DNA, 2950 bp, Oryza sativa
aacttgtagcatttctagtgagatactatacgtagtagtactccagattttaaatcatgttttgtgtttgggccgctagaaatgaaaccatgtgtcaaaaatgtgtcataccaataatttagtagcttgaatagtatatatgctggttttggttcgaaagccaaacattggcattccccgtgtttaacttggtactttctagattataattaaggttttagcttcttatttggtattaaaccagatattattttactccgctaaagaattggttgtcaaaatttacctaggttttaagttatagtacttacaattttttgatgaggtatcaaactaaacaagctcgaatcctgacttccaggcgaaaaatgacaagagtcaagtttctatatccggtagaccagcgtggcaaaggcatcacaaaacatctgcagaatcataaccaaaaccgtgagtcgacgtcagcttgcccagcaaaaacgtcacaaatgacgagccgaattatggagatccacggacacccatgctcccacgtgccatagatcactaagcttaactgatgaagcattccaatttatatactcaacacaaatcaatctcgcgatccactggattggtatgaagccccgggagtaagattatcttaatgcaaccgaccaccataaatccccccaaaaacacaagctaaagttcccttgtgcctcactgaaccaaagcatccaaattggcaaaggccgcctctttctttaattaaccaagaaggcaaagcaaaagaggcaacacaacacaacacagttgcgattagaggaagcaaaaagacaagctagactggtccaaatccaacccaattaaaccaaaaaaaaaaagagagtccaataaagaaatcacccggtcactctcgaagtcccactgtttcttagccagattcatccccccaaatccagcctgtgtcctctcactcgccgctgcgcgccaccacctataaatacgaggccccaaaaccgctcttctcccatcgccattaccacactcgagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgaggcacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtccaccccacgcaccgacgacgacgaggagtccgccgccaccgacggcgacgagtcctcctccccggccagcgacctggcgttcgaactggacgtcctgagtgacatgggctgggacctgtactacgcgagcttggcgcaggggatgctcatggagccaccatcggcggcgctcggcgacgacggtgacgccatcctcgccgacgtcccactctggagctactagagctcaatcaactgtacaattttgcctcttttttctctcttttctggcttccgatgccaaaattttggtactgtacggacactactttcggtaatgtgatggaacaagttgcaaaacacagagcatcttcatttgagtcattgacttcccaaaatagtactgtagatttttttttagcatctgcgagccgtcctcgtgtagaaacagtttcttgacagtattgtttctgcacgagaactacagtgacgagagattggatggtacagtacttaggttacagtgttaacgacagtgaaaaaaaacctggttttgtcaatgatgttcgtactgggtaacctatgcattcgagtgcaattgaccgtggatctctctcaagcaatttcacttgaaaagatttgttctggttttggccacaccttttggtgaatgctcccgcaatgcaatccctgtactgtacattacaggtcaaacacaaaaaatgaaccgggtcaaagtcaaaagccccagctctagataacttgctttgccaatgatttcttgctacttgtatttggtttgacctgcggtgcctgccttaactccgtaaactttgtacaggcttcacctttcaacggtcctggcaaaattcaatcaaataaaaaagccctcaacatgtcccagtgggtcattcacttgtattcccacaagttcgcaaagctatttatttaccttttgactcttggcactatccaaactgcccccctttgttacctgagctctccaaaaatttagggggtgaactcacaccggagcaccagggccacaatcccacaccaatttttgcaacttgtcgaggaaacagaaaatgacacatctcaatacgtcacgaacacatcgatttatttactacggtacagagcacggtgagcaagcaggaagcaactagcggcttagcttagctgtagccacccgtttgcagcgcaacaaaggaaaaaaaaaaacatcgctctcccagatcgaaggcgaaggaagctgccctcgttgccgcagaaaatatcgcaagtattcgcggtgttcgcctccctgaaaccccgaagggccaagcaggcagaaaccggccgcaggtgggcgccaacacgcacgcgccgctgctgctgtggc

SEQ ID NO: 222 - DNA, 2987 bp, Oryza sativa
ccaatatctaatttagaaatttctaaattctaatcaaagttttggcttctaattggtattaaatcaaatacaacattattctatcgaagaattgacggtgccatatattttatttatcacaaccaatatttggtaatgtactaaactaaacatgtcctacgtcttgtaaagcgaagttgaccggagtatcactagttctatttgagacatattagtataaaaagtattcttctaggaggagtaaaaccgcgaaggcaaacttaggctgagtttgataaaggggagatagagaagattggaaagatacgtaaaacgaggtaagccattagcgcatgattaattaagtattaactattttaaatttcaaaaattgactaatatgattttttaaagcaactttcctatagaaattttttataaaaaaacacaccgtttaatagtttgggaagcgtgcgcgcggaaaacggaataaactatctcccaatctaacggtggcgaacgcagccttagagtatctcctactacgacactcatggcatctttgactaaaactgagagtgtgaaatgaagttgatcggagtaacactcgtgcagtctcaccttggagcaagtattctttcgagagaagtaaagccaaaccatacacctcaccttaccacggcactacccccatgaaccccatctagaatgttttccctcgtcaagttagagagccctgtcaaccgagagaccaaaaccgttgccaaatccccccaaaaccctgcagaaacagccccaaaaacccaacagaaaccacagaaaacgccgtgaagctgcctgcaagctggagtagcagcagcagcagcgggcagtgagactgaagacagcgagagtgtgagctgccacgcgggcccaccaccgcacccgcacgctgttccctttccatttccagctatccccgcgtgcgcctcgcaccgagtaacgaccaccacttacctataaatattctccatctccaactccaagtctccaacctcagctcagctcaagctcgccggcgaagtgaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccaacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggcgcaggggctgctcgtcgagccgccggccgccggagcgtggtgggaggacggcgagctcgccggctccgacatgccgctctggagctactaatcaaaatctcgcactgaaaagtgtggacaaattttgattctccagaaattgggggaaaaaagagaacagagtattggtgaatttagaacagagtaggcaatgagactgaggatgaatggcaatttttgtaattttggaatgtgccagatttctccctccttttgtgattccatctgattttgaatgtgcagtcaatgaattcctgtaaatttacttctcctctccaaagagctattttggtcaagttcttctctgattttatggattttggatttacgtttgcacgcttcttgagctaatgattcgtacgaaaattttctatgtgaagttatcttggaatatacttttctaaaacaaattttcaacctcgtactccccctaattaaaatataaggattttctgacaagcttgtattttaaaacgaaaagaatagtagttgattcattcgtttacatctttaaatagctataaaaatagattatccataattccgtcaatttcaactgtctcaaacggggcaaaagtcctcctgaaccaactgcaattttacctgtaagctaaactagaagactaaatcagttcacactaatgcagagacactcttaacaagtttcagcaaattccatttcaccactatggtgtcagtaatctaggtgtaaaatctttgcaccattgctctgtcccaattttattaacgatcgtctctgaacaaagagcacaacagaggataaattaacctgaagcagactccagaaagagaaaaaaaaaactgaacaccaaacaccctgggaccaaacggaaccatcaaaatccagagacgaaaagtcgatgcgtgtagcgacgttctccactttcttctagctgcagtgaggaagctcgcactgtcgcggcttcgcaagtcaagttgcatcgcgcccaacgctgcaaaagaagaagaagaagaagaaaaaggaaaaaaacatctccgtctctctcactgacagactctcttctcctttcacactcgatttcatccactagaccaacatgatttagaaaaaaaaaaacgactcgttcaacgtgacacacagttgcatacacgtgcaacttgcgagccgctgctacttgtgttgtggcaggagaaagcaactctctcaacttgaacttcgccagttgatccactgcaagtctgaactgatgataagttggctgaatcattatcatggtctgattctgaatttctgatccattcccatggttcaagaaatcaggatcaatcattcctcat

SEQ ID NO: 223 - DNA, 3558 bp, Oryza sativa
ctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactctactgtgcctcacctcttgccactactatttctagtagtcgtgtatcatcatttcagatatcatatcgccacctctcgtttttttaataatatcagcggcgagcgagcgagatggactccccgtcgcctatggcggcgcaggcggccgacctgtcgctgacgctggcgccgtcgggagggggtggtgggggaggaggaggcggcggcggtggtgggtcgtcgtcggcgtgcatcgacggcaaggacgtgcggctgttcccgtgcttgttctgcaacaagaagttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccgggagctacggcgtcgtcggtggtgccgccgtcggggctactgctggcgttgggggcggaggtggagtgggaggggggcttctcccggcgcacgcgtacgccgggcacgggtacgccgcggtgccgacgtcgttccccatcgcgtcgcacagctcgagcgtggttggctccggtgggctgcagtactacgctggtaccgactgcggcgcggcggcggcgggtgcggcgaagacgacgacgacggcggcggcggcggcgacggccgtggcggggagcgagagcggcgtgcaggtgccccggttcgcgacgcaccagcaccatctcctggcggtggtgagcagcgggcgcgcgatgctggcggcgcccgaccagccgggcgccgggcgcgacgacatgatcgacatgctcaactggaggcgaggctcccacggccccaccgcctccgccgccgccaccacgccctccccggcaagcaccaccaccacgctcaccaccttcgccagcgccgacggcagcaacaacggcgaggagaacgaggagctcgacctcaacttgagcctctagctcccaccaccaccacctcctcctccgccgccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatccttttttgtcttctttttcattttgccgtcgatttcttggcttctctcttcattttacctttcatgtttgcctctgctgctgtatatatctgtgactgtctctgtagtctgtacttggatggcacttgcaaccaaccgcattgcaatggcctgcagaggctcgatggtcacactgttcatctcatgctcgaatcgccattgacatgtccatctacttctacttcttctcatcgtatcaaagcgttttcttttcttttcttctctgaagccgtgagttttctctggttgcagctgcatctacgtgcctgtcaatccattcaactacgttcatatattctcctcgttgcaatttttttaatacgttttctcatactgttcatggacctggatagattaatatccgtatacatatactgtacatatttggtggtactagtgtatctatctatcgtctgctgcactaattcatcatatccaacggctgtgactgctagtactagctcttgtttgtttgttcgattctgtggctgcagaatagtagcagaaggatattagacaagaagttttcaatttttttttacatacgtcatgcaaggtgaacgtgcatactactacggtgtatggtaaagaaggtgaagtagttgctggtttttactactactgtactattttaatccttgtgtgtcccaaaactgttgctgctgtttggcgtacgtgtgcatgttgcgttttggtgacatgagatgagatgcaggtttgggagcggtgggtgttgaacagtgatgcaatcaatctcgctatgtatatactccttctcgtgctactgacatgtggggacatggcatgagtatacagtagtagtatactccatgtgtgtgaatgttcaggtcggtgtcccatcgcgtcggatcgtgtttcacagttgcgagagctttttctttatttttggctactgcaacgctttctctcttcttcctcttttctgccatgaaagcctactatacgactagtcatctcctgacttgaaaaaaaaaaccagaagaaaaggcgagagagagagagagagagagctcctgtttcgagttatggtgagaggtgacgcgactcacgcaccggacggacaaatccgcgccgtccaatagccagccagccagaccctctttgcgggccccacctgtcagcgc

SEQ ID NO: 224 - DNA, 3393 bp, Oryza sativa
gtactactaaaagatgatctcttttttctttttcttttttgtctgaatgttcctgctctgcttccctgcctttttccctgctccctcttcagaaacccgaggatccaaccaatctcaagattcctttcctcctggtctcttgttccaaagtctctccaagaattgagatggtgattttgaccttccaatctctccgagaatcgaatcacatcatcatcttcatcttcttcttcttcaccaaccaaccccaaccaaaccccagtcataaagaaattgtgctaatgaagcagtagtaactctgaacaataatttaaaagaaaaacacacacatctccatatcttcagaacaacaacaaaaaaaaaaggtcatcctctggtcaatcaccctgccaaactttcagtcagagagacacacaaaaaggttagattgagacagagacacccaaaagaattcttaattgaaacagtaccactcctaattagcaatttgcttactcttaatctccctcactaacttaacctgcttttcaaagctttctcttccgacccggcaacatggcgaggaattgagagagagagagagagagagagagagagaggtttcaaaagtcaagtggtggatattattgcgaaaagcgcgcggctgcagcagcttcgcgccagaatcccagatagaaaatctcacagctcgggtcactctactgtaggtagaagagcgaggctaacttggcgcgagattgggacatgcgtgcaagtcaccacaagctctctctctctttcgcgccctttatatgccgctctcccgcgcgccccatgcatcattcgtcttcttcctcctcgcgtctcctcccctcgtctatggtctgcgcggctcatggccttggttgctggcacgagcagcgcggcggcaatgacgctcccgaggcaatgcgcggcggcgtgtaggacaggcggcggcggcggcggcgtggtgcggtgcagggcggtggcggcggcgggtggggcggtggcggtgagggatgcggtggtggcgccggtggcgaggcgaggggcggcgaggaagacggcggagacggtggcggggatgtggagggaggtgcaggggtgcggggattgggaggggatgctggagccggcgccgcacccggtgctgaggggggaggtggcgcggtacggcgagctggtgggcgcgtgctacaaggcgttcgacctggacccggcgtcgcggaggtacctcaactgcaagtacgggagggagaggatgctggaggaggtcgggatgggcggcgccgggtacgaggtcacccgctacatctacgcggcggcggacgtcagcgtgccgaccatggagccgtcgacgagcgggcgcgggcggtggatcgggtacgtcgcggtgtccaccgacgagatgtcgcggcggctcgggcggcgcgacgtgctcgtctcgttccggggcacggtcacccccgccgagtggatggccaacctcatgagctcgctggaggcggcgcggctcgacccgtgcgacccgcgccccgacgtcaaggtggagtccgggttcctcagcctctacacctccgccgacaagacgtgccgcttcggcggcgccgggagctgccgggagcagctcctccgcgaggtgtcccgcctcgtcgccgcctactccggcggcggcgaggacgtcagcgtcacgctcgccggccacagcatgggcagcgcgctggcgctcctctccgcctacgacctcgccgagctcggcctcaaccgcgccgccccggtcaccgtcttctccttcggcgggccgagggtggggaacgcggcgttcaaggcgcgctgcgacgagctcggcgtcaaggcgctccgcgtcaccaacgtacacgacccgatcaccaagctccccggcgtcttcctcaacgaggccaccgccggcgtgctccgcccgtggcgccactcctgctacacccacgtcggcgtcgagctccccctcgacttcttcaaggtcggcgacctcgcctccgtccacgacctcgccacctacatctccctcctccgtggcgccgacaagaagcagcccgccgccgccgccgccgacgccggcggcgtgctcgccaaggtgatggacttcgtgggtcggcggcgcggcggcggcgcattgccgtggcacgacgcggcgatgatacagatgggcggcttggtgcagacgctcgggctaatctgacagagtcttaacccaccactgtcaagacggctaatcaagattaacagaccactaatcctcttcgacattttattcgagggttttatggtcgaatttattttttcttctttgatttgattctgtatagatagatcaaccatcatagagatatctcaaatcaaacacacacaaaaaagaaaaaaccccttttttttttgttctgtttttttcacactgtacatagagagagatcatgattcatgagcctcaaagcagagcatgtaaacacacacaaacaacaaaaactgatctgaatttgtttgattcattttgaaatctcagcttctctttgtccccgttccagaacgcccaaatctgagcaggaaacagttcgatttccgtatgaagcaggtcccaaatgggccttaaacttgatgagttcagttaagctgcctgaagtgtgacacaacaaatttgatgatattttgtacgtcactgtatatctgtttttgcttggaaacacaccagttggacgatctggcagcctggcacaattcatcaaattttatcattttgtttatttatttatttataacgtatgcaaggatgccatagatcttcttttcagttttctttttcctagaaaaatggcatccatgcaacaaagcatcttaatcagataagctaattttcatatggctaagataatcttgccactgaattaagctgtgatttttccatgactttttttagtacttgggaacatgcttaccatcgtaagtattagtgctggtttttaaaaatagtatttgtagcgcccgttccgtcgtagcgcctagcgggaaaactatctcttaaaaaccctatttgcgaaatccgtttctttgcttgttgtctagtgtccgtgctatctcagatctcaaatccctgatctatcgtcaagttcaatcccgaatccaaatccttcccaaatcaaatccctccgcaaaagtctattttgcctccctcgggttcgatgggccgaatccctctcggcccatctccccctccctccccggctctctctctctctctctccccgctctgcccgtgagccgcgccgagccctcctgccgttcccgccgatgccgcccaaatcgccgcgccgcccgttgcttcccgcgcgcgcgtgccgtggtggccgaccgcctggtcgc

SEQ ID NO: 225 - DNA, 5647 bp, Oryza sativa
ctttaacaacccgccctctagaaccccgtggcccaacccgtccgataggcgggcccactactgtacgtaccaccccacttacactttcatcctcgttttgtgtaaaaggattaacccaaaagtagtatgattgaagggaagagatcttataagttagtttcactattgctaaactagcaaagtggtattaacatgcgcacagaactctcatgaggtcatacatgccaaatcctattgggctaggatgtcacagcaaagacgcttgccaatccgctccctagacgtggcttcgctcatgcctcccgctgttgagttatggtttctacaaggcacgtatgcctgtatggaacactaccgaagaaaccatcgttgctgtgttggccaaaaaccacaatagtcccggtttgaatagaaaccaggtttaaatatggttttttgtcctggtttaaaactctatcggtcctggatgatctttagtcccggttcattctgtcagaggctgtcaagggccggggatgtgcagtttaattaattttgtataagattttctaagttttagatatttttgccttcataagttgaagtccatcttatggcttattaagtggttagggtcaatctctctttaacaaattaaatcaagtgtgacatggtcaacgagcttgtttgtacaacttaaggttctgagaagtagttgattaatagttagtttttgagaatttgaaaatgttgagttttcaacttctgactttttgtttatattttggattctacaagttttttagaatccagataaattgtttagacaaacttttaagtctagataaaactgcagctgtcaaaaagctttccaaacagtaccaaaggcccagccataacccaacaacactaccccacacgtggctcctaggagtgtcgcacccacgtacgacgtcccgagagacgatatggcccctcgcgagctctatatataggcctcgcatcctagctagctagtagtatcccagcagcattcgtcgacgcgcgctctgcgatagccagaagctagcttagcatacgtgcaactgcgtgtgcgacgcgtacacggctgtacagacacagataagcctctcgcctacgtagacgtcttcccgaccatgccggccttcgccgacatcgccatcgacccgcctctggccgacagctaccgcgcgctggcgctgctccgccgcgaccgcgacggtggcattgcgccgccggctgtgcagatggtcggctcgggcggcgccgtgctggagcgcgacctgccgatggtggacctggagcggctgacgaggggcggcgcgggggagaggaaggcgtgcgcgggcgccatggcgagggcggcgtcggagtgggggttcttccagctgaccaaccacggcgtgggccgggagctgatggaggagatgaggcgggagcaggcaaggctgttccgtctgccgttcgaaaccaaggagaaggccggcctgctcaacggctcgtaccggtggggcaaccccaccgccacgtcgctccgccacctctcgtggtcggaggcgttccacgtcccgctcgccagcatctccggggcggattgcgactttggagacctcacctccttaaggtacgtacagtacgtactatgcttaattactagctcgtatatactcgttaatatacgtagtggagtagtgtacagtgtgcactgcagtactccatgttgctttttatatgttagcttggtttttcttaattagctcgctcgcgcaagcacactttagtcattttgatgaaacaggccggtgaggcgatccgtgagtatttgcatatcggcatatgcatgcatgtgacaagctggatatatgctaacaaaattggcaattaagttgtttttagttataactactcccttcgtcttaaaatatactagtaatttaggactagacgagacatatccaatccaatgaaactggagaagggattgtctagattcgttggactcgaatatatcttatctaattctagtgttgctatattttgaggtaggatagatctcatccagttttagattgatatattatatgatggaggtaggagtaacttgcggtttcacactcgtacgtacaagctctgtagctagctagaccgggccgtcacagttacagtgtcagcgtctaagtactagtactagcttagtacaaaaggcgctaacagggcactgctcatcagaaaaggaggtatctctgttaattgcgatcgttcacgggatatttctcgtgtacacgtactcgccgcgactgtctgacacatacgcgagcgagcgcgatcgctgctatattcgcgcgtgctcgctgtccttacgatcgaacaaattaagctataaaagtctctggggtctacaataagctccaagcgagcagcaaacttgcctgtcacctgtatatattccgctcatgtgagtcaatgagtgatgatatcatgtgtgcggtggcgtatgtgcccacgaaacatgcgtgccttttagtacactaaccgaatttaacgccttcgtgtccatcgaaccagcctaccaacgccgtcccccacgtcggtgatatatatactcgcttattaattactccctcattattttaatgtatgacgccgttgaccatttgttttattcgaaatttttgtgcaaatatgaaaatatttatgtcatacttaaaggacatttgataacgaatcaagtcataataaaataaatgataattacataaaatttttttaataagacgaatggtcaaacgttagataaaaagtcaatggcgtcatacattaaaatatggagatagtattatattgtgtgtcgtgtacattccgaggcgtgtctagctttcatacacagtgaaggaaatactgtgagaaatatctcgggcacaagaaatatctgagtcacacacgtaggcgtaggaggatgcataaatcggagttgtaacctctaatatataacctttcccgtctaaatcgagggtagatccagtaaattgagccactagctaggtcactgagcttatggatcctatgcttgctagcgacaccaatgactaacttgtatgaacattgacttgctactgattcctctttatatatagcgttaattgatatttggataatacgtttgactgtttatcttacttaaaagttagcgaaaaatatgtattttttatggcatattctattattaaaggtactttacgtgtcgtttacatatttatataatattttaataaaacatcacgtttaaatatcagcatcatctcgtacattctaaaaacagaggaatatttagttgaccctaccaaatcatgtccccttcacagttgctttgtagattaatctaaactgaccactaaagttggatggtgataaggtttctagcgtcgtatcaggttataaagaaatctaattaagcttctattagttctttatcggatcaacagtgaataacatatatataaccggtttccgttgtcctaccggttagccgagaggttattaacctggctgatcagtacttttactgttttactgccggttggtgcacatggactctagtacggattatgatcgagtggttgtactcgattactaacaagcggaggttgttgtggtggtgacggcgtgcaggggcgtgatgcaggaggtggccgaagcgatgtcgcgggtggcgaacacggtggcagcggcgctggcggaggagctgaccgggcgcggaggcggcggggcatcggcggcgccgtggttccctgcggggtgcgacgagacgacgtgcttcctgcggctcaaccggtacccggcgtgccctttcgcggcggacacgttcgggctggtgccgcacacggacagcgacttcctcaccgtcctgtgccaggaccaggtcgggggcctgcacctgatgaaggactcccggtgggtggccgtcaggccacgccccgacgccctcgtcgtcaacatcggcgatctgtttcaggtaacagtccgccgattagctcgctcgggcatcattgtgtgtaccagctttgaccaccaaggcgggagaaacagagatgtcatcagatcgacgtgtctttgtgtggatgcattgattttaactttcgatgtcccatgaggccatgaatcattagctaattaattctctgctctgctataggcgtggagcaacaacaggtacaagagcgtggagcataaagtggtggccaacgccaagacggaccggctatcggtggcctacttcctgtgcccgtcctacgactcgcttgtcgggacatgcggcgagccatcgccatacagggccttcaccttcggggagtacaggaagaaggtgcaggaagacgtcaggacaaccgggaaaaagattggcctcccaaactttttcaagcattcttcagtacaataatgatcgcatcaatgacagcaaccgcttgttctatatatgttcgttataatttatggtcgatgtgaactcgaccgtaccatcaatccatctcactgtacaattgtgtgtgcggtgttcggggttggaggttctttccttatcatttccgtggccttttttggtttgtagattgtaattggcaaggtagtactatacaagtgattaaaccagaaggccttatgtgcaattatcaagttatcgcataatgacaactgccaccatgtcggaggaaataatttactactacttccgtcccaaaataagtacagccgtagatattcgtgcccaacgtttgaccgtccgtcttatttgaaaaatttgtgaaaaatttaaaaatatttagtcacacataaagtactattcatgttttatcatctaatagcaataaaaatactaatcataaaaaattttcaaataagacgaatggtcaaacgttaaacgtgaatagtgtaaaactacacttattttgggacggagggagtacatttctaacattgttctgtaaaaggtccactcgacaccctcgactccaaaactgcatatttgatccccaatctctcgtggatccgtgtggctaaattggttctctacgtgaggttaaatcttaactactatttagatatatactagaaaaaatacccgtgcgttgcaacatgtgaaaactattttaatcttactattgttatatggtttagttaatgtaaaattcaatgtgttaaattcatttggatatattttgttagaaaatcatgagctgcaattagaagtctgatcgtctcatgttagtatgcgagttttttaaagagattttatacgattccttctgtgtttcctaaagcaaacgaatttaaaaaccgactcatacacggatgacatactaaaataccgacaaaagtatctttaatttttataatagtagatattagtacgcccatatctaattgagtgtgagggcctgtttggcacagctccagctccacctctcctggagctggagctcagccaaatagtttcagctccaccaaaactgggagtggagctgggtggagctctctcataaaatgaattagagttttggagctgggtttaggcagctccataactccactccagacccaactactagagctaaatttaggagttggagctgtaccaaactgaccctgagtg

SEQ ID NO: 226 - DNA, 4112 bp, Oryza sativa
tatactttaagatgagtgtagcattacatcgtttgcaaagtcataagccccaagacagggtacaagtcatgaattgttgagtgaggatcgtattttcactggaatataaatctccacaacccaggaatatgcagattctcatgaaaaggacaaatcatggtactatatctcgctaacacaaaacttataaatagtaacacgcatacatattactgttgaagtgtgattagattaaccatctttctccagttccaatacaacttttgagatcatttcaacaagatagggatagcacaactgcaaggaaaataattgatcattgttcatgagtgtcgtgtttaaatactccctacggtcacgaaaacatgttccagacattttacagaattatcatactctcccctcgaaagaaacataggcttatcggtggggctcactatgatgcgatatgcttactgtaacattgaggtgaaaaacatgattaaaaattgttttcatttcaaaagcttattgattaattgtaaaccataaaacttcagttacatcattttgcctactaattatgagccgttacgcttattaacgataagcaaataatttatgagaaattttttagtgcatttttagcaacttaaaagcaaaactataattgaaaagatcaaaatcaactctaagatttagttttaaaattaagtatcacatatcataatacatgtgctttactataattttaaccataatatgaggttttctaaaatctaccgttcaacttttgagccgcccgcagtgagagtgtgagaccgcgatgctggttgtggatcccgcaggagttccacccacgtgtcataaaccattacagtgggcccgccaaaatcgctgcagccaatcgcagagcagtgaaccggatggggctttacgaccagaccaatcacgttccagataagacctgcaattgggccccatcacaacaccaaaagtgcaaagcacactacactgctaggattcctccggaaaagagtactccacttggacatatctctcaagtatggcccttatccggtggtacttttgtcattttttggcgtatcataccatgccctcgtcgcaactcgtacaataggttaacacacactttgtacagatcgagtgcaagtgagctgcatagatttttagaggttttttgtggaatcatcttttgtgctgggagatttcttctgtttgttcttttgtttcgtcgtgacgcatgagctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccgctgacggcgcgggcgtcggtggaggaggaggcggcggcggcggtggggacgacgacgacgacgacgtcgaagagagagggcggcgtcacgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcgccgagttctgctcgccgcccccgatcgatgacgcggcggccgcatcctcatcgtgcttcaaggaggacgccgccgacggcgccgtggaagacgcaaagtatccggcagctgcggcgtcgtcgcccgtgcagcagctcccggatagctttgtcaacttcgaaccgacggacgccgagctgagggagttcgccgccgacatggaagccctactcggacaaggcctggacgacagcaacgagctgcaggactcgttctacatggagaccctagggctaataacgccgccggtagaagaatccggccgggtgaagatggagctcgacggcggtgttgcctccaacagcagggtatctctcccatcatgccgcgctcatccgaagccggaggacgtcgaatccgccgacgtgctggacatcgatttcaactgcacctcgccggacgaacagaagtcgtcggcgagcaacggcgccgcagccgattcgcagttcttccacaggagcctggatctcaggctcaactacgaggcgatcatcgagagctggggcaactcgccgtggaccgacggccggccgccgcacggccagctcgacgacttctggcccaacgaccaccattactcggtacgtgatttttgcaatttcaataccgtgtcgtccatactctcatgctagcgcatgcgacatgcatactgaatcgaaaactgtgttggtgcaggggttgtgggctgcgggagggggcgggcatggcgcggaggtggggatgatgacggtgaggccgcggatggacggcccggggcgggaggcgcgggtgacgaggtacagggagaagcggcgtacgcggctgttctccaagaagatacggtacgaggtgcggaagctgaacgccgagaaacggccgcggatgaagggccggttcgtcaagcgcccctccgccgccgccgccccgtgcgccgtcacctagacgtacgatcgcgcacggcccggcgcgcggcaccatgcgtacgtgtccggtgtcgagacttgcctgcgttcgatcgtatgcctcatggactcgattggcacaaaagttcacgcaaaatttgtcgaagctgcacgattcaagtagtataacgttgttcaattcaaaagtttttctcttccttttttttttcggttttgttggtgtttggctcggtgcttttggatctcttttatctctgttccatcgaccggagagaaagtaggcgattgtacttgtgtaaacattggtgttcatggttttgtagaaacactccataaaggaaacaaaatgacttgtatatgtaaactgggttgtgcctgcgccacacccatgtacattgagtaatcagtacatacttaattattttcttgcatgtagataactggacaagtatctgaaaacttaccgggacgatcaaaagtgttcatgataatcacattcataaaatcactgctgtaagcattgtccgctaacatgcaggatcgacagcatgttggccagtttctttagatcaatttctggggattgaataaagtacaatgtatgatgaacaattttcgtgaaagattatattgccccatgaataaattaatcccctttcaaaaatgattatgcctaaggtaggagttgttacgatagcaaaaacagatgtagtagcttgaatttgcacgttgcaacttgcaacagtgctcgatatctcctggatatattggtgaaatttttttgaaaatatgccttttatttttttctctcagaaatattcgggttataattttatttgcacaaatataccgttgatattacgatctcgcacaatgaaaacgcaagacgctcggtgtcgcgcggcaaattattactacatccatcccaaaatgtttgacgccgttgactttttaaaaaatgtttgaccgttcgtcttattcaaaaaatttaagtaattgttaattctttttctatcatttaatttattgttaaatatacttttatgtatacatatagtttcacacatatcacaaaagtttttgaataaaacgaacggtcaaatatgtttaaaaaagttaacggtttcaaacattttgggagtattaattagtcgagacgcaatttgccgcgcgaccgctggctctcgctggttaagtgaaggcaaattattattaattagtcgagacgcaattcgtaattattattaattcgatctacacgtgaagacactgttattgcccatcaaggaaaggaacaaaacaaagcttcgcggtaccaaacactagtactctaaacaacgggttttggtctctgcaatgtgcgatccaaagaatcgttccaaaaaattggtgcagacgacggcattttttactctgtcccagcaatcctcttctt

SEQ ID NO: 227 - DNA, 4664 bp, Oryza sativa
cacggtatatcgaaaggtaaccttatggcaatgattacatttataaagtggaacacatacattgtgagaaatagctttagcttagagtgcatcttatacttaaggtctaccacaagcataaagaaaatattctctctctcatttatgtcatgaacaagagctgaaaagcaggtttttctatctcataagggccccatattattgttaaatttcagcaagggattagctaaaaaactgttgcaggttttttgagtaaaaaactttcaaatctaactatagtacataattttactagaactacactataataattatataacttgtatagatgtattaaaataatatatgcaactttatatctaatttgatagagataataatgtagttactgtaactagggtataactggagtataagtaacatgtaacttgctaattttttaaaaaacttgcaagctggtgggatcgaggtcctgggttcgaaccccatgcagcgcacaaattatgtttctcacacgggatttttttccatgaacgcgccagcacgaatcttgagatgaatctgacggtcaaaaattcgaaagaatttacccccgttttctgtcgatagaaaactagcaaatccgtttcagcaatagcattatgggaattgctttaacaacaatcaaactattcatgggccacttctaagatcacactagacccatatacattgagattgccctgatatatccatctaattcatggacattttcctagtcttggggggatataatataataggagctagaggggggcatgggtagtgaagtccagccagcgcagaagatccttggggggatctggttgcaatggggatggccaatgaggagtcgccaaattatcaggtgaaaaaaggcggccggattcctccacgtaaggaccaaatccatccacagatcgccccgctctcctcgatcgatcataatatgatctcgcaatggcccccctacctttccctcatccccaacttgccctgtcttcttcttcttcttcttcttgtacctatattattacaagtcatcgatctcgctgatcgatcagtgatcacaagcatttcacaaccctagctagctgagctgatcgagctcaagtgacctcacctgctatagctaacttactagctagctctagctagttgttgtttgtagctcgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcgtgagtatcaatccaataatcctgatccggccggcatgatcggctcgattgagccgtgtcgattattaatttccatcttatatattattaattgatgaattcttgattgattcatcgatcctcctcgtcttttcttggcttctttgtttttgttatttagtcaaaaacaactcttcatttctgctgcctatatgccgtacaacttcaaactatcaaaggtcaaataatcgatcaatatataccaagtttgaattaatttggagcttaattaattaattactggcttgcagcagctggtttatagtattgtttctagctatatatgtgagggccgtgtgtgggatgtgatttgcatctttcgatggcgacttaattaattcgatgatatatttcattgcatatgcatacggatccagcctctgtctatactgtacgattccacatacgtatatgtacggttaagtcagtatatatacttttagatagtcgcgtgtgcttttcgagttcggtagctatattttagattgtaaaaacaagtcagaggctaattttataatctagaaatacttatttccccatatataagcgtatgttaaatattgatggtgtaatctacttatatgtcaggaaacatcattgcttgctttctggcgctttcttctacatatcagtagaggaaaatggaaaaaaaaagatgaattttgatgttgtagtttgctatattcagcatatataccatcagttatacatatgcagatcttgctaaaaccaaaataaaaatagaactgtaaggagatattgtgcttctcggtctatttacttacagtttgttgagaagtaatacgagcaagcaaatgtatatatatatttctttagaactgcaaggagatgcatatacatgtgtgattcaaacacacgtactgcacattcaaactataaaaacaacttgattgccgtagaagttaaaagggagacatatccatgggtttcggattctaaatcaatctatgtgtaaatgaaactttagtatagtaggaaataggttttcaaaaaaaaaagtatagtaggaaatagtatgtgtatatgcctttttaacccttaattacaagttgttataattcagtgttaacaaagtcacggactcacagagtgtgcccttacacaatttcagactaatttgtaaatgcatcgatcgtcacattttatgtggttcaattatctgacacagttaattaatggtggccgatcgatgtatgctcttctagctttccagctatatgcgtatgtaataaatgaataaaacgtgtaggatgaaatgtgaatacgcatcattgtaattaatttgattaatgctagtaaaaaatctgcaaatttgtctttttgaaattaaaatatgccttataaaattaatggacccaggcccctagggcaaaatatattggggcacaaaatcatgtccatatatacattcttatttgaaagtagactctgaaacaaaatatgcccatataaatcaagggaggttacaactaactgcatttgcttatgcgtacatctggattgtaacttctatgttttgtacatacgatgattaattgtattcgagcttcttaattgtacatctattaactaactagttttgcagatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatagataattacagtgcgtatataccactgactatatatgactgatcatcatgcatcacatatatatatatatatatatgcattattagaccatacatacatatatatatatatatatatatatatatatatatatatatgtgcttgcatataacctatatatttaggcatgcaattcggtaatatatatatatatatatatatatatatatatatatatatatatatataattagtgatcgatggcccattcagaaaacttgattgcatgcatatacattagcttgctgaataagaaggttgatctgcatgaagataagaaggttgatcatggaaatgtatgattcaaacatatatttgttcaagaatcaagaggttccttagatgctttatcactctttatattctttaaaccagctaatatttcttttgccaaaattgaatcccgcatgcagtagctctgatcaggaagcacaattaatggtgctgggatacataggataattatttggattcaagtgctagtctttcagattttgtccaaattgactaggttacaagaaaaatccctaattcaaagttccacgtatcctctatatatactttcgctaaagatcgataaccatgttggcacaccaaaataaatgtctaaagaaaacagggtccttaattaattcttccatgcatacatcacacacaatataatagtggaacataagataagatgatagagaaatattattgtgcatgcatgtatatatatttgtgccatgagagagcatacatgtatcatgcacaatatccaactaaaaattggttcctttttaatagcacacagccactaaaacttgggaaataaatctagctaacttctgttccgttcacctttagttatgaaattacttggaaagaaattattggccggaaactagtttctgatatgatattgaatgaatttcatgtttgacaagttaaaataatttgtaatacatattcaactaagctctagttcaatttccataagaacaatctgg

SEQ ID NO: 228 - DNA, 6962 bp, Oryza sativa
gcttatacctctctctattttccctttttcttttgtgggattacttctatttctttttcttttgttacagaagaggaaaaagaaaggtgatgacgaactgacctgtatttattactgacgtcgattgggtaactctggattgtgagttccaccactcgatgggatggatgtgttctccgaattttagaggttggaaagtggtttgtgcttaaagactatcgacttctcgtgaaattttgctgtccatttaattatttgttcaatccattggagcagtagagtatgaagtactagaaagaatattctgttgctcctcgtgttatctctgatttttttcttaatttacttttgtctcgtgttatccttttgttttgttttaagacttctcgtgtaatctcgtgaagtcaacgagacaactagtagtagttgtccttgagacgctttattgaactctgcgtacttctgttgaaatttgtgtgcattggagccaagcttttgtaccggccgcacggagctcgttgaattctgtaggaattctgaattcaggtagcagcaagttcacgagtctataaaactggggactaaaaggcttgctccaaaaaccaaagaatttcacgagttaaaaaatcacaaattatcaaaagacacaacgcagaattaaaattcaaattcacgtggacggcaaattctcaaaaggaaaaaaaaacccgcaaaattttcgcgggagagaaaaatcgtcctacgacgaacacgtccaagcgccccaaagatcacacgaacgcgtgacgccgcccgtcacccacccacaccgcctcgcgtccccatccatcaccgtccatcgtcgaatggacggctcagatcgaccctacgggaccctctcaccagcatcagagaagcccccgggcccaccagcccaggcgaggtgggccccacggcccgaggcgaggcgaggcgagccagcgccatcatcacagccggccaaccccccatctctctctcaccccttttcccactagtacttgccgtgccttcctctctcctctcctcttgtctccattgctttctcgggttctcctccactcctctcgtctcgcgtgagtactcgcgacctcaccgccggcggcgacgagcggcggcggcggcggttgaggaaggaagggggagggagagcaggaaatgcggatgctgtccaaggcgtgctcgctcgtggcctcctccctcccgcggtgctcatcctccgctgcccccacggtcgggctcccttccctctccccctcccgctccgtttccgtttgatggattgttgttgggcgatctccggtagggatggtgttcgggggcttggatctggggggattgggtcggaggggcgcgtcgctgcggggggtgtgcgtgcctcctccgctgtgaacgaaaccgtcgcgtttttggcttcggtccctcgctttccgggtttttgccgatatcggcgacgtgcctgattattccctagtgtgttcgattctagtcagttttgccggattactggaagaattttttgtatggagttccgcggtatagaattgggtatttgattgctgaattagttgtgtgatgatagagttctatgaattcagagttgggatggctgacgattgtttgttgtgttgggtttgcagatcagagggcagccgtcgttgctgccaagcgtgcgcaaggaatggcttggcaagccgctgctgtacggaatcggcacgctgctcgtcatgcctctgaggacgctgcacggggtgggacggatgtttggcgctgggcggttcctctgcaacatgaccagcgtctcgtcgtcgctgcaaattgagctcgtgagtatcctgagatattttattatgttgttattctccctgtcagtgaattgttattgcaacttgattgggcttgtggattgtgagtatcatcctgagagttgatattattgttattgcaatcaattaattgttatgatacttcgtgctgcacatgtttgctcatcagttgaaaagaaaatctgattgctgcataagcataaaagatatttggagggcaggattcgattcaacagacaacactaattttttccacagcgactaatcaaacctagatgtgaagaatttgttgcaactggatggtgttgctggtggcattggttttgggataaaaactttggggcgttctcaataagaaagtggccatgctcacataaagaagcttccctaattgttcttccacctttttgttgttgctttgttctgttttttttttctttctgctctcgattcttctgcatgaatgtgatatatgttcaacacattaaattgtatcattttctgtgacctatcaagcatactttagtcgtctatatgattttgcactcttttttactttattcctgaacacttgttcatagtttcttccagacatactggttcttaagcgtagcatcccaactcaaaacactggatcagatctaactttattttggatagacagaccctctctatcaccaaccctccttatgctttccttgcttcgcataaaagggttattggggatagctacattggaattatctatagtatttgttgccaacaatgtttatgcttcttgtgtaggtaccctgccttcaagataactatgcttacatcctacatgatgttgatactggaacagttggagttgtggacccttctgaagcaacgccaatcataaatgcactagaaaaaagaaaccagaacttgacctacatactgaacacccatcatcactatgaccatactggtggcaacttggaactgaaggcaaaatatggtgcaaaggtatgcacataggttgcctctcttattttcgtttgttccattgtttgtagcactaaattgtgtattgttatgagttcttatggacaatgagtaatatggtagcaataaacagatcagcatttttcaaggttaaatttgatgttataaatttagtttataaatctgcttacagtattaaatttaagatgtgacgagtttctatacgaataataaaaaggacctattgatagttgacacagtttgttttccagcatgccattatctatccactgggtgctcctaccacctgtaacaccaaagtttatgagtaaatgtggttttgatatttttggtttatgaattttgtttgtttaactaggtgattggttctgcaaaggatagggatagaattccaggcattgacataactcttagtgagggtgacacatggatgtttgctggtcatcaagttcttgtaatggaaactcctggtcatacatcaggtgcgtgcttgcaagtttcttattagatttatcttctttctttttcttcattatcgaattatgccaagtctgaatgtgtatgtactagatttccttaaacatgagacatcacattttttgcacttggttggtgattactggaagtattcaagctaagagtgcctctaaatttttaacctgaagttcaaattgctttctttgccaccttccccacaagcacatgtgatagtttcctgtgggcgctcatggccagttggccacatgtacatgtgttaaactcaagtagtggcacacccttatatgaagcatatttgaaggtgtaccatttttttgggagaaggttatattgcgatttttgcatcttatgtttatttacaagatatgtcaatactatctttttttttaaaaaaaaatcaccaatttcccttctacttatattaggtcatgtgtgctaccacttccctggatctggagcaatatttacaggggacacattgtttagtttgtcatgtggaaagctttttgaagggactccacaacaggttctttttaatttttacagagtcatcttcatgtgcactttatggaagtaattaaacaccaaatgctatgttttgcttgattccatgtacttgttcattccctgttagatctttgaatgaaactggttccctgccaattttacctcagcaaagatgaatctgatggcaaggccttaagcaatttgttgagaccattaagatccttttgccgcgccatagttatcaatataatctagattacttgtaaactagactagcgatctattagccatgattatttaagatatataacagaagaggctttaaacgttctctataaacaatcagatgaactggaagttcttgctacatggattatcaaaccttcatctatttgtacatcaaacagcggatgggattaaacaaactgctagcaccttagattagttcacttagtaaccagagatgcagaaaaggtagaagactgttaatttgtggtatttctgttggtcatcaatagcttctttttatacaagttggttaagtatgtaatgcatttccctgtaactattattgagacctgtgcataattcctctttttttcaaatttgtgctgcagatgtactcttcactccagaaaattatagcacttccggatgagacaagagtgtattgcggacatgaatatacattggtgaatatccaacgttcattttcaattccacaaataaatcttcattgacctgttatttatgcttcaagtatctatccgcagagcaattcaaagtttgccttgagcatagaaccaggaaataaagacttacaggaatacgctgcaaatgccgctgatctccgcaagaggaatacacccacggtattagtgctatacaaaccatacatattcatggttttcttgacaatccaattctattacacattattttatgatgtttcttgcttttacttctaaactttttctgagagaagccagctcatttggtattttggtgcatagatatttaggcgcaattgtttgtttggaagttcatgcatctgaatttattgacaaccctatcatgttaatgatagtattctgtcttaacctctcagcccctaagatgtcttatgttgaactagaaagaagtcaggataacatactccgtatcttgatgtgaaataaaggttgtatcttgcaggaattggcactagaaggtcaaatcatgttacaattgaaaatgatgggaaggttttatagcaactttaaggaactacgttttgttgctgtgcactatctgaagtgcttttggttgtttaagaagaaaattaacaattgattttggtgtaaaatgtttcccacattatttgaaagaataccaactatacttaaacatcactgcaagactagaatgagatggaaaaagggttcaatctagtgccaatagctcattctcttcatgaaagcaacatatgaccaattctagatagtattaacataaaaagccaagctatgtggggttgtcaatcacaactgcagattgcatgatagtggcttgattgggattatttaacttgttttttttttttttggcttcatgttcgccaggtgccaacaacaattgggagagagaagcagtgcaatccttttctgaggacctcaagtccagagataaagaataccctgtccatcccagaccattttgatgatgcacgcgttcttgaagttgttcgacgagcgaaggataacttttaactaaccataaaaaaggaaaatttcacgtccatgacccaattgtcatgttgaggagagaagcagacaaagaactccacaagagaaacaaaagaactacaaggtatatgatgactacataagatcgagctagtttgtttctaaaatgcttcggcaaaattgtgtcgcggtgtatgtagcttttggcagtggttgtaaaatgtcgtccaatagcagctggtgattctttctatcaactacaaataagtgtgatctgttatcatcaactctgtaaaaagaatgcgagttagagattgatagttctcccagaatctcaatcctgtccttatgactcatttcatttgaagtgtttaagagtcagttcttacggagtaggcagttggtgcgctttttgtgacttattttacactggagtgtacctgaatgtgttgacatggtaacacactgacactgatcactcgatcaacttcattgcaagtgatcaacaacacattggcttcttggactgtcctttcattagtgacctaacatgccaggcttgtttgtacatcacgtcacattttggaaaagtgttgctcaatcatattcatactcaataactcgatgtgatacatcaccgaaagacattacttcctgcaagattgatgcttggatgttaatatggaggcaatgccgcagcccacaatgcgaaacatggttagccgctgcttggaacatggaaagaatttacaagttcctactccctccaattcatttataaatcgtttttacttttttctagtaaaactttgttagttttgatcaagcttataaaaaactttaacaacatctacaacatcaaattagtttaattaaatataacattaaatatattatgattatatattattttgtattagaaatgttgctatttctttttataaacttgatgaaacttaaatgttttcaaaaagtaaaggcagtataaaaattgaaccgattcaaaaacgaaatttgaaatcgaactaaattactataaacaagagcaaatataattcaaaccggtcaaaacacttctacagttctactaggcacggctcaaacattcccccaaacacaacccgtcgtcttcgcctagtcccaccatctttctcccactccctcccctcccctccacccccaccagcgatggcgaccgccgagcccggcccgggcccgggcccacgcaagcccgcctgctgcgccgtcaccttcggccgctccaccctcctcggccgccacctcgccgccgcgctcgccgcctccggccgctggtccaccgtcgccgtcctcgacccctctccgcccaccacaaccaccaccacctccccgccgccgggctccccgctcgcccaccacc

SEQ ID NO: 229 - DNA, 6962 bp, Oryza sativa; identical to SEQ ID NO: 228

SEQ ID NO: 230 - DNA, 6501 bp, Oryza sativa
gcggcgctacctctctctccgtcggtggcctctcccctctctagcgctgctcctctctcccctctttcccctgtggtggtgatggtggcatcggggaagagcggggaacaacggtagtgccggcgacctgcggagccgggggcggcgacgagccccacgacggtgccactcctgtctcccctctttcccccggttcctcccccggatgcatagcccaagctattcccctccctccccaacactctaacaaatctgacgaggaactcgtggctaactttggctctccggacttcactttgttacgggagtagcagatgtggtatggaatccatgacgtggaatgttaggattgaatggtacatgtatacagttatgcaccgtgaatggcctaagtgaacatccacggttccacctatccctctcttcccgcatgttggagtactgaaatgggtcaccaaatgatgataccccatctgtccacgtctattaggaatgggccgttctaggctacatagtacacacctagcacaaagctaaactaagctaatgatggtacacagtagacgtttgcaggccatccggcccattaccgccgtcccaaaatacttatttttgagtttttattaccaattatcttgtttagaagattatataattattatttattttatttgtgacttactttattatcaataatattttaagtatgactttctttatatttacactaattttttaaataaaacgaatgatcgaaaattgaaagcaaaaagttaaaacgacacctaatttacagagtcaaaatgacatctaatttggtacggagggagttacaaaaatacgctttaaaacttacaaagcgtatcttatggcacctcgagggcccaaggctcaggcggctccgcggctatgcgccagcgccacctatgacctatacccgccgatgccacgtcatgcctcaccgaagcaacaaagcctcgccttttgtctcctggctagccccacacacggccacaccacgcgccccgcctcgaagcaacgcatttgatttccgcctcgtctcgtctcgtctcgtcacgcgcccccgcgccgccgcggaagcctcggagcagcagccatggcgacggcggcgaccctcccctcctcctcctcctccgccgccgccgcggtccagaccatatcccgcgtcctctccttcccccgccgcggcggcgggggcttcctccacctccgccgccaccccctcgcggctgcggctgccgccacccggggccggggcccgctcctccgcctcggcccgcgccgcccgttctccgcctccgcctccgccggggataacggggccgctgcgggcggcgatgggggtgggtgcgactacgactacgacctcttcaccatcggcgccgggagcggcgggatgcgggcgtcgcgcgtcgccgcctccctctacggcgcccgcgccgccgtctgcgagatgcccttcgccaccgtcgcgtccgacagcctcggcggcgtcggcggaacgtgagtgaacttcgccacccttcttcctagttcaagtcgcacacattgttcagtggtaatgtttgtttggaattcggatggtgtgcatggtttgcttctgattgtttgtttaggattatgatttagtagtgaggagaggattgaacaatttcacgcacgatccagtgctctgttatgatcaacgaccactaggagtctactctatgactataagaacagattcttattcaccattcctggagctcatgcttaatttcagaggcttttgtggtattcactataatgttgttcaatatatgtgtagagatgatgatatgagatttactattagggttacatacttacatgaatggctctccatatacgcaagtaacaaaaaagttagagagctctgtcacgatggctggttgttatcaaccagttagccttacgcgtttccagcttccttctatatctgtaatttgcttatagcgtctgcagagtgaaatgcttagtatctataatgtgcggatagcatctttcttccatttcatatccaattgcaaaaatgtgcaagtaagatgttcagtttttccatacttcagatgtgtgcttcgtggctgtgtcccaaagaaactgctggtgtatgcatccaaatactctcatgagtttgaagagagtcatggctttgggtggaggtatggcactgagccaaagcatgactggagcactctgatgaccaacaagaatttagagttgcagcgcttggtgggggttcagacaaacatgctaaagaattctggggtcactataattgaaggccgtggaaaggttgggacaaatttgtaaattgggttaagtttgcatatacagttttgttgaaaggatcaatgcagcaatgacagtgttgatatactacctgttcatattatgcaggttgttgatccacatactgtcagtgttgatggaaagctttatactgcaaaaaacatactcattgcagttggtggtcggccatccatgccagacattccagggatagagcatgttattgattcagatgcagcattggacctgccttcaagacctgagaagattgcgatagtaggaggagggtatattgctttggagtttgctggcattttcaatggcttaaaaagtggtgttcatgttttcatccgacagaagaaagtactgagaggctttgatgaggaggtgagcaagtatccattagaacaataatttcgtttttgaactgaagtgtgtcaatgcgtcatgccttgagttattttctcattccatgtggatttgtaggtcagggattttgttgccgatcagatgtctttgaggggtatcacatttcataccgaagagactcctcaagcagtaatgaaatcagacgatggcttgctgactctgacgacaaacaaaggaagcataaatgggttctcacatgtaatgtttgcaacaggacgaaaaccaaatacaaaggttaatattatgccagtcatttccacttttctcaaccaagtttgttttgggggcatacatttattttctggatacacatcttcatacaatccatacctttgtagaatttgggtctagaagaggttggggtcaaaatggacaagcatggtgctattgtggtatgtgtatttaaacaaggttctgtgtattctacatagattctatacattatgattctatacattatacataatctaacattttctcaattattagatgatcattaagtgataactgaaattcttggtctatatatgttatcctaggttgatgagttctctcgaacctcagttgattctatatgggctgtgggtgatgttactaacagggtgaacttgacaccggttgcattaatggaaggtggggcattagcaaggactatttttggcaatgaacctacaaaaccagattacaggtatgcatgtatatgtatttttagtgtgtatatacatatatatataacatccatataaatttgtattgatcttgaaccttgcgattttgatgcttcatgttcccttatttgtgtatacaaactgattgttcttggtgagcattaacaagaattcaagaaatgctaaattgtgtaccttgtaaacagttgtcattttgtgcacattatgcattaattatctcttgtggcagtagtgcataagttcaaacacatccgctgccccatccctttctttcttcacaattcaaaatgactaacaaatctgatttttttttgtcaagttctctatttaacattataattcaatagtagaatcatgtacactgtaatttggcataactgttgtattaaactctttgatatgcatttttacagtgctgtgccatctgcggtgttttcccaacctccaattggacaagttggactcactgaagagaaggtattgtaaacttacaaacttgttaacttgcaaaaacacacgagaaatttaagtaaactatacacttctgtaggcgatcgaaaagtatggagatgttgatgtctacacatcaaacttcagacctctcagggccactctttctggtctacctgatcgtgtatacatgaaggttatcgtgtgtgctaatactaacaaagttctaggagtgcacgtgtgtggtgaagatgcacccgagattattcaggtttgtgagttctttatttaatatttagccatcattttgttcatgtttgcctaatatatttgtggtgtacattactatgacagggtattgcaattgctgtaaaggctgggttgatgaagcaaaactttgatgccaccataggtgtccacccaaccactgcagaagaacttgtcacaatgagaagcccgactaggaaggtccggagagatgctgtggatgaggtttgatgaacccataatttacagttacatactccttgatataaatattacatagtgtacagaaatactgaaagtataggctcatctgtagaactgcctggttcataaagtttgtttccttatgtttattcttgccttttcaacttcaggccaaaatgaaagatgaggccacaagtcagaagtagatacacctgccctgcataaatgaggtaatcatttggagtaagggttttttctttttgaaatttggatgataaattttgtgaaacaatcgctaaattgacgatgatttttttctgtttattgcaccatctgcttcattaacatctttggcagttgtgcaactagaatgattattttcggttggtcattgtatgagcacctaaacaagtcatgaattggattatacatcctggagacaaatggcaaaactgtccagacatatcttttgatatttgcgattttcttttgagatgtttgtggtccacaatcatcatcttctgaaacattacaaaggaccactaaaataaatctttctaaatttccaccaaaattatctgagaatttagtttgagttctattgccatgagctacctaactatgatgtagtttgtgttgcagtctgaccagtcgatttctaaccgcggaaacaacagacagatatcggtatttcgagcagtaccagagaaatccaacccacgattgcagccagtgaagaacggagatgagttacagcaaatggctagctatctcgtatattgcatggtttataagttcattattatagaaaccagctcaagttccttttatttttttggcctaacatgttactgaaagaaatgcttcaggtcccggtcaaaaaaaagaaagaaatgcttcaggatgttgatagtattgccgcatgaaattttttgattaaacaacaaatttcttgagtaccttctcctgaactattgactggtttatgtacatgtgatccgtggatcaagcatccatctattttgcttccagttccagatatccagaggtatattatataatatcactgtgccgttctgaatgtaaatcgtgactgcaagttgtaacccattcattcgtggtgtggtcctacacactaagctttttgttcctgcttttgatgctactttactgctttgtgatctcctggtcgcaacagcttgcattcaaggatgtattagtaagggtatgtttgctgcagcttctttcaaaatcagaaactcattcaaacaatctagcttttgatttagattttaagaagccatagttgtagaatctaggaaataaactagaagtcacaagctaaaaaacctagttttttttattcttagaagcttagctaccaacaagcttaaataggcctaaaacaaggtgcggtttgaagttggacttattctggtgacctggtcagcaaaggtgcttagaaggtgccttgttaagctgattaaaaagtgacgcttttgttcgtgcattgatatttctccatgattttctttgtgacctgaacacgacaccttgctgcacgatgcttccaacggcagatacgtacgcacactcgttgggatgggatcgtcacctcggtgtttccgtttcattctgggtcgatctggcgtcaacatgtggcgtggcgacaacaacaacaaagtcgtcaaaacctaggagcataataacgaggaaatcgctcacggctcctccaacagccgaaccggttctagcgaaaattcctatgtttcaaattcactttaatccattggactacagctaattaggaaaaagattaatgagtgagcttttatatttatatccttactatccctaaactatcacggtcgatcgaattatacccttaaatcacaaaactagacattcttcatctataactatgcaaactggacaaataacccccccggctcaatccatggtggttttaatcctacgtgcgcggtagttttgatcctacgtggcgtgcgagaggatcaaaaccaccgcgaattgaaccgggggttatttgtccgatttatatagttgggaggtgaagaatgtctggtttgtggtttaggggtgtaattcaatcgaccactatagttcagga

SEQ ID NO: 231 - DNA, 8731 bp, Oryza sativa
accaagtcgatttctgcaacattttgggagcccttgaagagcttcttgaggcagtcagctgcaaccttgagcaatccttaactgaatttacagacttcaagttgaaattttgtaggtgcgtagcgtacgaagacgcgtgtgagagctttgaaatgttgcttcagatgtatagaacgactaggaatcagtacacgaggggaatgctagcattgcacaggaagcatgaaatttaacttctggagtttggagaattccctcctgacagataaagttcagtgatcagctaggtgtatcatttctccctgactagaaaatctgtctggaaacatttgccccacctcaatcatccacaattctgattagattttaactcaactatcatggtcttttgtcttgtggtcttacagttctgattagttacaacttgagttcactattgtcatgatatgactaatgataaaaaatgaatcacttgctcatgctgcaaagctccacagaatctctctgctcaagtctcacactctcacatgaccacctgatctactgctacaaaactgcaagttgataagcaaacaaacacaatttgttgccaccgaccagatggaatccaatctatgacctctggaccccaaatcaacccgttggcgctgcacctgcaaagagatgacgtttctaaaccgctaatctcctcccccaattattgcaccatctgagggtcagtcataacctcagtgacagtcttgtattttctgaatttctggctgcatccccccccccccccccccaagattataaataacaaacaaatactaaatgtacaatttgcaggtcaatgaacgctgcacataaacaacaataaatgggtcgctgctgcgatcggaggtagacgtgacaaggagagccgcatcttccatatccaggagaagagaaaagatttgataaatcgaagaagaaaaaattttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttcgtgctcggtttcgtctcgtttttgctgatgacaatgttgtttgtttgatgcaggttgagtgagttggtgattatctgtagggggtgaaaatggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctggtactgcaaatgctgcatctcacagtgacgcttctgttcttggtttgacccacacaacagtagcagtagcagcagtttcagactttcagatttcagataagccaaatccgcactttttactagcaccaatttagtactactgctacagtttgtaggttttgcactgcaccgttcgattagggaattggatggttgagatatgaatcataggattagctgtgagcaaacattagtagagtacaagttttgccttaaaatagataaaagtttctcaagcatggtggtggctggtggtgactcacactagctgcttttcagttcccacacttgaataataatacttcaggagtgcgaatccccgatgcgttttcctggtgaaagcagcaatatattaacgaatctgcaatcctttttgccacattctgcagggttggaggaactggaattgacctcagaagcaaatcaagggtatgcacttggtatcatcattatcacaaatgttcttgttcttggataaagataccagtgctgtctttaggaagagaagttgcgtttttaggggattagcagtgtacacagcgcctcctttcgttatttactttctacctctttggcccttgaaagaaaaatcgaatgcctgtatttcagacaatatcaaaaccagtggaggacccctcggagctaccaaaatggaactacgatggatcaagcacagggcaagctccaggagaagatagtgaagtcatcttatagtaagaaaaaatattgcagtacatgtgattcttcagtaaagcattctagatttctaattctgtctcttctcttgcgctgtcccccctgatttcagcccacaggctatattcaaggacccatttcgaggtggcaacaacatattggtaccatcccttctccttaatgttttatccttttcaaatgtgcttttcatactaacctgcacataaaagattagctgtgcaatggttagtggcgcatgtgaaaaatcgcatgctagctgatacaaaatctgttgtttcaggttatgtgtgatacctacacaccagctggggaacccatccctactaacaaacgtaacagggctgcacaagtattcagtgatccaaaggttgtcagccaagtgccatggtaactaaacatcaagcacttttgtgctataaattacaatagaaaacatggtttttccatctacttttgtttacatgtgaagttgagacattttctatgcactatttttctaggtttggaatagaacaggagtacactttgctccagagagacgtaaactggcctcttggctggcccgttggaggctaccctgggccccaggtattatactgaacaagaatggagctttgttgatcagataataataaagataaggatggtttaagtccatgtgttgtgtatgcttaataaaacactatcatgctggatattacagggtccatactactgcgctgtaggatcggacaaatcgtttggccgtgacatatcagatgctcactacaaggcatgtctttatgctggaattaacattagtggaacaaatggagaggtcatgcctggtcaggtatgtgtgttgttatttgtcaattagttttctgaatcagtggatatgttttaacttctatgaagaacaaatcctagtgtttaacaagtgaaacttcacaatccttattcatgcagtgggagtaccaggttggacctagtgtcggtattgaagctggagaccacatatggatttcaagatatattcttgaggtatttcaaataataataaaatatttccctacataatgaaattttggttcaaataataataataaaatatttccctacataatgaaattttggttttctctcttaattttcaaaccatggtttaaaaatcaagctgcatgcatattattgccaagacgtttacatgtgcacattttgtgatccaccttgacattcttacaaatcgcttgttgaaagccatcatctttgttttgttcaaaacatcagaatgttgcatcctatgaatggctatacttttgcttatatcaatttctgcatcagtaaaagcacttctaattatcgtttgctcactgtaatcagagaataacggagcaggctggtgtagtgcttacccttgaccccaaaccaattcaggtatgtcctagtaaattgtccccaactttaaagcgaatcaaacgttaaaggagactgaacatatataatgtactgacagggagactggaatggagctgggtgccacacaaactacaggtttcattatcttcttctgatgttaaagtatcctgcagcataagaacaaagcttagaacacttaacacagctttgctgacatttttcctttgagagaacaactttgttgaccgaactaatgcctattcagagacaaaaataaattccttgggaatttgataggaaagaaaacatatgtgtaagacctaaaataccaatccaaatacggaccgaatatcaagtgttcgtaggtgttaaatctattatatctataaagtaatagaaaaagaagcctccacgtttgctctcacggtctagaaaatcccccgttaatcgaaagaaaataagaaaaaaagaaaaatagaagggtattaggattaggttttgtgttaacggaaaaaaaaacaaagagtaaacggacaaaaaaagttggaaacggaaaaaaaaagttggaaacggacaaaaaaaaatccaatcggacaagaaagagagaaaaaagtgaaaagggacaaaaaaaaagaaattccaatgttaatcaagaaaaagagaaaaaaaataaccattgggtcatagtagatccagattataacagtttagatttaatatagggtgtgtttggattccaattttttttctaaaaacatcacatcaaatgtttggacacatgtatggagcaataaatgtgaacgaaaaaaaaaccaattgcacagtttgcatgcaaattgcgagacgaatcttttgagcctaattacgccatgattttacaatatgatgctacagtaaacatttgctaataacagattaattaggcttaataaattcgtctcgtagtttcctggcagcatctgtaatttgttttattattggactacgtttaattccttcaaatgtgtgttcatatacttcaaaatttttacacctaaacaactaaacacggccataatagttatataactaatataaatctttttttacggaagcttaaagtaactataggaatcgaagtaaaaaaagcttgagatggaaatgaccaaacaaaccacatgcacaagaaaaaaggaaaaatagaagggtattaggattaggttttgtgtaaatggacaaaaaaacaaagattgggtgtggtgtaaacagacaaaaaaaaagttggaaacggacaaaaaagaaaaaatagaaacggacaagaaagatagaaaaagtgaaaacagacaagaaaaatagaaattccaatgttaatcaagaaaaagagaaaaaaaataaccattgagtcatagtagatccagattataacagtttagatttaatatagggtgtgtttagattccaaaaaattttggcgaaaaacgttacatcaaatgtttggacacatgtatggagcattatatatggacgaaaaaaaccaattgcacagtttgcatgtcaattgcgagacgaatcttttgagcctaattatgccatgatttgataatgtgatgctatagtaaacatttgctaatgacagattaataaggcttaataaattcgtctcgcagtttacaggcggattcagtaatttgttttgttattagtctacgtttagtacttcaaatgtgtgtccgtatacttcaaaatttttacacctaaacaactaaacacggccataatggttatacaactaatataaatcttttttttacggaagcttaaagtaactataggaatcggagtaaaaaaaacttgagatggaaacgatcaaacaaaccacatgcacaaagtttatttctaatttaaccaattggattaagaactaatgcattaacttatttaagtaataagggcatgtttagatccgctgacaagttatttcactctgtcacatcgaacgttttaacacctgtatgaagtatattatgaagtattaaatataggcgaaaaaataactaattgcacagattgcgactaatttgcgagacgaatcttttaagcctaattgctacatgatttgacaatgtggtgctagagtaaacatttgctaatgacggattatttaggcttaataaattcgtctcgcattttacaggcggattctgtaatttgttttgttattagactacgtttaatacttcaaatgtatgtcagtatatccgatgtgacatggcaaaaattttcacccctggatctaaacacagcctaagaaaattggactccgcgtttgctctcatggcctagaaattctcatattaatcgaagtccatatagaaaaacaatttacatagataattaaaaaataatgaatattggaagagaaggctagagttcatactggtgtacaatttataactaattgaaatacggaatcagagaaaaataataatagagtccatatagaaatacaattttaaatagcttaaattcgaaattaaaaaaaggaatattgaaagaaaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttgtgtttgggattcagaaaacactaacatccactggtatattaagcaaccaattgagccctccaaaaccagagtaacatagtttttatagcaaataagcacatcatgtagtaactgcccctattgctcatttgtacttccgtaattcaatacttcgttgttacgctccaaatatttcaggtttgagttgaaaatacaaacatttttttttctgaaactatgaaagaacacaacatcagcaaatgcatgtcttgtaatgttgttttcacaattcacaaatgtgcaacttagtatttgcatttttcaactcaatcttattaacttgcccttacaatgctaaatctccttgctgataggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttttaagtttcttcagtcctgcgtccttccctcgaaataaaaatgtttccttgttttttatcccgggctaaacctgtagttgcgatgaaaacgtcactattggagacttggagaatataatttgacagttgacactcgaccatcatggactggtgttagttctcagctgtggtcagggttcacctttctgatcgagtgcctgacctgaatccgtagcggaatgacatttttcaccaaatttcgatcaaattttggttgaattttactgtttcaaatttgaattctagaaaaccattcgaaatttcactcataatcttctttcatctaggggtgcaagtgggtcacccacgaacccatttataggtcaaaataagtgagttcgcgggttagtttagcctataaataggttttcgcgggtagccacttgcacccttagtttcatccctcgtcaaaacatctaaattttgcggtttttggttggttttcgtcgaaaacttaaaccctggctgtgtcatctctgcagctagctaacagcaatgcatgaacagagcaatggcaacacatacagaagaagcagcagcagaacatcgatcgatctcttgcgaagaagggtacatgtaatttcatgacgaaattaacagtccaagagagtacttagtactagtagtactcctactaactaagctagacaagaagattatacacggacaaacagagaagctgacagcctatggtttctttgggtgcttgcgtttgggtggagacggagagtgcatcgccaccccgctgtaatcagcgctgtcgatcagcccttctcttgcgccctcatcatcatccacccaacctgccttcgtctctgcagtctccttcgtcgtcgcctccatagccactacctggacatggacacaccatgagcttgacaattatttcttgtttttcatctgcatttctagctgaagatggtagtgcacaatgtgctattcactgacattaaaaaaagattatgcagcagaggcaggcacaagaaaacacataaaaattcagttttgcattttatgaa

SEQ ID NO: 232 - DNA, 3024 bp, Oryza sativa
ttgaaagaaaccatttttcgtttgcagatgtgtggggaaagatacaaagcagctgaagatttactgaagctttctggtcgtcttcgattgctcatggctcaggttttaaccattaataatactgcgtaatgagtcaatattcttagtgtataagttaatgatgatttaatgatcatgtgcgtacttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacccaataactttagtccaagatttagattggtgatcactgcatcactttgatcacaccaacccaacaagtagtccatgatccaacagatggtgatcacaacatcacgttgactacaacgaccgtgtagccaacccggcgaaactttcttcgccttcaactaaacattgacaaaaacgacatgctaactggggcctcctgacgtgtccttccaacccccccggcctagtaaagagataaacgaaccgtcggcgccatccaatttgaaccgtcgccggccggtgctcaccagacaccagagtaccagacccattcaggccagggctcaccaaccccccacctttggcgctacctatttaaaccgctagctgccactctctccggcatccactcaagcagagcagagcagcggcaaagcaagtgatctctttagctcggatcatctctgcatttgcatttgcagctgctcgtcacggcaatggcatccaccaacagctggacccacgagatcgagtcgccggtggccgcgccgcgcctgttccgcgccgccgtcatggactggcacacccttgcccccaagatcgcctcccacatcgtcgccagcgcccaccccgtcgacggcgacggcagcgtcggcagcgtcaggcagttcaacttcacctcaggtatatatatatatatataccgccgtccactaagctcaatattccatcatccccgagatgcacttgatagtgcggtggcaaggggtgtgtggtttcaactatgacgtccgtcccgtgttcaatccccaacacgttcataattacattcacctgctgttctttctgcagccatgccattcagccacatgaaggagaggctggagttcctggacgtggacaagtgcgagtgcaagtcgacgctggtggagggcggcggcatcggcaaggcgatcgagacggcgacgtcgcacatcaaggtggagccggcggcgaacggcgggagcgtcgtgaaggtggagtccacgtacaagctcctccccggagtggaggtgaaggacgagatcaccaaggctaaggagtccctcaccggcatcttcaagaccgccgaggcctacctcatcgccaacccggacgcttacaactaaatcgtcatcatgcctatgcccccaaaatatgtttgataatatttgatctttgcgagtgtgtatgatcgaaataaagctgcttccaagcagtgattgagaagtgagcagcgagaagcttggtgtgtggtttggttgctgtcggagaatggttttgtttgacatgatgctgtcaacaccggctatgttatgtatctatctagcatctacctgttggttttgcgtgggaataaaaacatactataaaagataatgagctcggaagctactatctgtgaactgtgaagtactctgctttggaagatatcagctcactgtcttctgcttcctcatagaaagtttcactgaacatgattacatttcactccttttcaatgaggattagatagcatatcagtaatcagtctggtgaggccgtcgaaaattgatttttgtatcaataactattggttgccaccatttctacctatcatgtagtactacactagggaggtggatttttttcccccggagaaaggatgtccctctcattttaatgttttaataagatagataaatatgtgagatatcagtacataaatatgtaagtatagatcatttcccaaaccttaatgaaattggatgaccttccttcagctgtcccggaaaaaaaaatcaaagtagaaaaattaataaatttggctatgtagcgtaagttgaatttaaacttacccctttatatagtgatatatcatatatttttctttcttgttattttttttaaaaaatatgatttagatggcatgcaaatacagacgagaagaaataaaccttccttactagttactactctatcttttaaaattctaatagtatactgctgtactagttactagttagaaggaaaaatcgtttttcatactgatacaagatacaaatgatgtttccttgtcgtctaatccatttattgcattcaaattaactttcaaaattattttgcagcacattctaaattattttgcatgtctaaattaaccagagcaaattttataaaaattatgattgttttgtgtgtgttgttggatttagggtagtatgcttgtttgtttggcctgcggcctgagtccgggacatttaactatttgcaattcataatccctcatgtatctataatatgtgagtatagtaacaaatttttaattacccattcaaaagtgacaaatagttaattattcccatgagtccctgttgagagttgtgtgcggtgttaccgtgttcgaaagctggag

SEQ ID NO: 233 - DNA, 5183 bp, Oryza sativa
ttcgggccggcggcgtacacggcgtcgaagcacgcggtgctggggctggtgcgcgcggcggccggcgagctcgggcggcacggcgtgcgcgtgaactgcgtgtcccccggcggcgtggcgacgccgctgagctgcgggctgacggggatgagccccgaggagatggaggcggcggcggagccccacaacgtgctccgcgggaaggtgctcaaggcggcggacgtcgcggaggccatgctcttcctcgcctccgaccaggccgccttcgtcagcggccacaacctcgtcgtcgacggcgccaccaccgccgtcaactacgccgtgctccagtccgtcggcctgtgacacggaccgacgccattaatttaatttaaaagaaaaacatatctttacgataaattttaccgcgttttgactggaaagatgatccctttttcttattaggcgatcaatggtgacgtggtgtcatagcatgtggtttgtaaaattgtgtttgttcgtttgtaatattatatgttggttgccattgcatctcatcatgatgcaaccttttggactcagtggagcatgttttcatgtaacaatttttgagttttgaatttgtaaatttgtctgacataatttgtgtttatgtctcttctcggttagttctagtatcgctctgcgaatgaaaaatggctattgtgtttttcaatctactccctctatctctttttatttttaacgtggattagttaaccggtgtcaaataaatgagaatggaggaagtatctatttttttcatttgacgttggttagtttattagtgcgcggtgttaaataaatgagaatggagggagtaatctagtaatatttttttaacgtcaaatttataagggatatgtagcggtacgataatctgattttgtgtcaaacgtggaggacaccttcacatgttcgaattcactcgaaatttatttttttaaaaaaaaacaaattcataagatgcaaatttagcaatgacgtcacgcatttccccttcggttgtgttcacaccgggggtctgcacttctgctccctctccgcctccggcgtctcccgctcgccgccgccgctgtcagagatgggccgtgctccggcgaaacggaagccctcgtcgccgccgcctcctccgcctccgggccgttgccacttctggctccctaacaagcgccgccactgcgccaacactccgctcccaacctctcagtaagcagctctccgagttaccttcctgcttaacccctgaaccctaaccctaaccctaacccccatcgccgcctcctccccctcctcctcaggtactgtgggaaccacctcccggattccgcctccgatgccggtgcgcccttccgccgccttgtcccctgccccgtcgacccctcgcagtaagaccccccaaaatcctataccaccgccaagtgatctccatcaccagcgtccctatccgctaatgccgccttgtcttgggcagcaccgtgctcgaggagaacctggaggcgcacgtcggcaagtgccccctcaagaagcaggccgcggcgctcgcagcgcagccgttctactccaagggcatcaactccggtgggggagaaggcggtgggggtgtcacctcggccgctaagcgtgcattggtgcacaagctcaccaaggatgaattgcgcgccttgattgagaagatcaagttggcgcatgcgtcggcggccatggcaatgcgtgattcatttcttgttacagatgcttgcgacaattggatgaggaaccaggttgataggtgtgtgtgcttaccacttttgatggtgtaagggttggatttttttgaggattttgtagtgaggagtgatttaagctggtgtgttgggcaggaaggtgccataccaggaaaagcatgtcacgcagcaggcatccatcattggcaatatggaggcatttggtttgctgcagaagggaggtgaggtggcggaggagaatggtgtgaaaaatgctccggcagtggtggaattcggagcagggagagggtacttgactcagatgctggcagactgctacgggattaggaatgttttcttggttgagagaagatcatacaagctcaaggtcagtttctctgttcatattgcctcaggatgatatctactttgagcttgtcaaacatggacagttgccattggttattcgaccttttgaaatcaatttcagcttatttttcatgtagaaatttagaaggacattacttatttctgtgccagattagaatatatctgcaatttattggcttgctattatgctcaacaatagttaattcagtattttgtgttcgttgtttaagatgtctcaactttaagtatgaaggcatgtataggttgtttacagtgattttgaatttaatgcactgtcctatctgtgtctagtgccttatgaagtttgagtttgtttcgacacattgttgctgtattcctcatgatttgcagtaaaacttttattgttttgttattttctgaaagtgcttgttgtgttaaatctaatttcagcttaggttggttctttgactgctctgttgttgccctgtttcttccttttctctgtactttctaggctgatcgaagtttgcgacaaaatgaaggcgttactttgaagcgtttgagaattgatagtaagatttcttttcattctttgaagtggtttttaggcacctttggtgctgaaggccaaatgtgtttgttatcagttcacttatatgcatgtgtgggtggtctctgtgttcttaaaacgaattgtcacattcataccctgtgatttgagatagtaagagatataagcactcataagaaacataaacacaatgcagttgaagatttgaaccttcaaggaatagaggcattgagtggacttcattatctagcaattggaaagcatctatgtggacctgcaacaggtggttctaagttctaacatatgaaatttattcatggattttatactccgacaaactgatgtataatacatgacaatgagattaactgattgcttgattgtatataatgaatattgtcctctccagatatgaccatgatgtgctgccttcatgaacggtataaccaggcacatgaaaaagaatatggcaaaagcaatctatgtggccttgctttggccacctgctgccaccatctgtgccaatggaatcactatgcaagtaaatttttttttgccagccaatgctgctaattatttttgtttaggatgtatcgtgcgattatgtcgcttacagctttgactactttatataatattataccgtcctcctttgaaaattgcagtaaaacctttagattttcttcttagagaataatgttcctgttctcattgcagataagacattcctctcagggttagggattacagaggaagatttccataccatgacttggtttagcagctgggctgtggatggtgatcacagctccccggattcctctttagaggttgaagactcatctgtagaagacaggtaagaaccattagttgaactaagccttagttttcttctacattctgatagctataaaagatcatctgttcaaatcttggtgggaagtatcacccttttaaattgttatgatgcatcatgtatgggcaaaaacatggtacagttcgttttcttgaatcattctcgaatggtgtcacggaagcttaatatgtttgtcgctacgtttttttacaggtgcggaaaagcagagaagtctgatgtggaggtcagcggaatcgatagactcatccgaagtataccagcaggggagagagctgccttggggtttatgtgtaaagatattattgatactggtaggctattatggcttagagagaagggtttagatgcagatcttgtaagctacgtcccatcaaatatttctccagagaatcacttactcattgcaaaatgtacgtctttatcaggatgaaaaagaagcttacatgttccattttgaacctgattaagttcgcaaattttggttgtataatttatgacatatggtgctcatcagttcagtgaaaaattaggtgtgcaagccaaaaacatccggagagcatgctatatctccatgtgaaatttcaatatgagagcagtctccatgtgaaattccagtattgaatcacattttgaatgatacatagtgctgaaatatatcttttcctatctcactagttaccgttgggtttgatattacaattatgccgatgcgtatagcgtaccattaacaagctccgagataggaagtatcatgatagtactttgagaaacttttcaaatcgacctggttttcacgcattttgagcgtccagtgcacttggacaacaaatatgttgggaaagattcagcatcgtttctgaatcaacatttgatctcaagtgatatatagacaagaaaaaaaaaggagcgcaaagacatgaaaaaaaaaagttctattccgagtctacaacaatacaacactcacaaagcgcatgaaaaaaatgttttattctgagtttacaacaatacaacgctgacgaaaaaaaaaagttttattccgagtttacaacaatacaacaccgacaaaatcttgtagccacaaaactagaagtctagaatgaaccgaaagcagccagaagcatggctccaacaagaagctctggaaagaatgaattctacaaccacaccatgaattttatggaacatatgttctgtttacatgttaggcggtaaatataatataaataataataactaatcaataataattaataatgacggtatgtaagcttttatataaacgaaacgatcctgctttaaatacaaaggatcatcctcctcacatagtactgttattttgatcttagccagcacactaagctctcgacttacgtaaaacacaactacacttattccattctaagctcctcctcacattggtccacgttctaacagctcccatctgaatgtaggagctgcataaacctttggacaggtgtggagtagcaggccgacgcagacgcagatgacggcgatgcccatcacggtcagcatcgctggcctgtacaggaaggtcctcgccgtcgagttggggtacatcagggcctgacggctgcaggcgttgcagctcggtgctggcggcggcacggtcatgccgatc

SEQ ID NO: 234 - DNA, 8119 bp, Oryza sativa
tacaattaacaaaacataattaataggcttaggcataatacccaaatccgaagaaccgatccaaaaaacccgatccgaacccgaacccaaaattttcaaatacccgaacatgtctaaacttcaaaacccgaaaaacccaaacccaaacccgaataggtatccaaacatatctcaaatataagtatatattagttatatttatacttatatatagaaaatattaggattttttggatattttagatatttttgtgtattttaaaatatattcaagcaaaactactcgtgttgttttgggaatttttaaaattttcaagtaatttaatagatttgcagacaaaatttgatatttcaatatataaataaactcgaacccgaaccgaacccgacccgaaatcttaaattacccgaacgggttctaaacttctaagcccgaaaacccgaacccgaaatacccgacccgaatacccaaacgcttaggactaataattaataaaaaaatagaaatctacaaaaatatttagaaaccaaacattgttgaaaatatattttttatatatgccgtaatctcgtaagttaattttacatcatacaaattaatattaaatgagttaaaattaataaattaaaatattcttactaaaagttattgaaaagttaaatcctataagctaagttatttctctcaaaatgttctattttcacttatgattacattagttaaagacaaatttgttaattttccttttgttgaataaatgttaaacatcttatcgtttgatttgacacgtgacacgatcttaagagttagtaacttgtaaacatctgatcgtttgacttgacacgtggcacgatcttaagagttagtaactttaaaaaccatactttatataataagatatatatatgattttaatattattttattagaatttccttttctggttttctaatgtaaaaatggaaatataattatacttacgtggaaaacgaaaattgtattttattttaaaaaagccgggaacgaccatctttctttcgtcggcgatttttcagagattaccagagagacagcgagaaacatttctttcggcgatggaagcatttcttaaggaattcggagattattatggatacccagatggtcccaagaacattcaagagatccgcgacaccgaattcaagagattagataaaggtctgtttttttttgttcttttttgaatcatgtatgagttgttcttctcttggatctaatagggttcgaaacttaagctttttgagctgaaatttctatgagtcaaaaactattgggttgggtcagtggtggatcagctccactctcactacttgagaatttcgaattgaattaaaattgagttacagtgtttctcgatggaacagtataacttatgtttatgtatgtaattgaagaggtttaattgatccagtactcatatgaacaattccgttattgctaagaatgggatcatagtgttttaatgatgttctatgtagtgattttgtggaaacaatgcttagtatccagacggatttaatcattttccttccagtacaatattcgaatttgatacttataagatttttgtggtatgtgcaggtgttgtatacttggatcatgctggttctactttgtattctgagttgcagatggaatatatttttaaggacttcacaagcaatgtttttggaaatccacgtatcctcatcttttgatcctcataggataggctttacattatcttttattaggctttcaatctcagattttaatgacttgaaagatgtgaaactttcatgttgattggtgaaaacaacgtagctaagctctttttagatataatgcctttttttttgtgagcttatgttgttgaaagaggttccttaatagtgatttagatagtcaaagtgatatcagttcggccaccagtgaccttatagcggatgctcgacatcaggtaccacattctttacatttcttcaactgatattattggtcttcatcttataagttggttccatatgtttcaatcaatcttcattgcacactggagttaggtgcttgaatactttaatgcatctcctgaagattacagttgcttattcacctccggagccacagcagcgctgaagcttgtcggagagacttttccgtggacccaagacagtaattttttgtataccatggagaatcacaacagtgtacttggtattagggaatatgcattagctcaaggtgcttcagcatgtgcagtggatattgaagaggcagctaaccaaccaggccagcttacaaattcaggaccatctatcaaggtaaagcatcgtgctgtgcagatgagaaacacttctaaactccaaaaggaagagtcaagaggtctgttagcttgataatcttttctttcttctttcatcctgaaaagaatctgttcaagatgtatcacatgttatattcttgtatgctgcgtatctaatcgacttttctggtttgcttatcctgtgtttcactctattgtatgtttacaggaaatgcctataatctatttgctttcccctcggagtgcaatttttctggcctgaggtttaatctagatctggtgaagttgatgaaagaaaatactgagaccgtgctacaaggctccccctttagcaagtaggtttcacattctctctattcagctctcattttcctcagtttcttgcattggtataccgctgaatgtctgcttggattcatattgctgaggtttggcgatgctatgcctagaattcaactccgtgagctcagtgtttttttccgcaaagaaatttttgaaggaactactttgaattgatttgatacttatttctttgttgattctaagtgtgtataggacttgaagaggttcattcgtattagtttctattgtgtatctctcatcatggcttatatactttttataaggagcaagcggtggatggtcttgattgatgctgcaaagggttgtgctacactaccacctgatttatcggagtatcctgcagattttgttgttctgtcattctacaaggtatctcctggattttccaaaataaatgaagttcttttgttatcaaattttgactttcttgttttcggctgatgtcatgaagttatttggttatcctactgggcttggcgctctccttgtacggaatggtgcgtaaattgttccctaggtttatctccttctgtaaatcttcacaaatcaaatctgactgtagttcagaaacattctcgttaaattcattacttagatcagagcatttctgttgttaagatctctgatattgttttcattttattcttattccctttgagataatatctcaaacaagatcaatatttatcatttaatgaaacaaatattgcaaatgctagcttctgacatgatttttcccgttattataatctacagatgcagccaaattgctcaaaaagacttattttagtggaggtatgcatctcatttagttgtgtaaaatggttgaatttgtatggcatttgatgaacataatacttacaggcactgttgctgcttcaattgctgacatcgactttgtaaaaagaagggaaagggtggaggagttttttgaggatggttctgcttcattcctgagcatagcagccatccgtcatggcttcaaattactcaagtcgcttacaccttctgcaatttggatgtgagtaaaacttttgctccgtgcagggtctccaatttttaaaatttgtcgaaatttttaccttggaagatagtctagtaggggccttgtctttttttagagactccatgttgttgatttttctttgaaattttcataagtttaaagttccctccaaaccatctgctattgtagaagctaaagtgtattctgtatctatttactaggcacacaacgtcactttccatatatgtgaaaaagaagcttcaggctttacgacatggaaacggggctgctgtatgtgttctgtatggcagtgaaaatctggaggtcagttctttcatgattaaaaactagtttttttctctcatattccattagttatagggcttcatctattgagtgaaatatatgcttcaacaaaaaggatagcaaagagcataggaagaaaacaagtatctatcgtttcatatttgaaaaatatcatatcatcatttactttcgaagtcacataaattacttcttcgtgtggccatagtttttgattcattctatgttttatgtttcagttatcttcacataaatcaggcccaacggttacattcaacttgaaaagacctgatggctcttggtttggctacttggaggtggagaagcttgcttctttatctggaattcagttacgggtatgttttggaaacacagttcagttttattctctttgaattcttccaccttatagaaaagaagttatgtaagtaagactagggacttgcactcgctggcaaggggttatctttcattaggccatttgaagttttgaacgctgaaattacatctgtcattttacttcattttggtgtagacaggatgtttttgcaatcctggcgcatgtgcaaagtatctcgagttatcccattctgagctacggtctaatgtagaggtataattgttcaattattttgcttatcattctttctactgctcctgattttagcagttcttgtattatatacttgacagtgacatccttttaatttaacacaggctgggcatatttgctgggatgacaatgatgtgataaatggaaaaccaacaggggctgttagggtttcgtttggttatatgtcaacctttgaagatgccaaggtatatgtaggttccttgatttaaatgtttcccaattccatgtatattgtcgaaaatataaacaaagctcattttcgacttgctgctacctaataaatataatatgcttcattcacagaaatttattgatttcatcataagttcatttgcttcacctccaaagaagactgggaatggaaccgtcgtcagtggaaggtttcctcaacttcctagtgaaggtacttgctctgaaatcttttacagtgctttgttcctagtaacaattcaactctcttggagcatttattcactcacatagtcacattgacataaaagggacttcgtatagttgattccgccattcattctctgggatgtgacttcaattaaagccaccatctttacatgcttacttttttgtaatttggtaattgatacttgtgttagccacacaaataaagtgcatgtagcttgtcaacttcgtatgatctttggaaaaccacagagtcttaacttgcgagatagcaaatacttcataaagtataaatggcgtctcttcccctttttgttgatttgcagaccttgaaagtaaagaatcttttccaagccactaccttaagtcaattactgtatacccgatcaagtcatgtgctggattttctgtgatacgttggccactttgcagaacaggtatttcattcaacttgcttggttactccaaattggtgctgctgttgtattagtggttgggctgatctctttggcatttatgcataacctgtgtttattttttgaaacataaaaggcctgctgcatgatcgagaatggatggttcagggtctgaccggtgaaattcttacccaaaagaaggtaatagagcatcttctatctacagctatgtcaccaaaattttgattttcttgggaatggcttctaggtgcctgagatgtctcttataaaaacctttatcgaccttgaggaaggactactgtctgtagaatcttctcgctgcgaagacaagttgcacatcagaatcaagtctgattcatataacccgaggaacgatgagtttgattcacatgccaacatgtatgcattgctccttatcatgtgctgtcttacatcagctgcttgtaataaatttgattttggttgcagacttgaaaaccgtaatgaggaaactagaatcaatcgttggttcaccaatgccattggtcgacaatgcaagttgctacggtattctagctctacttccaaagactgcttgaacagaaacaagagtcctggtttgtgcagagatttggaaagcaatatcaactttgctaatgaagctcagttcttgttaatctccgaggagagtgttgctgacctaaacagaagattagaagcaagtacgtttccatgtccttttcatcttacatctttttccttttcgcttgataaaaactgatttggttgcagaagacgaggattacaaacgggctcatgaaaaactcaatccacataggttcagaccaaatctggttatatctggaggtgaaccatacggggaagataaatggaaaactgtcaagataggagacaatcatttcacagtaagtccatggatccacacaagattcaaccataatcatatgcattaagtataaacttcatggttctctgttttcttaaaaagttggttcctttcaatgcagtcattgggcggttgtaaccggtgccagatgataaacataagtaatgaagctggactagtgaagaaatccaatgagcccttaacaactttagcttcatataggagagtaaaggttcaacattctaaaaccagtcttttccattaacaaaaaatgtatttgacaattatttgtgaagtaacctttcttggtgttgtcattggattcagggaaagatcttgtttggaacgcttttgagatacgagattgatgagaaaagacaatgttggattggagttggggaagaagttaatccagatattgaataagttcaagcttgtgtgtattatcgtctactatacataaaaataaacatatggagaagcatcaaaagtataaacatatggagaagcgtcaaaagcatatgagaacaaatctgttactggacctgtataccattgtattactccttcaagattgtagagaagaacaatatagctcagactctggaatcttgctcttataccaaaaactgtaatactgaaaatcaaacttgatgtaatactataatagagaagaataataccaaggttaattgcctttttgcttcataaacaattatacacacaaaattagtttttttttctttttctctgctgcctcctctggttctgtccagtggtagacagacgcctccaaaagtaagaaagtttcagactttagctattgaaacctgctctaagcagtatgatggtgaggagaggtcgtggtcgtggtcgtggcggcggaggtggtggaatgggcggaggaataaatcgtagatatctgagtcaagttattgattcatgcgggaaggatttaacaacggcggaggatatcgtcgatgatcttcgttccagatacagtaactttgcccgcttgactcggcaagtgcttctgctcaacgtcagacaagtccttaacgccagaaacaacaaagctgaggaggaagatgatgataacaacaacggcgatggggaagctgctgctgctaaaaggaagaaagtgtcttcgtcgccgtctcattcttcgacttctgaggacgaggacgctgtttacagcgagaagctgagtccaaggtttgatttgatcaatgacagtctacgagataactatgccaagctaaacaagaaaccaattgggtcgccgcctgtggagaagaatgttgaagttgaaactgtgggtaacaaaggtagaagtaagatggctacaatggggttgagaaaggagtctaaagactcactttccatcagtggaactactggtaatggtgatttggatgtagtgggtgataaaggacctacttttaaagattttggtgggattaagaaagtgttggatgaactggagaggaatgttttgttcccgattctcaatcctgaaccgtttaagaagattggagttaagccaccgagtgggattctatttcatggaccacctggctgtgggaagaccaagttggctaatgctatagccaatgaagttggtgttccgttttataagatttcagctacagatgtggtttctggtgtctctggtgcttctgaagagaatcttagagagcttttctctaaagc

SEQ ID NO: 235 - DNA, 6108 bp, Oryza sativa
ggcagggattccagaatctataggtaaactcaagaaattagaggaactccatttaggctacaacaacatgtatggagagatcagatgtgccatcgactccgagcagctgcacaaatctcgaaaccatagattagatatcaagagcaacaacttcagtggagagctctccaagatcattttctccaccttacccaatttttacaaactttacatcttatgcttaacaacttcaaaggaacaattccgcaaagcatatattcatgcatcaatctagttaagagttgccaaaattaagtagcaaaccaaatatctatgcgatattattaaagttgtcaaaaaaatggtagggcaaaaaatagcttcaatccaaacaagccctaaaataattttgctatggaattgtataggtcgtatcgagaaacttgatatcaaaatgtcaagaacttgatattcctcgtacaatcgtaataaaattggtagggcaaaaattagcttcaatccaaacaagccctaaaataattttgctatggaattgtataggtcgtatcaagaaacttgatatcaaaatgtcaagaacttgatatccctcgtacaatcagaataaagtttttctatgcttccctgtggtgtcccaactcccaagtgatcagcctgctgccacttgcagccctcacacgctaccttcttttttttagagaagggtattttttacccggcctctacatccaactggatatatacggccattgaaatagggaacttagccccgcaaacaacctaatctctgaaattcgctcctatgaagatttgaactcagaaccttggggtattactcaggtcactgcaatcactagactacaccctagcttacttaaactcttcaagcatcttcagaagctttgtttctttttacagacatgagtcctttcctccttaccaaaaggtatgcatccttgtgtaaaaaaatgaccgtattagtagcacgcaaacatatctgtcaagggaagagaaatggtgtcagatcaagtgaatttaggattgctgtaacaatgtcaatgtcataaggattgaaataaataaaaatgattaaaggaaaattgaaataaataaaaatgattaaaggaaaataacttgtacggtcagggaggcagaccactcagacttttcaatagaagattttatgaagtccttgacctgtatttcttttttatgacttcgagtagaaaaacagaataaagttgtcacgtgctaggaaaatggaagcaagagccacttctttcttcctcctcaagctctttcttgattagatcatctcatgctttgcccagtcagaaactcaggatacaaactaagcataaggcttccatgctagtatcaccagaaaaccatgcagccacctcattcttcatgcaagacacaaagcaacagatttcccatacctgttcttggtcttgcccttgtgctactgctcaacttcacctctcccaccagttcatgtacaaagcaagagaagagcaccctcctcaatttcctcacggggttttctcaggatgggggcctcagcatgtcatggaaggatggcatggattgttgcgaatgggaagggataaactgcagccaagataagaccgtgactgaagtttcattgccttccaggagcctcgaggggcacatctcaccatctcttggcaacctgactggattgttgcgcctcaatctgtcctacaacctgctatccggtgccataccgcaggaattagtgtcttccagaagtctcattgtcatcgacatcagctttaaccgcctgaatggaggtctcgatgagttgccatcttcaacccctgccaggccactgcaggtactaaacatctcaagcaatttgtttaaaggacagtttccatcctccacatggaaagtgatgaaaaatctggtcaaactcaatgtcagtaacaacagctttagtgggcatataccaactaatttctgcaccaactcaccatccttcgctgtgcttgagctcagttacaaccaattcagtgggggcgttccccctgaacttggaaattgctccatgctcagagtcctcaaggctggcaacaacaaccttagtgggactctcccagacgaactcttcaatgctacctcgttggactgcctctcttttcccaacaataatttagaaggaaacattggtagtacacctgtagtaaaactcagtaatgtggtagtacttgatcttggagggaacaacttcagtggcatgattccagatactataggtcagctcagtagattgcaggagctccatttggacaacaataacttgcatggtgagcttccatcggctttgggcaattgcaaatatctcacaaccatcaacctcaagagcaacagcttcagcggagatctaggcaaggtcaacttctccacattgcccaatctgaaaactttagatattgacatgaacaactttagtggtaaagttccagaaagcatctactcatgtagcaacttgattgcactgcggctctcgtataacaatttctacggtgagctgtcatcagaaataggcaagctgaagtacctctcgttcctatctttgagtaacaattcttttacaaatatcacaagagctcttcagatccttaagagctccacgaaccttaccaccctgtttattgcgtacaacttcatggaagaggtcattccacaggatgaaaccattgatggtttcgagaatctccaggctctctcagtagaccactgttcattatcaggaagaataccactttggctatcaaagctcacaaacttgaagttactatttttatccaacaatcaactaactggaccaataccagactggattagctcactaaaccgcctgttctatctggatatatcaaacaacagcctagcaggagaaatcccaattaccttgatggacatgccaatgataagaacaacccagaataagacctattcagagcctagtttctttgagctacctgtttatgatggtaaatttcttcaataccgtacacgtactgcttttccgacactgttgaatctaagcctaaacaagttcatgggtgtgatccccccacaaattggtcagttaaaaatgcttgtcgtacttgatttcagccacaacaatttatcaggacagatcccacaatcagtttgcagcctcacaagtctgcgagttctcgatttatccaataacaacctcacaggttcaattcctggtgaactgaatagcctgaacttcctttcagcattcaatgtttcaaacaatgaccttgaaggtcctattcccataggagctcagtttagtacatttccaaattccagctttgatggtaacccaaagctgtgtggctctatgctcactcacaaatgcaaatcagcagaagaagcctcagcatccaaaaaacagttgaacaaaagggtcattcttgcaatagtatttggggtgctttttggaggggccgcaattgttttgctattggcgcacttccttttctcgctcagggatgcaattcccaaaatcgaaaacaaaagcaacactagtggaaatctggaggccggttcgttcacctctgatccagagcatttgttggtaatgataccacgaggcagtggagaagcaaacaaactcacattcactgatctcatggaggctacagataacttccataaggagaatattatagcatgtggaggttatgggctagtgtacaaagctgagttacccagtggctccacactcgcaatcaagaagctcaatggagaaatgtgcctcatggaaagggagtttgcagcagaggttgaagccctatccatggcacagcatgacaatcttgtgcctttgtggggatactgcatccagggaaactcgaggctactcatatattcttacatggaaaatggtagcctggacgactggcttcataatagggatgacgaaaccagctcatttcttgactggccaacacgtttcaagattgcacgaggagcaagccagggtctttcgtatatccatgatgtctgcaagcctcacattgtccaccgtgacatcaagtccagcaacattctacttgacaaagaattcaaagcttatgtcgctgattttgggttgtcaagattgatccttccgaacaaaaaccacatcacaacagagctagtcggcactctaggttacatcccacctgagtatggacaaggatgggttgctaccttaagaggcgatgtgtacagttttggagtggtcctgcttgagctactcacaggaagacggcctgtttcaatcctctctacatcagaggaacttgttccatgggtactagaaatgaagtccaagggaaacatgcttgaggtcctggatccaacactccaaggcacagggaatgaagagcagatgctcaaggtgcttgaagttgcttgcaaatgtgtcaactgtaatccttgcatgcggccaactatcacagaggtagtttcctgcctggacagtgtaggctccgactgaagatatagaaggcacaaggcagtcaaggtagattgcagttatacaatgacaaaattgtagctcagtgcatagagcaaatgtggtattacgtagtagtagtttttctggtcttgtaacatgttgtgtacagctgctgacatattaccattttgcacttttgtatcttctcaggagtttttagtttcataaccagacatttctcctccactgaaggaagtgctgagtacgctcaattggcgaaaagcatgaggaaaagtataaacaagtgaaaagatcatcctgttccttttttcgctgggacggcagaaggacgccatctgaatttcattagattttaaaaggagtttagtacataaatgctcggcaaacttaaattgccggggcagcaccgcctcacggcagtgaaacgctaggagctacacttgtctacaaccagagctagactaggccagcctcctgccaaatcatcctgttctttgtgtgctcaaacaaatcgagtgcaaatgctaaggcaattaggtgatatcagcactcttgtttctgattgacgtacatagaaaccacaggaatctaatgaatacatgccagaaatgtgtgattcaagtatggaagagaatgagaatgcaacgcagtttttggggtggtagggataaaactctgtgatcaccagaagctgaacacgcatctagtcaatcaaaagaatgagagtaccaaccacgtaaaaagatcgatatagtgaagaatgtggtaagccattaactccagtatacaaggcaaagctacctgatggctccaagattgccatcaagaagctcaaaggtgaaatgtgcgtgatggatataaactaaacaaaagtttttaggaacactactcgtgctcaagttgcacaggcatgaaaagtaacaatgactgagaacattaagtttttaactcagaaattaagtcagaatggtttcggttcaagtgaagatactaggtgttgccagatgtttgttgccgatcaacgcattcttaataccggaagagaatagataagtgaaccacaccagcacaaatgctaagccctagcatgggacggggagataatgcagcatcactaacctcgcgaagccgaagcgcttggagagagcttggcattgcagcacgcactcacgaagcatggtcccttcgcctccacgagatcttcaacggccggactcgccgccggccagattctcgagcatttcgccgaacaccctgagcgcaccgcctaacagcgaagaagcggctccaccacctccgctcggccgctccaccaggccagccctggcattgcgtcgaacagtcaaagggcgcggtgggcggaagccaggagagggatacggaaccgcaattccggccacccgtcgccgccggtcgccgtcgcctccccccgccgctaatctggaagaagatggaagctttcgggctcgtgttgggcccgaagggaaacgaccacacgaggcccacacattccagcccaacttaaggctaatcgatgaatccatcccttggcataacggcgatgtctatgattttatggacagaagcactagtatgat

SEQ ID NO: 236-237 - skipped (2 entries)

SEQ ID NO: 238 - DNA, 3304 bp, Oryza sativa
ttattagaaggagatacgaaaactttataataacataagaaggaataaattccaattccctcaaaaggaaaaaagaagaagaaaatattccaatcgaaatagcccaaattatccgccggaaccagcaagcttgcttcctctggtttggacgtggccacggcacgagcagatacaacgcgctggcgagcacgggcgcggatcccataccatcatacgggctgggaataatcccccaagtgccgattgattcgtggcgttggaatcggccgtcccaatcctcctcatcatgcccggaagaggattttgatccctcgagaggatatcccctcgttgtttgcatgtcactcaaatgattataaaaaaattaaaaaaaatttaagaagatgtattaatatgtgatatatcactccacaaacatacaagtaaaaattcaacttctatatctcgcaacgaaaaaaataaattcggctctgaatatacgttaactagctgtggttcaatttgtttttttcgttacgagatgtagaagttgaatttgaacttttatgtttgtggagtgttatatctcatgttaatacaccttcctaatttttttaaaaaatttttattactatttaagtgacataaaaagaacaagaggatatcccctcgagggattaaaacagtttcccatcatgcccccctttcccgcactgttggtttggctgcgcgcgggcctgcggccaaggagagaaggaagaggtcggcgccacgcgaccgtatcaccgaatccatccaaaaagcggctggacacatggcgcccactagacccgcaccgcgacaaggaactctagctcgtactaccagttctcggttgctctcgctcatcactatcttctgagctaatctcttccttttcttatcatcatcctgatcaagacaaatgcaacagaaccaaatgatgtgtacatggctgaggcttgctccaaatctctatataagctgcccattgcctcccgttgtgccacaagatccaaggctatctaagcaccggcatttgcatacagccgcctaagcaaagagcacagcaagtatacgcgaatctgagtgtgtgagagagactagtagcacagacgaaggtatggcgttctacctcggcagcatgggtggctcgccatcgtcatggggggtggcggaggtgccggtgccgagcagcaggccgtggagcaaggcggaggacaaggtgttcgagagcgcgctcgtggcgttcccggagcacacgcacaaccggtgggcgctcgtcgcgtcgcggctcccggggcgctcggcgcacgaggtttgggaacactaccaggtgctcgtggacgatgtcgacctcatcgagcgtggcatggttgcgtccccgggctgctgggacgacgacaacaacagcgccggccacggccgtggcagtggtggggatgagcgtcgtcgcggcgtgccctggactgaggaggagcacaggtatgtgtccaatacgtgccatcaaatcccggttctattccatgttatttttcattttttctgttattttcggtgcgctctttgagatcctaggtattattatattgttcttttcacatcggattacttccctggcccacatcacctgtctcaccaacacgcaggccctagatttccctatagcaacagtaccttgcactacacgtctactatatcgagttacggctaatttcctctttctctctttttctattattattatgaataggctatttcttgaagggctagagaaatatgggcgtggcgactggcgcaacatctcgcgctggtcggtgaagacgcggactccgacgcaagtggcgagccatgcgcagaagttcttcatccgacaggccaacgccagcagccgtggcgactccaagcgtaagagcatccacgacatcactgccccatgatgtgtggtccgatcgaggatatgcattatgatccggtccagtctaggtttagttgtatttccatcaattccaactagctttcaaccccatttcaaagaggagagaacgaagggagtttagtcgtcggccctccctgttagttcctctctctgtgttgtgtaaaatatagctaggcaatagctaaaactaagcttggctggaacctgagatcaattgttgtgatactagtttgtgtacttgtcaaataatatttgtatccgtttaatttcaccgtgtgcgtgcgacatgtaagctagcattgctacacatgtttgatagtacttaataggggtaatagggttatacattcagctatcacattttcatagttgtaatgataagtttattaaattgtgttcacccgtataacaataataataaaactaaaatagccttcacccgttgcaaagtacgggcttttttctagtacgtaaaatatatatcttgactaattaaaatattcataattttcctttcgtcacctaaatttctgtccatgttagcgctaatttttcgtccgtcaagtgagtgtcctctttgctcatgatctcccctgcgcgtctttcgtctgtctcttcgtgagaaatggaccgtatcagatgcaccacaatacaagggaagaaagatggaagcagtgaacacgtgaacaaatatatgactatatcaagagaagaaggaaaactaaaagattaagaaattcctaaatcgaaggagaggataaactagactgaaattgcttagcaatagaagtaagaagagggattaaactagattgaaatttcccgaaatcgccaaattaagaaatcccaaatcagtgacaccctaaattcctaaaatatgcaaatcaaattaagtatctgctaatcaatttaacctctttcgattcggttactcaccgttttcttggaaccctaagccacctggaaaccccaacacagtgcgggtttttgccgtgaagcggcatcgctgccgtcgccgtgtgggcctcatcttcgcccgcgcgtgccttggtgccgtcgctggcctcctcgtcctcctcatggatgcgccggcttcaccgtgcgcgcgatgtcttggacccccgccccccaccatcaccgccgcgctgggaccagaaggttcgccttgacgctgccctgagcagcgccctcctccgcaccctccaagcccctcccagcagatgatgttggagccgcccggcggaatcacctttacccccgcgagccacttcactggaccaccgtagctgccatcgccgccgtccgctctcacgctcgtcgccggtagaggccaaaggggatcgggagagagtgagggttagggtttcc

SEQ ID NO: 239-240 - skipped (2 entries)

SEQ ID NO: 241 - DNA, 6657 bp, Oryza sativa
tctgaatctgagtagtcaagctgctcaactgaaaagtggaagcagccaaagcaggataagatttctgagagcaagtttaatagtgtagtccactacaggctccaaatcatttataaccaatgtaatagtcaattcatacaatagttgtttactataccattaatatttggtcccacctgtcatacacacgttatgtcttggagtccgtgttgcagctggctacagatctgtagcccgctgctcttctctctcttcttttatctctttaaaatatgtttatagctggcttaggcctcctttaatggttgagctagtgcactagctcatgcttgtccacctcatacaagagatagcaaaaagtctacctctccaatagattatctcatagcatattgtttaaaatgctttgggtttcacaattcctctcacattttctttaggagcttagctcttgaagaagatatagtgcattctctctccttatcttctctctcttccacatcatataaaagctgatatggagatttataagctagctgactcatccttgttggaggagcccttatagcctgctattgtacctgctatgattaatactagtactgtcacttacctctccgttaaaagggacagatataggttggtattttttttcttgacggaggaagtactcgaatctcaaatctcagttaggcccgggtaattctgctatagaaaagaaacaattaacaaaatgctgagatgaatgaatgttcaggcgaaaattaatccacaatgttctcgcaaaagaaatataattaattcacaatgtaataggacggacacgtcatgacagaagaagcatctgttgaagcgttcacgagacagatgccgcataaacaagtgagacatgccacccacgcgtccatctaatctaatctaaccaccctgcacgaatcgcgacgcacccccctgcgaagcattccgttccaagcgggcaagcgctatatatcgccgcggcgtcatctcgacaaggcacctgccactcgcccactcctcctcctcccccatcctccagtgctacggtgtcacgcagccatggcgctccgcacgctggcctcgaggaaaaccctagccgccgcggcgctgccgctggctgcggcggcggcggcgaggggtgtgacgaccgtcgcgctcccggacctcccctacgactacggcgcgctggagccggccatctccggggagatcatgcgcctgcaccaccagaagcaccacgccacctacgtcgccaactacaacaaggccctcgagcagctcgacgccgccgtcgccaagggcgacgcccccgccatcgtgcacctccagagcgccatcaagttcaacggcggaggtgaggccaagtcccgccccccttaccccttcctcgcatacggctttctttctttctttttcttcgtcctgttcatcgcgggcgatgcgggcggcgggggatctgaggaattgggtggggtatttgtgtgctattgtggctgatctggattggtctggacgggagaggcagtgtgctcccccaaatggagaatcggattgggttgggggttttaggatcctcccatttctaggggtttaggtggttctggttttattatcggccgcgaatttaggtttaatactgtgttgtagtggtctggtacatacactattttttaaaacagttgagacatgtgttaactgcgtgggtgttttgagtataaaatttgaacaattttggtgcttgttatccacagttaggcgttagctgtcttgattgtcatttggttcaggtagtgattagttggtgtgcctttgattcctgcaaaatttgagctgttttatattaatttcctgtgtttgagaggggctcagtctaactggtcaggtagcgatccattgttgtaattttgctatccagtgcttctctaatttgatcaggcagttggatgaatgggtgatctgttaagcttcatttctaggtgaaagttctgtatgcggtaatgtactttgggctcgaatttgaacaattttgatgcatgttctctgcacttagctatcctgattgtcagttggttgtgcttttaaggatttgttcgcctaagataggatttgagtagattcagcattgggttcttgggcttgtgccatagtttattttaatctagctttcaacttttgaaggccctctttgttttatgttctagacatatctagtgtttgatggggtgtattgtcatcgcagaagttcgaactgcattgaattttgtgcttgtacaccctttaatttaaagggtatgttatgttatctcccatctcaatgccagaaattttcctgtctcctgtaaaaatttgagttgttttatgttaatttcctgtctttgagatgaactcagtctgattggtcagttagtgatccattattgtaattttgagatccatcgcttctttaatttgatcatgcacttggagaatggttgatgtattaagcttcatttctatatgaccagatgcgtttctactaaattagacagcaccatgatgcatccatgagctgctgatttattgagctcaggttgagctgcctttgagttggttccacagttgccaatttctctaataaaaatatatagagacaaattagtggtccccttttactatctcttcagaaaattttatttaactttgaagaaatagtttggtagtttcacttatattcatatgttggatgataatatacatgataaattggcgtaaggttcacaatttcacattacaccaaactatcagggtgtgtttggataatgggaaatggggagtgggattaggattgggaaatcaatgaagggttaggattaaatggaactggaagaatgaatggttaggatttaaagatgcatttttgtgggtgggaaatcatttccctatcccattagccaaacactccgtcaaagggaacagcaggtggtatggtagtaaagaggtatcctcaggacagggctacgttgttccagctgggacccaagctgccgcccactcccaacgctcctgtaggatggagctgctgtgtttgtgttattgtgtgagcgcggaattgaagagactagtgttcctttcttctagagcctccaaaaaatcaggatgggtgtgacttttgccagctcttagctaaattcttgcacttggatagacaccactgcaagaggaaccaaagccaaatcttccgagcatagacacaagaaataagcaaatggtcggcacacccctcctgaccatgaagcagaaggcttagtgggtgtccattcactgccggagcatctcatctgttgtctagattcattgatttgcaataaaaaaaattctagagttaatttattgcgatttcgttgctctcagatatctactctattcgttacaacaaagatattttcagtaatgcctttgtattaactgtgctgcaggccatgtcaatcattcgatcttctggaataacctcaagcctatcagcgtaattatccagtccatacaacttgctccatttctttcttcctccacttactttttttctactggatctccaatcaccgaattaatgaaaatattgggtgttttacaggagggtggtggtgatccaccacatgcaaaacttggctgggccattgatgaggattttggttcatttgaggcacttgtaaagaagatgagtgcagaaggtgctgctttacaaggatctggatgggtggtatgtacaccatgcattgctttatccattgatgtgtcatcctgttcagtctgaagaaatgtattgttcatttattatatttattttctcgtacagtggctagctttggataaagaggcaaagaagctttcagtggaaacaactgctaaccaggtgaaagttcttaactctttgtagattatattatttgcgcataataacaggatgtcctataccatgcagtctactcttgaacaacaacagttcaattcagtagattcttatcatttttgtcatgttttcaatgtctgttgagatagtgataaaaaacacttctgtaagatcaagggatggggattagcaatatggtacatcaatggttactgcagaaacacatcgttagaaacatatgcaataattttggtacattgggcaaggaaactgttattggatgcatgttcattgttctgataaaaaatggtaccgatcaatatgctagtggcttgctaaaatatgttactgcagtttagttaacatgtactgttgaaacaataccttgttcagcagtcctgcaattggatttcaagagttaagagcaaggacactatattttgtttaataagttgttatgacatggtacttaaaattaatgtgttttaccagtataagatgtattgtcttctgaacatactattttctaacatcctgtaaacttttatgaagtatctatgaattttcattgtttaatgaattctgaatatgactgttctaagtacatggcaagagtttgctgttctcatagttcagtttttgctttggctaatgtgttgagcaatatgaaattgtagccctactttctaaaggaaagaatacattttttttagcatcctacatggtgatttgataatagggcacagctgacttcttgcaatttgcaggaccctctggtaacgaagggggccaacttggttcctttgttgggaattgatgtctgggagcatgcgtactacctgcaggtaatctcatgctgttgtgggggtcagaggcacactcattgtttagttgctcttattctgctgttggttattattcctaatggcatgttgtaatttgcttatgttgttagtgttgctagcgccacatatgatgtgttcattgatcacaaattcacacttgaatgagttggacaacttattccccttgtagcatttgcactacgaagctattgcctttttttttaagataatggaaagaatcctgggctttacttcaaagaagctacaaccacttattacataattcactgaatgaagctactgcttgaaaatacggttcccattgttttccacaagacctaacaggagcagagtagaatgatatcacattgtttcatgggttatgtctcaaaagatcagagaaaatttaggagtagtaggatgtgactaggcatcgaatacgcatgtgcatgaatacaaaatgtgagtaccattgaagattactagtattgtacgttctgaacttctgatgtagtacatagtctgactatagaaggaatagttacctctggctgtttaacaacttacaacatcgtgcacacccaacttatttgtgcttcgaatttcaacctttgctattgctaaacagtcttcattgatttccgtggttgcagtacaagaatgtcaggccagactacctgagcaacatctggaaggtgatgaactggaaatacgcaggggaggtgtacgaaaatgcgactgcttgatgttgtctgaaggcaacgctcatggttttttttcacctagtactgccatggatctttgtatgcaataaaaatgggcctattgcacttctggaccttgtgtacattgcgtagaggtggactaatgcataacataatatgcctgagattttcttcttgtgctgctttcctgcatttctttgctcctggtgtttcactgcccatgcatttactactgcgccggtactgcctttctgtgccaattcccgttctcaaagcgaatgaataattctgtgctgatatactacctccgtttcaaaatatagtgacttttagctatgaatctggacacataattgttcagattcatagttaaaaatacttatattttaggattgcttatattttgggacggagggagggagtaatgatgtaatttaggaagaacactcgtacatatggaacgcatgcagttctttgtaaatttacaagaatagtctcgtggaacgcaagtaatggatcaaccaaaatactaatccccctcgtacctcagcacagtcctcatcgcctggtgtacatgcgtgcatctttcatataatcgcggaaaagccacgacacttgtttttaagtgctcaagttgtataaaagttggatgtgagcgatatcttttgtaatatttagaatattatctaaaaacaatatgtttaaatgtatgttggggaataatttcatcagattatattttaaccatatttaataaatatattcgaacataaatttttatcggtcaattttcttgtttctgactttatttgcttgggtgcgtgctgaagaatgtggtgttcttatctccgattctctttcacaaattttaaccatcatttttttttattttacatagatcaagacgaattgtatgattgtttccggtgtgttttttcaaaaaaaaagagcagtttttcttttcatttcgtaaatttcagtcactttttaaaaacaaaaaagtactccatacagcttaattttggaaaattcaaagttcagcataattacaaaaaagcttaggacaaacgactcgcccttgcgattttgcgaatgataaacgaacggtttcatttcacagacgcttcacttcgctcagctgtagtagacatcgagtttgagtcggactccgactccgagtccc

SEQ ID NO: 242 - DNA, 4567 bp, Oryza sativa
tgggatgctgggctgtcagtatgcgtttgtaacccataaatgctcgcctattagccccacccacttagttgtatggagttttgttcaaactctaaaaaacttcagtcttctacgataattaattactccggtgcacgtaggtcaattaggcgtacagtcaccggtgtgtatgctcttttgggaaaaaaaaacattttcctaacttgtggctaattgcacgtgcagtttatcatcaagttttacttaagtccatacggcttgctagcatgtcatttggcgttaattatacctaccacacatgcagcatgccacattgcctctgtcagaagaaaatgtagtagtagcttcgagacaacaaagacgacagttttttctccacaacaatctcgaggtcaaatcttgattaattatgctaattaacgcgatccggatatacaatctgcagatatattacttaattacactaatgatgaaacgctaattgcctttttttttctccaccaagttgatgaaatgatcgatcacctgtcttaccattaccttaccgaaagtccctttatgagatagagacgctaattaaatatagttttccatgagaaaaatgctgtcactgatcaattatgcttagagaaacagtaaccataataataaataaattcattccctgctgtagcaaggaggcacgtgacgcaagcatcaacgtcagaccgctggcccattatccgatctaagcccacggccccaggctcgaaatatccggcccatatacttacatgggccgggatctgaaacaaacatcaggcctaactacgtaatgggcccagatttaggcctcctaacgaggccttgatgggctaagcgccatcatgggcctccgctttttttcgaagcccacggcgaattcccttcccagcgccgccgtagccgcctctgcgtcggggtttgcgcgggaaaaaccgaggaatttcccgccggttcgcgccggccgcggttcatcattctttggcctctccgaaacctagatcccaaatcgacccaagccatggccgccgccgccgtcgccgacgaggtcaccgaggcgatggagcaagtcgaaggggagcgtgaggaggccgacgcggtcgctgatgaggccgccgaggtgatggagcaagccgaaggggagcgggaggaagccatcgatgcggtcgccggcgaggccggcgaggtgatgaaggaagtcgtcgaaggggagcgggaggaggcgaatgccatggccgatgaggccgatgaggcgatggagccggaaggggagcgggaggaggaggcagacgccgtcgccgacgaggccaccgagccgatggagcaagtcgaaggggagggggaggatggcgacgccgccgcgcaacggccggcgctgccgctggggagggtgaagcggatcatccgggtggaccgtgacatcaagaaggtgaccaacgaggcggcgctgctcatcgccgcggccacggagctcttcgtcggctccctcgccgcgggcgcccacagggccgcctcccggcgcggccggcgcgcggtgcgtgccgtgcacgtgcgggccgccgcgcgcgagcaccgccccaccgccgacttcctcctcgactgcctccccgccgccgaggaggcggcgcctgctcgcgcggctgccgccggtcccagccgcggcggcggaagaggagaggcaaagccgttgccacgtgggacccgccgcatcgacgcgttcttccagaagaccacctagtggtgttccctctctgtatgtgtctaatgcatccgctgctctaaatgtttggagaaaaatttcactcgcagatgaaactatgaatttttatcatttcgttagtcaagctcgtttccaatgtcttgcaatgatttggtatgacctgctcaaatcttgattccggttgccgtgaattttgcgatgcagtttcggtaggaattggtctttgtaagatgatctagctaatatatttctaggtcctggttcaaacacatgattctcaaaagaatatataatgctaatactaagattgcgacttaccttagtttcagtgatcctctgtgattcacctctctgatagattacacttattctgcaaacagtttattgttttggtcttcatgcagtgattcggtaattatatgctgacgctgtgacgcatactgtgataagaaacacaaaacaaggttgtccttagctactttgtcgctggttaggatgccgagccgtgttggtttcatctgaggaagtagcttgattccctcttgccatggaacatgttagcatcacaaaatttgcatgagtggaaccccacacttttgaaagaatcccacactttttgggtgtttacctgggaaacaagtaaggccttagtttttacaccagttttagaaacattctgctctctttcttgttcttatttgttctcaaaaaatcatgttcattttacctgtctaaacaggataaggatcagaatcagcatattaggatggttatttatgtgtaaccactaattccatatgaattgatgaataataaaattgttcttttattgcataaattcagaaatgtcaacacactgcttgcctgatgagtgacaataatctcatatcaacagataatacaaattcgttagagattttctgctggacagaactactcctggtaaaagactaataatatgattttcagatttttggcatctataacatatgaatgttgtgagtccctaaactttagggcactgacttctgatgccacaaggcatcaatgcacataggcagcttctttatatctgcacaacgaagctatgcaggaaatccaaaggtgaagcttaggctcatttgctgcatgcacctcttccctcagcagctcataacgctgcacaaccatgggccccctttggaccttcattctgctatatcctgagatcttcctagctatcatctgcttcttctggttttcactcttccgtcccatcaggcagcgccagaagagcaacctcccagtgaactggcctgtttttggtatgcttccattcctcgtgcagaatctgcactatatccatgacaaagtcgcagatgtgctccgcgaggcggggtgcaccttcatggtcagtggcccgtggttcctcaacatgaacttcttgattacctgtgacccagccacggtcaaccattgcttcaatgccaacttcaaaaactacccgaaaggcagtgagtttgctgaaatgtttgacattctaggtgatggactccttgtagcagactctgaatcatgggagtatcagcgacgcatggcaatgtacatatttgctgcccgtacctttcggtcctttgcgatgtccaccatcacgaggaagactggcagtgtcttgttaccctaccttgatcacatggctaagtttggctcagaggttgagctggagggtgtcttcatgaggttctcactagatgtgacatactctactgtgtttgcagctgaccttgactgcttgtcagtgtcttccccaatccctgtgtttggccaagctacgaaggaagctgaggaggcagtgctgttcaggcacgttataccaccaagcgtgtggaagctcttgaggctgctcaatgtcgggaccgagaagaagctgaccaatgcaaaggtggtgatcgatcaattcatctatgaggagattgccaaacggaaggcgcaggcaagcgatgggctccagggagacatcctgtccatgtacatgaaatggtccattcatgaaagtgcgcacaagcagaaggatgagcggttcctccgtgacacggcagtgggtttcatctttgctgggaaagatctcattgctgtcacactgacttggttcttctacatgatgtgcaagcacccacatgtcgaggcgcggatcctccaagagctcaagggccttcaaagctccacctggcccggggacctccatgtcttcgagtgggacacgctccggtctgccatctacctccaagccgcactccttgagacactaaggtgacacatctttgatctccccattctcccccaatctcactaacaattaatctccctctcttcatcttctgacattctgaccaactattacattgcttgaattgtgttccaggctcttccccgcaaccccgttcgaggagaaggaggcgctcgttgacgatgttctccctaacggtaccaaggtgagccggaacacgaggatcatcttctcgctgtacgccatggggaggatagaagggatctggggcaaggactgcatggagtttaagccggagcggtgggtgtcgaagagcgggcgccttcgccacgagccaagctacaagttcctgtccttcaacaccgggcccaggagctgcctcgggaaggaactcagcctcagcaacatgaagatcatcgttgcctccatcatccacaacttcaaggttgagctggtcgagggccatgaggtgatgccgcagagctctgtcatacttcacacgcagaacggcatgatggtcaggctcaagagaagggatgcagcttgataaccatgctgtc

SEQ ID NO: 243 - DNA, 6049 bp, Oryza sativa
cacgctcgtgtcggcgctggtcgccgccggcgtcgggggcctccccgtcgtcgtcggcgaggtcgggtggccaaccgacggcgacaagcacgccagggcggacctcgcgcagcggttctacgccgggctgctccggaagctggcgtccaacgccgggacgccgctgcggccgaaccagtacgtggaggtgtacctgttcagcctcgtcgacgaggacgccaagagcgtggcgccgggcaacttcgagcgccactggggcatcctccggtacgacggccagcccaagtactccatggacctcgcagggcagggccgggacacggcgctcgtggcggcgcgcggcgtcgcctacctcccgcgcgcgtggtgcgtgctcaacccgagcgccacgccggacgccatgagcagggtcggcgacaacgtcaactacgcctgcacgtacgccgactgcacctcgctgggctacggctcgacgtgcaacggcatggacgccgccggcaacgcctcctacgccttcaacgcctacttccaggtgcagaaccaggtggaggagtcgtgcggtttccagggcctcgccgtgcagacgcagcaggacccgtccacgaacgcctgcaacttcaccatacagatcgagccgtctgcggccgccggccgacggccggcggcggtggccgtgacggtggcgacggccatgctgatctcggttctcgccgccatggtcacgacgccctgattggcgtgaggacatagttacatttgtagaggttttctgcttgattttgtagatactttggtgttgcctatacagcgattgatcgatacacgctcgtttggtcgtttcgatgtctaactgggtggctgaaatttcggcccatgaagtagatgggcttgtaagttggaaacaaattacggcccatttatatatggatatgggccggtttctgtgacggcccgcgtagcttcggaggaagcgaccaccttatcccctcgctatcccctcccacctccgagatccccacctccaccatttctctttctcccacctccaccggcgacgccaccgccgccgcctcctcctcctccgcctctctacggcagcctcgccgccgcgccgcgcagcgcagcgcagagcaacatggaagcgacgggcgccgccgtatccgccttctccaccgcgtcctcgtcgagtcccgcggcgcctagacacggccgtctcctggcgagccccgcggcgtggcgcagcgcacggacgctgccaccacgggccgtcgcctcctcccgcgcgacggtcctcgtctcgaaccctcctccgccgccgctgccgccgacacccgctcctgctgcggtcgcgccctccaaggtcgaccggtccgggcggttctgtagcccccgcgccgctcgcgagctcgcgctgtgagtcctcgccctcgagcccgagaactttgggctgcttgattcggttcgtatttgtcgctaatggctgcctgccaccgtgcttgcaggatgatttcctacgcggcttgccttgagggcgccgacgtggtgcggctcttcgaccgcagaatcagcgcgagaagaggtgagcctcctcctgacgcctcttagcttctttgcactatccttgtgatccactagcagcatcactgtgctgcacaatggcttcaattgtttggccttcgttggatagatgaatttggtttctctttgcctcattctggtcttgttctatatgattttgcagaacctggctatgttttcgataaggcgtgcgtggtgaactacaaccatatgagcttcggtgggggacctctggaggtcgggacagaggaggaggctgagaagctcatgagtcagaacgagaaggattcagcaaatggtaacaacttttttgcaaatgttattctcattgaaactagttctgcatcttgctggatgaaaattggggatatagcactggcacatgatcttacttaactatttcttcaagagctcattaactaatcggctaatcgcaatgactaatcctgcaagttcaatcacttgccattttgcaagagcaaaagtcccctagattaccctaatcctgtccttaatacgaagtcaatgtcacaatcgcaatgctattggttttatggcaatgatattatgcttgccttttataaacatttggaatataatatgtgtttttttgcagtatatttattcaggaaataatgtatccttttttttaaaaaaaaactgtgagtatttttagataatactccctccgtcccataatataagagattttgagtttttccttgtactgtttgaccactcgtcttattcaaaaaaaaaaatggaattactattttgtttgacttactttattatctaaagtacattaagcacaacttttcgttttttatatttgcacaaattttttgaataagacgagtggtcaaacagtacaagcaaaaactcaaaatcccttatattatgggacggagggagtatgttcacaacatgtctctgtagtatattcttgatgaattatttaatttgacacaagattcattgtcttgtaattcagaagcagaagttctttcagctcctccaaagctggtgtacaacaactttgtgttacggtatttttttcttctctcctctttttggttggtataatcacataatggacactgttgtttaggtaacgtgtttttacgtgcggggtccttgtaggtatttttctaattacatgctttctgaacagactggctcgagaaattttagtggctgttgccagtggatgggacaagcatgttgatatcatcaacaaaataactccccagaattggaaggttggatactttttttcccagtgttgtatatcgatccatcaaatctttgtacttgcttgctaaatcgtgcataagtagaatgcttgttgatttaattgaaaggcgctatatattattagagaacataatccctcagtaatcactagtactgaattatatatgcatcttgttactatattgtgtaacaatctagttggagctgcttttgcctcatcaccgtgctaaattatcgaacatttaggaacagggttatacctgccatttgatcattcctatgatcaatttctcaagtaaaacctgcatcttaggagtaggttacttgccaaataaaaccatttgtcacataatatttttaatacatttttttaacctttaacttacatcccactaaaaaaaagtcaactcatggaatttcagactactatgtatagtttccactttaaacagctgtcaatgtgatggattgggatgttcccaagccccgaagcgagtgcacagttggcctactataatgaccaaaaggtgtagcaccagagccccacaactttgatttatggggatcaaaactgaaagtaaatggtgtgattgagctcacaatgaaactctcagtcacagtaaatgagagttgattgtattgattggttgcatgtaatgattaatgtttgggtagtataagtttattattagcgtagttgttgtgtagcagacaggctgtaaatgaatcattaatagagagggcttagaggggtgggaaaagaggatattgtagttaagtttatactaaaaagaagggtataaaggattcgttaatagtaattaaaagctaaacaaaaattgaggcctctaaatttttcgtgcccgtgcatcttgagcaagccacatttgaaccatgttaggtgcttgttcaccaccttttgctatggctgtaggcatccctcgatgcaaaagccaggatttccctgttatctttgcattgctcacctggttcatttccccttctatggggcttgatttcctacaggcatagttgtcatatagaggtgctagttatttaatacatcagctaccttcttgaaatatctgaaattttccatcaatgttagttgattctacccaaagatccctgtttttctaaacaaaaattttaagaatatgaaagacaataggttgcccaatcacatgcttaattgctgatttaaatgatcatgttttgcttctatttaatttttgctgactcgccaaaattctgtgggcaggacgaacctgttgcaaggatccttgaactttgtattcttcatattgccatggcagagatgacatcaaaaggaacacctcacaaaattgtcattaacgaggttaccattttatcacaatctccttcatattttaagtttgacaaaagaaacatataaatatctatcttgttatgtccattgatgataggctgtggatttggcaaaacggttctgtgatggtggtgctcctcgggtaatcaatggatgccttcggacatttgtgaaggatcacatgaacattgacaccagtcagccagctccagctgagtcaaaagcgtgaagtttttgcaaatatgaaaatatgaatcatcacaaatatgattcaaagaatagaagcacggagaaaatcctgctctctttgtctgatctcctttggttgtttaaagattgattggtgaagttgaaaggaggcaaacatgctggacttgtggagaactagaagtatcttcaatatttagctggtggttagactagatatgttgagccatatactgatgatgcactcttcttgaagaactaaatgacactacttctaacagcttttgccatgctgattcctgtgcttaatgggacaagagaacctgtatcatagtgtatgtgtaaagttgcaaggtaagggttgcatctctcaatttcacaataacgtgcttgagctgctgagtaagttgggagttgggagtttgcagctgatactatggaagatgcattttctccaagatttggatatgatatattgtgtaattctacctgcacacgagttctgttcaaatataaatttggtacacctctaatagtatttgtattgtatatggctgcaaacttttcctacgaaattctttgtaagtagcatgggttgtaacctgcttaacgatccaatgattgctgctttaattaataagtttgttgcaggagaattttctttttctttaggatatactcctattttacttcaaaagctccaattttcttttgatcgaagcactgttgcatttgaactgagctacaagtctgtgacaacttacaattcggcctgtttggcaaggctcggccctagattttttttacattttagttctttttaaaacatttatttcataaatagaacttaaaaaagtttatctcatgaatggaccttttttcggtgccaatgaccgtgacgccaatgtctaacgtctcagtgccaatgatattggtgcttacatccttgctctgtgaaagctaagtcattgatgtaaatggggacaacacatatgtcattggtgttaaggaaacatttgtaaaaaaaattctaaaaaggctaaaatgtaaatatttttcttacaaacaggcatattttagctatttttacaattaggtcctcgatgtcaatgttattgacgttgctcccctttatatcagtgacttagcttccacaatgggggcgagggtgtcagcgtcgttgacgccgaggcattcgaccttggtgctgaggaaaaggtctattgctagaataagctttttcaagggtatgtttgtaaaagacaaagttttcaaaaaaaatactaaaatgtaaaaaaaaatccaggggcttgggctctagagtcatagagttgtagtccaattgtacggtttcatatttatcaaaaaaaaacaaagcgaagcgggctacagttatttttttaaaaaaaaatgaactagagggtgaaatagggttcagaccgctccacagctctacttcaaactttgctcatgaagttcgatttataagcatgaaaacatgcctcaagctccaaacagttccataggataaaaaaaggggtaaaaatacaatcctccacatgaaaaagggattattttaatgttataggaccttgtttaataaatgggttgtgggaggtgggattgggaaatagaaataagtggatggttaggatt

SEQ ID NO: 244 - DNA, 2757 bp, Oryza sativa
tgcatttataggaccatatgaacggagcaatttggtctaaaaaaaaacacagcacaccaatacatcgagcaacgtgtgtaaataacgaagtttcaaagcgggccggtacgtggactagtcattagtggataggcttcaatcttcatgcatgtgcacccacgtgtagaggggttgttggatgcatattcaacgatttggacatggggacatttggccatatggtgcgtggctacttgtgggttgcagatttgaattttgacgatgaaccttgcacatatagagctgagtataattaattcttctaaacgcatttggagctaggaagatttaattaatttcgagctaaataatagtagtagctatgtggcgcagagaggaaatgaaaccataatcatggtagaaccaaaaataagcattagtgatatgtcagtgcttagctattcgatgcatttaacaggcagcggcaacaagcttggatggatttggctgcctgctgcagtgctgctctaagctatagctccatgctgataactggccgagtccatctctgatggtaatggtgcagaagatgaacaggaggaggggatgaaaaaaaaaaaagaagacatggacaagttggttcatcgaagaaatacacatgtagtggcatatttgaaatacctattaaattaagcatgtctaaaattccataaattgtagtggtatattttagtattgaagaagttacaatggcatgatccaatgaatcatatttatatccacgttgcacattgtaaatttgacctgtaaaatgtttattaatcatatcgttttctgcaaatctgggcaccaagtggtatatgcagaagagtactaccttaacaaattgacactttctttctctgactagtagagtctccaccacacacacgtgccaccctttacatccgtgaattttctgagtccagaaggattaataagtctacaagtatatctcatctcagcaaactgggaagcctatccattaacggcaccgaaaaattgcacgttttgcttcttttctcatcttataaatacaccacacaactccatccctcatacaccaaacgcacacacaacttaagaatcgatcaatagagcatctatcattctgctggacaataacacccgtttcagtctcgatagcaagcagtttcaattggttgtaagtacctgttctgatcttaatttgatgaaagagtgtttcgaattaagtgccttgcgtgtacacaacaacaaattaatcctagctatatttgcaggaattttgcttcattaatttgctgtgaccagaatgagttcatcagacagcaagccatgtggtggtcttaagacggagtggccggagctagttggcctcaccatcgagcaggccaaggcgaaaatcaaggctgaccgtccagacctccaagttgaggtgctcccagtaggaaccatcatcctgggagtggtcgtcccgaaccgtgtcatcctctgggtcgacactgtggccgagattcccaagattggctaattagttttaagctgtgtctagctataagtgtaatgatacaataatgaaaggtccttgctttttatatatatctgatgcatgttgtaatgtgataaataaagaaggtataaataaagaagatagtatgtgcatgtacgtatgacagtttcatggccaacatgcgcacatgtgagattgtaatttgtaagatatattttcatgaatctctcacgatcatttgcatttagcattgtcatttcagccataatcccttcaatctataaagttatgacccactaagtgcaaatgagatcctaaagcattgtcatttcatatattgatggaatcagacatccaatccaaaacaacactactgagactattttttgtccctttttttttttttggtttcagaggactggaacttttttcaactacaacagaaaaaagagcggtggcagacagatcaagcagctacatatcaaccaaaaaatagaaattacatctgatgatttgtattttctactgattttgtccctgtggtttcgatcgacctgatcctcttgcttcctctaatccaatatagtgcatttgatctggaatatatgggtgtgtctcttggtatgagttttggtcctgcctctcttcacccttcacgtgtcttgctttgtcttgagaggcaacacataatgtcataaagcccaaagcccagatgcatgaaacaaaactaattcgattttatggattaaaagttcttttcagccaaagatttatattgttcactcagagcggaagtcacggcagcctgccgacgattataagcccaaaatattttgacaaaatcccaaaggcacatgcatgcaaaccagtcaaagagaagatcacagtgcatctctctcacatggcccagatattagcccaaaacactacacaaagcccaaagcccaaagtagtccaaaacaaaaagactatgggcccaaaaccttcattcgtttttttttttgcgcaagctcttttttcctttttgtgtttcagcatgccgttggatgcataattcacggcgcacagaatcgactgacaaccacccaaaattgcaagcgattgcagaataggcgaggcgcctacaaattaggcgcccgatttttttaaaaaaaaaattggtcgctgtttcaccaagtagatcgaacatgttttactaagtaggtcgaaaatgtttcaattttgtaaaaagctgaaacattaccaac

SEQ ID NO: 245 - DNA, 6586 bp, Oryza sativa
catggaggggttcataacatggctcctgggatggtgtgcgtggaatggagcatgatatgcgaaggttaaagatatttttggagcttcttggccaaactatgctccttttatttccggccaattgtgtggtataccgtatacacatgtactgttatatggtttcacacatttggccgaaacacacgacggctattcagggggcattagcatgtacaaaagagatgagtttcttgttgtggtttcttcccttaactgtttaacatagctatgcgagtgcaagagggcagatgaaacattgatgttgtgatatttttgtatactcgattgttttgtaatatggttacgaggagcgttagagtttttttttttttaacactgcagcatgaggaggtagactactgtaactgctgtctgataacactgcagaaactggtggtagctgtaagaatggtgttccaagtttgaactaaatcaggttccaaaaatgtttgagctccgaaccaagcatgcagctcttgattatttatactgcacggtttgattcgaggtcgtggctttgatcgttgtgttgtgctttccccacttcatctagacgagatcctcctgggattagaaagtgaccactctagagtacatgaaatcgtaaacaattcatcattttagagtaagtatgagatttcatcatcttttgtaatgtcatctcgaattacctataggggatttattctcaaagatacactaatgtgtcactgccccttaccaaaacattgtcaccaccaaaacggaggtagtagcattttgaatccgtgacaagctacgaaactcgacggcgactgcgattaggaaaaggaagagaggatacccaaaaaggactgggagtaggagtcacatcggacggcgcgcgaccctcccggaacgaatcggacggcccacgtgagtcgcgtagccatggccccacatggcagaccgactccccctcttccctatttctcctctataatcccctcacaagcaacaacgaacgacacgcgagtcggcggcgacaacaaatcgaaaatcgaacgggagaaattctctctgattctctctcgcgggcggcggaagcaatcgtagttagcagaggccggcgagcgagccgccaccggcgatgggcgacagccagtactccttctccctcaccaccttcaggtgcgctaccctctctctctcttttccggcggagatcgggagcatattggtctctgacgcgctcgtgtggcttccgttccgctgctgcagcccgtcggggaagctggtgcagatcgagcacgcgctgacggcggtcgggtccggccagacctccctcgggatcaaaggtgcgtgccactccctcccctttaatctccgattagggattatgcggatgagtttttttttttgttggtacagtggtacgattgcggtcgtgggatttagggtttaggtcttggcctcgtgtggattgtgggagcgtgtgcgctggttcgtcgcagagggtgggtaggttaggctgggggttttggagcccctggatgcttgtcgactctgctattggcagctagctgtggtgaactggtgatatacattttttttcggtgcctatgccgtattgggcaatgtgggcacttgtggaaaatttgaaccaatgaagttgaaacgtttggcgaagttggttgtttattatttctgtgaagtaaatggagattgtcagagtttgtagattgcaaaagtagaaattctatctataatatgattatctaaagtactaaagaagttgatacttggtctgaagattgtgtcctttacttgcttagatgacctgctaaacaaatccacctaaaacaggaggaacacatttctggaactatgcatgaccgatttgttgtttgtttctggctatgatgctacctgagcttgattttttttttacatagtttttcaaagacaacatgtgcaaatatgaatactataggttgggcttgagctgtctaggatgattaacaccttgcaaatatatctgcacaggcatgaatgaaatctggaaaatgataagttgagttcctatcaatgagttgttcagtgttttataagtagcactgtagccacatgcacgcacctacacacaagtgcctctttgtatgcacaaattgcatggtttccagtgttcatttgtttttcaaaataatctaactgtacctggtctggaaaacaactactatgcttggttctgctcagcaccaatttaacaactgaaggtgtactattgtctgagttgaatgaaactatagtttggcaaatatttcctagacactaacttctaatacttttagttgtccgaataatttgcaatgtgtgttgtaggtgcatatttattagattcctccattacacaggctaggtccataaaattgcttggttcctccaatgcaagcttaataattttgcaaaatatttggtgttgtaacagctgctaatggagtagttattgccaccgagaagaagttgccttctattttagtggatgaaacatctgtaagtgtgacattactcacaatttaagctcccttatctgttcatattctggaggcactaatgaatactcatattcatacataaaggtgcaaaagattcagtcgttgactccaaatattggtgttgtctacaggtacttattttaactgtgtttcattgttcatatactgctgtcttgctatgtacaaccttattcattatcttacactttatattacgctacataatattgtactgctatcttaatccctctaaaaaaattattttcataatttcttgatcttatatgtattcactgcccctttgcactaacaagatggtatagaaacaactagaaaggcatgagcacatgagacatttcatgtcttttgagaaaattatcgtgtacatactatatatactagggaaaaaaacatgcctacatcataccttctgcctcatcttataaagcattgattcttttaactaattttgctagtgttaatagtttgcaagtttgatttggtaatttagttgactgttaatattttcgaattacaacctgtgaatgcttcattttcatccaataagaacaaaaaacaggaattacattggttcttattctagtgatttgaacgttagaactcgggcttattcttctcttgaaatgcttattacaagtgccaacttcttgttgctgaggctcaatcatgttagacactggcctttggttagattaatgactaggatggtcgactctcactactttgttgcatatattcatgtgcttaccttgttttttttttcttccagtggcatggggccagacttccgtgttttagtgaggaaaagtcgaaagcaagcacaacagtattatcgtctgtacaaggtatttgatggtctattttgcagttttacagtgctatcctaaaaaaatatgtcgtagacgtaggaatagtctttcagaagggatttacattgtcagtaaaataaagtgattccgaatcggtgtttctgctttctaactgtattgtctatatataaatgcaggaaactatacctgttacacagctagtccgagaaactgctgctgtcatgcaggagtttacacaatctgggtatgtaaaatttgtacaagcagattgataaaccatgaacattctctgccttacctattcagaagaattaagctgtcattttttatacacaaacagcatgttctagaaagttaacacaatgcttgtttcttatcaatgtaatgcatattctttcacaaactagtaagaatataagaccccagtggtccacgtggtcaaatgaaaaccatggtcggtgaagtacaaaagccagaatatctattttattacttgtagatttgtatataataaatttcattatggcttttttgcagtggtgtaagaccatttggtgtatctttgttgattgctgggtatgatgacaatggtccccaattgtaccaggtattgacaaataattatatacaacagagaaggttttgtgtaaatacaaagtgtcaaatgcgaacaatctttctttctttttttcttgcttcagaccattgcatttacgactttgtagttattaatattgcagacagttgacattgtcattgttttattaggttgatccatcagggtcatacttctcctggaaagcatcagctatggggaaaaatgtgtcaaatgcaaagacatttcttgagaaaaggtaagcagattgacaaaacttacaattgatactagatactgttacatgtggtatcatttttcttccatttgatcataaacatggtgcttaattctatgctacatatctccttttcttaatttaagtgtcaagtttatacaggctcatgcccccccccccccaaaaaaaaagaaggcatgaatgcattaatttcatattcatttattgtttcattgcagatacacagaagatatggagcttgacgatgccattcatactgctattttaactctgaaagaagggtacctcactattattgtgtgttgatttgtttaccacttctttcctttttaaaaacaacttgatggattacaaacttgcagatatgaaggacaaatctccgccaacaacattgaaattgggataatccgatctgaccgtgaattcaagtatgatacagacttaatcaacttgttgctaccatttatcagatttcatattctgttatctctgccaaagatctaaatcttttagcttttctaaattgtggatttctagaaaatagccatctgttttgcatcataggcgtctttatcttaaaaaactgcacatttacccccatctgagtagaggctcataataggttaaatcttttctggagaataatcctagatttctttcgtcctttccatttgatgttttttttttaactaaggtgtagtattttgttatcacgctagtctctggtatagctgtctattctgtccaaactatttgagatgatagaacatgttgcatcgttgccctcagatggtttgctgactgttaatattttcctgaaaaatacagggttctgagccctgcagagatcaaggatttcttggaagaggtggaataatttgtctcaacaatctcatgtttcaaaccagtggacacctgagcagctgcctcgaagttatatcccctttcattcatgaactgattggcaccagtgacacgagacaaatgtttattcagattctcatgaatgaaaatgtgtttttaggaacgtatttgatttggcacggtgtcttctgtatcctcttgtgcccatcctagtctcctcggccagtgctacaactatttggcgtctccttacttttgtagtctgttttacttcttgccaaatgaagcacatgccatcttttgctcttgcaagtgtagtttgctccctggattgctaggacttggaagcccacccagttgttgcagctgttacactggtggtggtaaatcgctgtctggtgtaccatctgagccgtaattctggactgccatctcccaatctaactcatgtcctctttaaagcaaggaactgactaaaagctgattcatcgtacattcttttctacccttctgattcatagtatcatgttagcttaagagttgattgcaacccccccctaacccatcttataacaggaacatcacaaatgctctgaattaagttggataacttggtttattgacctggagcctctttgtgatgtctactttgaatgctttaaccttatttttctcagccaatgatggaacatgccatgttcaatttttgagagggaaaacaaatccggaaaatgcttgtcagagtcatttttttaagatgggatataaattcgagaagaccgttcgttctcggagtcatagggaagtgtcaacactagacaactgttccagatgagaaacatagtattacggttatcttgcgtcgttagcatggatagtaaaaacaagaataaatcgttgatagctgccgtttcctctgataaaaaaaataattctacatgtctccaacattaatgggagctactagtttgtagttgcaatcaaatactagaaaagaaaaacacagagacaaatcaaatgaaacaacggcatcgagcatgcagggtcaagtctgaaattgaggccatcctgctcgcacaagagaacaaaacaaaacagggatcaaatcgaaccatccggagccaatggaacaaaaaaaaaaaaaactactcagctaccactgctactctctagtctcaaccatgcagaacagcatttccaaatgttgaatcctctctaatagctacatgtttcacttattttttaaattttagttttgaagttaacttttaatcgtcgtttattttacaatatttacttttgaatcgttaagaatatgtatataaaagttttatctataaagtattttttattactataaatcatataaagaagcataataataagtgaaatgatggaattatgaatcgtcaaaggttagtcttaacccgagtagaagacgtgcacgtgcaatttaaaccaatgc

SEQ ID NO: 246 - DNA, 3925 bp, Oryza sativa
tatataatcgcctaattaataagaccatgcagtgttacatattggtttagttaacatggtatcatttaattatatgatccgatgacaaggctgaagtttattgtggaattacagcagaaagtctaattaagtatgtagatatccagcttgttgaaattttgcatggtagatcctttatgagttttctaaaaaaaatccccactgatacaaacacaatacaattatgcaacgttcacacaccattgattacatgtagactatttatctacgtggacaaaatctcttatattttaatatggaggtagtagtaattaatgacaagttatgcaaaaaaaatcacaaattaaattactcatttagacgatatcatggctaattacctccacctgttgagaaagttacattctcggacgacatgaacttcgtaaggaacacttaatttcttatgcgaatcacgaaaattctaaacgatcttaatcaagtagtaaaacatgaagaccaataaataaaccgagagaatgcctgcagaaatgattgcacttcaattattgagtaaaacagattatttgtaaaaaaaattatgtaaaacagatatcgttttcaaatttaaaactgtggaataactctcaccccagcagccaaattggagagttactcataaatattcggcacagcaaaagggaatgaataggccataatgccatatgtttcaggtgagtgaaaaatgagtcaatttgtgtgacctgacaagtctcctaatgcacactcacaaataagcaaaaccctccaaattaaatacagttaaataaattttactgttaagccgcccagattattttttactactactgaagccaagcactggagactgcactggtcgttgtcaccagtgctaagaaattgcgaccggttttctccatgaaaccgcgttaaagtattcaagcaatgcaatgcctttcttttctatataagctcgttgcctccacatccacaaccatctccacctcacctcgtccatcgtctccagtaaaaatcaagatcggcaagccaagtgcagaggcaaccaccaccaccacctggagcagagcgagcgagcgagcgagcagagcacactgtcatcaatggcggcggcagtggctgtggctgggccgtccatggaggtggagcaggacctcccgggcttccgtttccaccccacggaggaggagctcctcgacttctacctctcccgcgtcgtcctaggcaagaagctccacttcaacatcatcggcaccctcaacatctaccgccatgatccctgggacctcccaggtaaacaccaacacacagtgagagttcagcaagaacggagacagtgtttgagctggatgatctgatgatgatgatgtgtgtgtttcttgtaaaaatgtgcaggcatggcgaagatcggggagagggagtggtacttcttcgtgccgcgggacaggaaggccgggaacggcgggcggccgaaccggacgacggagcgcgggttctggaaggcgacggggtcggacagggcgatccggagctccggcgacccgaagcgggtgatcgggctcaagaagacgctcgtcttctaccagggtcgcgccccgcgcggcaccaagacggactgggtcatgaacgagtaccgcctccccgactacggcgccgcccgcgccgccgcgccgcctcccaaggttaaactaatgctctcttagcaattaacaagaacaatcagttgcagagttaattattagaacgaatcctttaagtgatcgcaaaatattagtactactgaattcttaaaatggtcacaaaaaaaatgatcggaatgaagtgagaatgatcatgtcatttatttcttttttgaacgaacaatgatcatgtcatatgtagtactagtattagagtattagtacattggcagtgaatgctctcattaatttggttgtttttggtgtgaaaatggggtgcaatgtagtcgttgtcccagtagacttgcagtatcaatgatgtagatattccacgaaagcgcaccaagcattaagaattaagaattgacacggttgacttgggagttgactgccttgatttttaccattgtacatgtaaatttactccagagaacaaatactccactagtagtacaattttaacttggatttttctcacactgtgtttggcggcaggaggacatggtgctctgcaagatataccggaaggcgacgccactgaaggagctggagcagagagcctcggcaatggaagagatgcagagaggatcaagtcacggagactacacggcgacgagagcatccctcgtccacgacgcctccgcctccaccggcgacgactacttctcgtcggacgacgtccacgacagcggcttcctgatccagtcctcatcctcgtcggcggcgccgtccggcagcagcagcaagaacggcggcgctggcgcaccaagggaagccaagaaggaagaagcagacgtcacggtcacggtggcgtcggcgacgagcctacagctcccggcggtgagccagctgccgagcctgcagcttccggcgatggactggctgcaggacccgttcctgacgcagctgcgcagcccgtggcaggaccagcactgcctgtctccctacgcccatctgctctactactaagcaaggggcagagaattacattgtgcatcgaagcaagaggagtcgatcacgatctccagatgcatgtgcaagagcaagagatcaaatcacccgtcgacgaagaacaagtagcgtagaatggctagctgtggattcgattgtacatatagtagtagcaccgagatatcaatcaatcttttggtcttctctcaagataatatgatgctttctgacttgacaatgctagaatctcttataagactatgattcaagaactttatattcatgtttgcgccgccaattttttgtgcaccgattataacagatcgaaacaacagatcctaggaacccagcaatacaagaaagatgtatgggccaaattttgtgcgcggagaagcccgctaaacaaactggtggctgattcggaccacagcccgcaggggacactactcacccaatgggccaaaatttctgcgcaaacaatattcgcttttgacaaccttcggagcgctgtacgagtttgagtttgtcaaagacacttgcaagtaaaatatgtttgatgtagcactagcagaagactgatcgatatgctcccccgatccagtcttcgcgactctcgcctcctgtttcggtggttgggggagatagatccagttaggtgcgcggcgccaagcggcaactttggcgttgggcttgtacgtacggcgagtgcagcgcgcggcagagacagcgctagctcatgatcgcttatcgccgtgggagctgagatgcgaaagcaattgaagaaaattaacacagataccggtcacacgatcagtttaactaggggcatcgttccaccagtaataatattatttcacaataacatgtgagataagcgaccatgtgtcatatactcatatctgttacatgatatccgcgaacgctctctgctagctttattcgtactagtatcacgtacatatacgtatgtacgcgaaggctaagctagccattagcaagcaaccagcagctgtactagcactaggagaatccgcttatgacgacgtactcccagtcgatcgtctccagtgcttaacctcctccgtagggcttctggtccctgcaggctatgttatctccgtatcctacgcggaacatgtcgcagtacctcttgtagtagccgacccggtccttggcgttgtcggtggagtagcccttgccgcactcttcaccgccgttgatgatgttggtggccatgccgtagccggggagcctcccggagctacggtcatcgccgg

SEQ ID NO: 247 - DNA, 4001 bp, Oryza sativa
atacacacgttgctggcaattaagaccaacagtcaaatatgtattgctgctgcatgtatgtttcgttcaactgttaaactaactttgggcctaactaaatgcacttaatacgcagttgacacttatattaagcagagttcgtactagctaactagctgcaccgacgtcgtcgcaagaacaataacaggttagaaaacacatgcatctggcacgcccagctcatgcactgctacctgtatagtacgtgtacatatatagtgggatctgactaggcgctaaatgtaattagtaatttgtaaaaacagatcaagatgaccaattaccaagaaattaccagcagtagtacagttaatatataatcaacatgatgacggcaattgcagcccgaaacagtcatacatataaacttctgaaactaagacctgtaaagttttttttccttgaaattgaggaatgacctgcacaaactcaacagtaaaaatatcaaagaagaatagacaagcgcctagctgaattttcccagctggatgagaaaaggaaagaaaaaaattattgccattagcagatgagaacagtgatttgtatctttgtcagcactatacatgaaaataaagaagtcaagtggcgccttatcgtaccatagaagccttatggacgacggttggtttctctttaggtcggttcctagccgtcgctgtcatcagcactagctggcaaaacagattgaggattatagaagaaaaatataataataattcgactataagatagatgtggatgtaattaagctcaacttgtataaatccgattaatttgacggacatgatattcttcatatggcaagagccgcacttaatcatagtacatccatttctttatcataatgaaaccgagtgaggaattgtcttccttgctaaccaagatttttgtgggcttccttgctagcaacctcaaaaccagggaaagggtctcaaagctttataaataaactcgctgccttctcttgctttccattatacctttatccccttcatttctgttccatttctcatccatcgcgcgtcgtctccacctttgttgcttgtgccaccaagctatctcctcctctcctctctactagtgcttctgcttgctcgatcagcagtgagcttcaagctagctagcaagcatggtggagactagtacatcccttgtgaaattagagcaagatggcagcttgttcttgcctccaggcttcagattccatcccacagatgcggaggtaatcttgagctacctcctgcagaaattcctcaaccctagcttcacctccttgccaatcggcgaggtcgacctcaacaagtgcgagccatgggatctcccaagtaagcctcaagtctcatatgcttacatccttaattctcttcttctctctagagtctagactagatagctgtagagatgtagatgcacaattgcttggctcttgatgttaatttgtttgttcatgtatgaatctgattattgatacaaattaatttgaattgaaggcaaggcgaagatgggggagaaagaatggtacttcttcagccacaaggacatgaaatacccgacggggatgcgaaccaaccgagccaccaaggagggatactggaaggccaccggcaaggacagggagatcttcaacctgcagcctaccagctatggaggcagcagcaacaacaagaataataagcagctggttgggatgaagaagacgcttgtgttctacatggggagagctcccaagggcaccaagaccaactgggtgatgcacgagttccgtctccacgccaacctccacaacgacaacccgaaccttcgtctcaacctcaaggtattcacattatattatttcgtttcacgcagcttaattaattacttgcttaattagctagctagctagatgtttaattatcttgaacttgacacaaattgtgacctgttctgacattttgggggggtcaaggatgagtgggttgtgtgcaaggtattccacaagaagggagacgatcgcgaagccatcaacaagcagcaggcacaggctgcagctgttgatcagtactctgccggaacacccaacaacggcagctccgtcgaagccggcgacgacgacgacgacttgttccagctcgactccatcatcgaccccagcatctacttcagcaactcatcagctgccaacatcttgtcggcgccgcccaacatgtccaattccgtcgtcgctgccaactacggtgcaagtacgacgacgactggtactgctagtgctggtagcttccagcagcagccaaactactgcagcttgatcaacaaaagcatcagcagcagcaatgtctcctcttggaataatatgcctccacctcctcctgtagctgaaggaggagtccatggaattggaagcagctacagcttgcagcaccaggcagcaatggtgaaagccctacgagatgtcattcgtctcccaaatcctcttggcatgccgcagtacaagttagatgatgcttatctatgggactcatcgtaatagctagtgctgctgctgctgctgcttaattacgtgctgagaatttttggtgctcgatcggctagctacggcactactgaattgagcatgtgcctggatactttgcatggtcgtttggtcatcgaattattaggaatatactatatagctatacattcgtgcaattttgttgattgctttgttgtttagttttggtcttctgtacaaagatcatgacattttgcttcgtgagtttcttgctggtaatgctgattgatagatgttctcttgcggcacatatttttggaacttgctatataatactctagcctttaatttggtggcatttgtggatgagacttcttctgtttgttctttattgtgatcgtatatattttgcttttgtgcacatgctgcattttgtaccatggtacatgtcacttatttcttcatggagtaaattgcaacattggttggattagactggtgccaatcaaaagaagtggtgcaaaggaatgaacaagagtgagagagtatttatcaggtgcaaagcagaaagcacaatcagtttattacccttttccttttcctaatcttgtcttgtatgtaagcttgctacacaagttaggagtgtggccttgaggttaacacagctagcaagcacagcactacagcttggtgcaagctagctaagcactgtcagaataaattgactgtcagataatcacgtgcagccagttcgctgtataagttggacggcgcatgcaaggccatgtggtgatgtcatattgtcatgtgatatacactaataagctagttggctttggagaagttaaccacgaaaacggcgtagtatctatgtatacctagctaagagaataatcgaaatatatacaagccagctgctagctagtaaccaatgtcaggatcgatagcaacgacatgaataatcttttgtatctggctgctctgaattaattatatatgaccatgtttaattattgttggatctgtatatggcagctctgaattaggaaacggacacggattttctacacctagatgctagcgctgcttactcagcttttgacattttgttccttcttcagtaaagaaaaaatattgtgcataatgtgtttacatggagccaattaattctttgtgccttgagtatatggaacccatcatatggtgtgtacagaccttaatttcctacccttaggcagggtttttactttcggttttcaccgaaaaattttggtgtaaccaaaattccattttttttgggggaatttcagaaccctttttttgcctgaaattgtttgaaaatttaataaattttgaataaattttgaccaatccataaaaatgaaaatgttcgaaaaattcggacaagatatttgctcgccggaggggagggaaattatcgaaatttcagaaatttcaaaccgaaattgaaatccctgcccttagagct

SEQ ID NO: 248 - DNA, 4322 bp, Oryza sativa
tgggtttgcatttagtacaaatcacaaagctttttgatgaacattttgacctgactgacacaagcgcacgggcgaagccttttgtcctcgagcgattggaaggagcaagaactctcaccccctgtgctgaattctcgcgtcactgtccatgatccagtgatcatttcttggatgtttttgtttgtgtgtttttgcagttagtaagataattaagaaactacttaattaccagttgtcttgttcttcattttcatggatcagtttgcagatgagatctctcttcaatgaaattggtggctcaccgattcgttaaaaaaagtttatagatgagatatttttccctttctctagcagaaaaaagttcattttgaaatggacatgtactttccatgaatgtttgaaacacaccgtgtgtttgcatatagtaattgaatctaagatgggattaaactattcagcgtgcctatccagttttctagtatgttcagaatcttgcaaaatatttaagaatgcaatcttatggactgtggaataataattccatgtggagtagtaagagtacgtgatgagttagcataagattaaccatgctgaccatggagcaaattggaccggtttccagcgtggcaactcagctgcaattaaatttagtgtaacagaactctacttagaataatagaagcttcccttccttccaacacttagcagtgtctcacacgctagctgataaaaaaaattgttgagctattacactgcctaaggccatcactatcttatgagaattcagcaaaaaacaatatatattttagtgactacgcattactaaagaaatatattactcaggaagaatagaacatcagtgagtatttcagaatcccaaaacatcagtgagtaggttttagaatcagtattaaagaaatatatcttgaagttcatgtaaccaaaattactcaggaggaatgaaacattctaaataaactaaatgtattggtgtatttggagaggctaaaacaaatttctgaaaaattcagaaggctaactgttgcatagtttaatgattgttttgactgccgtacatgagtattctaaagtgtgaattgaaagtgacggtaatctgctgagcttgttgttctctttgagacactgatccgggattaaagaaaccttgacagcttcaaatagagaacacttgtttaatgcagaatgaaatccttcagacttgtgggcctcatctagtcaatctaagcatcacaagctttcatatataagtacacatggtgtgtaatggatttgcaatagtgatcaactgtgtcttcacctcactggcttcatccctagaagccattcactagctactgcacaagtagtacaggagcatcttttgtcagatttgcttcaggcttgatcttttcttgtgtgagatatggaggagagaaatgatgtcaacatggacaagtcagatgagatcctcctgcctggattcaggtttcatcctacagatgaagagctggttagcttctatctcaagaggaagatccagcagaagcctatctccattgagctcatcaggcagcttgacatctacaagtttgatccttgggatctcccaagtaagcttgcacctacttgttcttacttcttgaaccttaatgaatggattcaatcattcaaacacaaaaactccaaactttagaagttcatttttaaagatagcaagaggaagagaatattttctttgtagtttaaggacatcttaggaactgcaaattaaacataagagaaaaactaaccggcttatgtgatgtctagttgaatagaaactagtgacacttctctgttgaaagttgaaagtaaagtcaccaatatcatttttgttgtaactgataaagttatactcgtaaatcaccttactgcaatgtgtctgacttcactatgttgatcattgacagagcttgcgagcacgggtgaaaaggagtggtacttctactgcccgagggaccggaaatatcgcaacagcgtgaggccgaaccgggtgacaacagctgggttctggaaagccacaggaactgacaggccaatctactccactgagggtaccaagtgcataggcctcaagaagtcccttgtcttctacaagggcagagctgcaagagggatcaagactgactggatgatgcatgagttcaggcttcctacgctcaccgatccatcgctcccgaagaagccgattgacaagaacattccgctcaacgtaagcattccattcgcaatttgttatagtcttatagaactgaattccaaggttttgtcaaattctgagggtgcactgttctgtttctgaaaacaggactcctggacaatctgcaggatcttcaagaagaccagttccatggcacaaagggcactctgtcagacctggggagctcaattgcctggaacaattgatccagacatcttctctacattgcaatctgtgcaagcttcacagtttgccctggagagttcctcctgctcattgcaagctgcagcaacggcagctcatcagatcactagcaagtatgcattgcaaggtaataataataatcagcagcagcagcaacagcacaagcctagcaatccactagatggatcttcatgcaaggtcataaacttcaactgcagtcaatctgcagaagtccagaactcccagatcatactgccatttgaggcacacacatcgcagaagaccgctacgccgctgctcttcgacacgcagtttgggcagcctgaccagatcagcagatttgtggtcgattcatctgtaaatgcaaatggaggaggcatcagcaacaagagccaagatccatcagcaagaaagcctggcagtggcttcagcatgaacagtgactgggatggtgtggcaagaatcaacttcccgttcgatttaggagcagattcttcagaagattggaggagcagcataccttgggaatccttccttagcccaactactgtccatgctgagatgccaaactagctgcagaggaatgccaggggtgttgttactaatattattcagagatatagatgtacaaatacagtgagtcaccttcatctgttagcatttctgttagcaacaaaaaaaaaaaaggtattgtttcttcagttttgattagatgtactgtacatactgtgagatataggagtacttgttaacagcaaagctaacagagagaaggttactttggttgtgttgtacatacattttcgagtttctgagtgctgtgagagtgtgatgagtattgtattgtcagtagaagaaatatatgtgaatttatatggcagattggcagctttagaaatatactccctccgtttcgaaatattcgacgccgttgacttttttaaatatgtttgaccgttcatcttattcaaaaaaaattaagtaattattaattcttttcctatcatttgattcattgttaaatatacttatatgtatacatatagttttacatatttcataaaagtttttgaataagacgaacggtcaaacatatgctaaaaagtcaacggtgtcaaatatttagaaacggaggtagtattaaaaaggaggggatgttacagaccatgaatctcatcctttccgtatacatacctgtctcgacgttgcatcaaagctctactttcacaaagaaagaatttcaggttccacacatcaaacataattagctatttcaaataccgtttggagatgggtataaagcatttcagattccacacataaaacataattggtagtttgggactacttcaaataccatttggagaaagttatcgctatcagacgatatcacgattactttgctgtggatattgcaaaccctgtttcgaagaggcacttcttcagtatttgccagtttttcttagccaaagtaagatatttaatttattcaggtcaattagcgtgttaaactgcactatgggtgttttggttactggtcacaactaaagttaggtaaattgtgacagccacaaaagtatggtaacaaattgctagccataaaatatggcaaagttaacatgctaatgaaaaggtgaaagaacatgcgtaacaaactgtaacaaccaaagtgcggccagaaaccaaacaccccctgtatccgaaagttaaatttcagaaatgcatcatcttgttcttgccgagttgatagacatcgacatgctgatatgaccaattgtgcatccaagtatccaacattctgggcatatttatcaccaaacgaaatagaccagctaacaaaaagtattaccaaataacagagggagtaaaacaaccacaa

SEQ ID NO: 249 - DNA, 3288 bp, Oryza sativa
accatagaattgctcttttttttatcctccagtgcctgcaattgcaacagtttttcaatctccaatgcgtgtccaggattaatcagtcaagcactagcaggaatgagctttaacgactgggtagtaatttaagcgtactttgccagatattttacttgtcatgtaaagtagtagtattactaaattaaaaagtgtgcttatcattttttatattaggagcatatctaattgctctaattgaattcgatcagtgtgattgatgctatatatagagaagtactactacaacagtaattaaatatctgcatttacaatttgttacctagttttttttattgatttgcttttatctagtactagctttttaaatcgcgcttgagggaaattgttccactgtatatttttgggcaaagtccattgagcaaaatgtagtggaattttaacagggaacacaagcacaagaaagacagaaaacctaaccctacaaatttccttttggtacgatttgcaacaggctttggacatcaacttgcattagacccagtccatcctctcttttcatcgttgttttagaaaaaaaggaaaacttgtcctcagctctagcactagcatgcccaagtcgatgaggtatgtgccttaattaactaacattcagtcagttagtcaccggatagctactactactaacatgcaatgtagtagtattaaattaatttagttaatcaggtagtgggcggcgcagattaaagcaagaaattccgatgtttgatgagctacgcagctaggacaggatgagacagtgaatggcagagtccaagtcacacacactacactagaatcgatgtgtcgtcgtcgtacgtttgtccagtaaaagtcagctctcgcatgactacgacgatggaatggaatggtgaccacttgctttgctgctacagtacttcctactgttacatatgtcatcgtcatcttctccaacgccggcctatatataccaagcaatttaacctctccttcctcccccaactcatcggtcgattaatctcgcctacaaacccatttacatccaatacagctagcatcaatacagagctatggagcagcagcggagcaggtcgacggcggcaggaggagaggtggaggtggagcagctgccgggattcaggttccatccgacggaggaggagctgctggagttctacctgaagcaggtggtgcaggggaagaagctcaagttcgacatcatccccaccgtccacctctaccgccacgacccgcgcgagctccccggactcgcccgcatcggcgagcgcgagtggtacttcttcgtcccccgcgaccgcaagcaggccaccggcggcggcggcggcggtaggcccagccgcaccacggagcgcggcttctggaaggccaccggctccgaccgcgccatccgctgcgccgccgaccccaagcgcctcatcggcctcaagaagacgctcgtctactacgagggccgcgcccctcgcggcaccaagaccgactgggtcatgaacgagtaccgcctccccgacgccgccgccattcccgacaccatgcaattgcaaatgcaacacgacgacatggtgctctgcaaggtctaccggaaggcggtctccctcaaggagctggagcagagggtcgccatggaggagcttgcacgctccaccacgtcctccggcacccacaacaccggctcgcccctgcagcaggactcctcctccatctccatctcctcctcctcggacgccatgaagaaagaggtggtgggggtggatgaggcgtcggcggcggcgcatgagctggtccgcccggcgacgctgagcctgccgcagctggaggtggcgaggccgcagagcgggctggagtggatgcaggagccattcctgacgcagctgcggagcccatggatggagacctggtcgccctactacgccagcgtcctcaacttctgattacgtactcttacctcattaaatcactgctatgtacttagtagttaattcattcacaaagaattacactactactctttctatgaaatgatcatgatcagagagctcgatcgatcatcagtttattaattaattatgacccccggtgcatggttttgcagcttaattgcacatgtatatagatcgacaaatcatcttttttgttctttcgttttttagaactgaatgtatttcgcaaagatggcagcacaaatataaagcccaaataagcgtaggcgttaacaaatgaatggaagaatcatattcgttttcgaggcatatgtatgcttttcaattgcgagaatttatggattttgcaggcaagcatttaaacggtatgatgttttttttacatcatttcgtatatcagtttatcagaatacctttttaaaacaacttttcaacttttataataattatttcatttgtttataccttcaaatatttgtcataagtcccattgtttcgcttatacctgtactaaaaaatttttataatccaattatctaatttccgttccaccaccgcaaattaggtacggggactccctcaactatcaaaaccatgtcacgttgacctaattggtttgggcatcaatttcatcctacgtggcacgttcatttgatcttcatccgctgcacggtgagcatgcaccgccacagaccatctctctttctgactcctttgttgtgtgccgtcaggccagcaattgccttacctatccaaccgttgtggcaccatctggagagagggactgacctaccattgccatcgctcatgagggctccatcacctcttctctctctttagtattctctgaccaaaggagcccacagaggactacctcaaaccagcattttagatatagcccacaaggcctacttctctccagagaaatgcataagaacatcggttccctagtttttaagggacctgatgcagagcaagagttaaatgctttcagaaaggctatacatccaggttaatatagtcaaattagggaaaatggtgcgaatgtataaacaaggccccccactcatcacaatgaacagtcatggtctaagaaacaaatggggatatggcaaaatcggtagagggagtagcttgtagagctggtaaaaagtgctgaagagagtagtttagacttccgggatcgaactttggtcttacaaggaggcaataaataaataattaatttttttttaataagacgaatggtcaaacacgtactaaaaagttaacggtgtcaaacattttgaaacggagggagtatattgta

SEQ ID NO: 250 - DNA, 5445 bp, Oryza sativa
gaccatcatctacaatatatttaattctacaaaacagcatgcaagtatatccaattatcacctctcaaattatttttataatatttaatgtatacttataaatatgtttcacattaaagcgcatgtattatttgtttgtatcatgataagtgctaataaaccataacgtttcattattttttctttttactcttaacttgattgttgaacaaaatatattaaaaattacttagtaattctcacatcaaaacacgggaatcagctagttatatagattttttttagccctgttcggaagcaattgttgtggctgcgactgcagccgctgcaaacagtgcttctattgctgttatttgttgcggtgctacgggagacatctccaccaaacgcagccttgtttagcaatagaatacttatatgattatatcctccttacctctgcagccttactccattgatgggagtaaagaagagaggtctaaaaaatgtcacaacatgagctactctctacaagttgataatacttgttgttttacagtacaagtctattgctaaactttaaaaactttaactagggaatgatatctagaagatttatttttgaaatatggagaacgtatgtatagatcagtcttaaaaattactttaataaaattcagcccggaagtagtacaagtttgcatgcatccaagtacacaaatccagataatacccatgcgtggatgaatataaactgcaaatggttgtcaacgccttttttaaaaagaaaaagaaatatgtttagtccataagaggttgcatatgatacacatttttaagttattttttgaaattttcatatccctatatatctgttccgttttgcagagagatcatcatcagttcctagccatatattatcttgccatgatctcatcacctcggctgtcgcctggcgccggcagccgacaggtgcctactacgtgcacgcaaactggcagctgccttcacccgtactataaaatggggcacacacgccttgctttcttattctcgccgccacacaagttatttttgcccgcgattcaattctctgaatcaatctcacgtacggtaagtctttcattttcctgccatgctcatgaacacaaattaaagaattaattaatgtttaactagatggccttattatctctacatcacacgttatatctatgatcttgcagtatatctacgctagcttagctttcatattcgatcgtttaattaattagtaattacacactcgatcgtccgatcatatgcatgaatgcttgcatattgtactttactgtcacctggtatgtaattcgctctgctttttcatggtgtagtgtttacgtacacgtgtatatgtcatactacctctatttcagaataaaacaacttgtgattatgtacatagacatactcttattcaaatacagagctaaaaattttatattttgaaacgggggtagtagtaggggaaattgttttcatcccttaagatatatccctttgttttttataccacttgaatagctaccaaaagaattgaaaaaaaaataggcatgatagatccataagaaatatgctattctacaaatatgcaaattcaaattcaatatatagaaataaaaacaaaaataacatatttattgcaaatggtgtgtactattcgcagtgaaatttgttattttcgcttctacttatatatgttgagtttgaatttgtatatttatgaaatggcatatttcatattgatctatcatatccattttttttctctttatttatgattttttagcaatatgcacaaaacgagaggatgtatcttcgtatggttcaaatcctctgccttaatgacaccactgcactgacatgcgggggtaataggatggtcagacccatatatcggtgactgtaatggtagtgatatcatggtagatgattctcacccagacacccatctctggtagagtatatatatattgcgtattttgtttgttggttaatcttgtctgccgggtgcatgtatacgtatacggcgggcgcagatagatcgatcgaaatggaagaggagcagcggttgccggcggggttccggttcttccccaccgacgaggagctcgtcacctactacctcgccaggaaggccatggacgccaccttcacctccgccgccatccgcgacgtcgacctctacacctccgatccatggcacctcccatgtatgccctagctctagctgatcatgatcatgtgatggtgtctagctcgttgagagagagagagagaatttgacagttaattctcgatcgattgatggagatgatgaccatatatatgcgtgacgtgttttgcgattaactaatgcacaggcgactcgtcggcggcgagcaccggaggcggcggcggcggcgagtgctacttcttctgcagacggagcagcaagtacccgtccggcgcgcgcgtccgccgcgcgacggccggcggctactggaagtcgacggggaaggacaagggcgtgtacgctgccggcggcggcggcgggctcgtggggacgaagaagacgctggtgttctacgaagggagggcgccgcgaggggagaagacgagctgggtgatgcacgagtactctagagcaccgagcaccaacttcatcagaggagctcaggcacgtacacataatcttctcgatattatctacgtatgattaattagcttcccttaatcctcatggctcatgcacgaagatgctgtgatacagttcaagttttcaagattcactacttctaagttctaactgtactggtgatattcttctactattggtacgttggtgatcctaagcagtgagttggtcgtgtctgggctccattgatttatcagaatacttgtatatatataaaaaaaagcgtaaatacattaggaatttcaaagatgtcgacacaattggtttccaaaaataatgggtagaatagagtacatatatatcgtgtcgattttgtgcaactcttaatttgtactccctccgtattttaatgtatgacaccgttgactttttaatcaacgttttaccactcgtctcattcaaattttttatgcaaatataaaagtacttatgtcatacttaaagaacatttgatgataaatgaagtcacgataaaataaattataattacataattttttttaataagacgaaaggtcaaacgtttgttaaaaagtcaaagacgtcatacattgaaatacggaggtattaccttacaattcattctaatttatacctttcaactccatcgccaactttatctaattttccttgataacacatgtaaaaagaaataatcgatcgctagcaaacgctctttgtcatcagggctcaacgatgccgctggcttcgatcgccacttgttcgtagtcattgatttaggatggttgtatctcagcaatagaaagtgctcctacggggatcagacgttgatcgatgttcttgacgtgttttcattaatgtttcctcggtgcagagcgagtgggtgatctgcagggtgttcaagaagcagcctccaattgaacactggctggaaatggaggaggtggagacgacgacgacgacgacgacagtgcaggagcacacgccaaaccggcgccgtctccctccggcggaggctgcggcggcgccgccgccgccgtccggtcagccgtggcaacacacgagtcgccggtccggcgatggccgtgctgccatcgatggtggcaaccgtgaggaggaggaggatgaacatggcctggctcgagaggagtcgtcgtctccggtggtcatcagctcaccatcacgctgcacctcctcaccgtcgtctcggcttctcaaccatgagcaccttggtgcttcgtcgtcagatgacctgccggagttgatggagttcggcgacatctacggcgggatcgccgccggtggcccgacggaccagcaggcctcatcatcaaactcaaattccatttgcaactttctcgacgagccatactactgctggaacttctgaatttctgacagttcagaacttatatgtacgtatattaactaatcactcaatgtgcagtcagcatatgcagtaatgtatataaatgttattaggcgtaaatccagttttaggtgcaagcatgcatgttttctgaacagagaatatgcatgtagatcaattgaaatgtgtagtttagcatctagaatatacggattgatgcgtgtaaagaacactgggttggaagttggtaccaggatgtagacatctgggacccatatgcatgatccaactcactttgtgtcatgtacatacatacttatctcggtactcttctccaaattacggggagtgcctgtactgtacatgtactagctggtttggtagcacaaattgttgtataaaaaagtagttattattgcagaagaatgttcaaagccaatattcatgcaactaattgaccaatttgcataacattctttgtgtatacaaaccaacccaaaataagcaccaacgtataagagtatacgtacctacgaagatacgatcctgatagatgggtgtgtttagtctatttttgtcaatcatcagcacttgccacttgcttctgagctttaattgcttgttcttctcctctttccagcactagcttgcattgatcactcataataagaaaaaccaacttgcaataaggaataaaagataggattagttaatgctaatcgcgtcatcaatcatgaaaacatgggaggtcctcgagaagaggtccgatatcgatacatccctgtcacgtgtcgatatttccatgacttgttctcttctcgttatcctgcaagccgtgtggatctcaacgatcttgagttagcacccgacatgattgagtccaaaaccatatagatttgaagtttgaaaaatgacagctctttgtaatcaataatataatggatggattaatgattggacatgtcaatttttacttgtgaccaacggcaactgaagtcaagttggacattccccggataatcagataatccctgcatgtatccgttaatgaagctggcgatagcagaaacagttaatccatgattacctgatttcatcttaatacccaagagaaacagtgttttgaaggtactgtaaatctgtaatatatgtattcagcttataacaaaagaaagaagtcacctcaagacaactttcatcgaaaggataatataaccaatactgtatatacctgtatggtccggctctaatcaattattctcctatggatctgcagaatgatgaattagtatgcctttttaccaaatgtgtataaaagatgctaacaacagagggaaataaaatgcctgccttctacaaggtgacaatcttgtctacatttcttgtgtcatgtcataatctcttgacgtaaaaaccgtag

SEQ ID NO: 251 - DNA, 5026 bp, Oryza sativa
ttggcccttttgatccatctaagcttcaagagacatgtctgccaggtcatttgttctttcattaggtgcaacagtttttgtttcagcatggcggcacaacactgcataaaaaaattataaaaacaataatatacagaatatcacagatttttacattttagaatttttgtgaatgattaggtggagcagttttttgtttcaaacatggcagcacaacactgcataaaaacaaatttataaaaaaaaacaataacatgaaaataatataaagacagctttttacattttagaattttgtaaattattaggtgcaaaggcggagccaaaaacactttaaaaattttttgattgaagaaggccaaagtgttacttttttgaaaatttgcgaaacctattgccgtaaaaattcgaagccatttgggagaccaagcccctcctcgcctcctgccgtctctaccccggtgcaacagtttttgtttcaacattgcagcaaaacactgcataaaagaagtaaatacgcagaatatcacagctttttacaattatgaatcttgtaaaaaaaattataaagcaaggaaatagaacaacactgtttccaattaaaacacctcccgtatagcccttgtactatcttgtcagatttgtctgtttcacgtctgcaacgaacagaaagatgcaattaccaaaaaccaaagtgttaaacaacctaaaaaaagtcgtcctttttttttctgcaattaaacccagagatgttttgtagctagcgtgacacaaactgaacaagctggccatgcatgtatatctctattaaaaaaaacatagtgtcatcatagtcatatcataggctaatcttgtaatgttaaccttatttttgtcagaccaaaaaaaaagctaattaaccttgtaagtattagtccttttttaagaaaaagttaagcaagttttggtttaactaattaaattaattaattaggtataaatgtaattaagcacatcggctcaaggctgcttctttctcctctcctataagaagcagcagcaatggcgtctctactcggactcctcttctcttctcttctcttctcagagcgctgcgaggcaaggaggcgagcaagaagcggcggcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatggggtgggacgacgacgacgagatcgagcagagcgtggacgcctcgtccatgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaaggtgattaatgacctcatttctattttttcactgttcattgctaattatttaattaatcagcagctccagtttctactagactgtatcttattaattaaattaatcagcattttctatttctacttttctaatttcagttttggcaacatgtttcagttcttgagtgatgtatactggtgtaggtcctgtaggagtgtgtttgtcatgatatttgtcactgaaattggttccaattttggtgctgaattcttgaattggctccacttcagatccaaaaaaacatccttttttcattagatctatgtcataccttgtcatgttcacatggtaacatgaggagttcctattcagcttgctggatggttgttttacagttcagttatggtaatttcagttctgaaattatacttcaatgtcttttttctaggactttataatttgtcgtagcttgagattacacatattatggggaactttgattctgatccatggccagatttagtgatgcatgattaacacagtgccatgcacaagatgtagttgaaagtgaccagataccagataactcacaaattcttttcccccttttctttctgttttttttttgtagttcttcgtgttggatgttttgtctttaacttttgttggtttccttgaaaaaagtcgttcactttggaagtttcggcatgcgaagtgcatattcagttctctgcagtcctttcgtgtgaagaacttactactttccttcacagcgatcaagatggttttgaacaataaagaaagacctgatgtactacagttcttgggatattatgacaagttgcagtctaacaattcagcgccatgtacgatgtgccgttttttagtgtagcagtacaaaacaatttatgtcaaagtgttcttaatgccaactatgtctgactcgtttcatgttaatatctatagtttatcatctcattaccagttttcttctcctttgtgacagatggacagagcttctatccttggtgatgcaattgagtacttgaaggagctcctgcagaggattaacgatcttcacaatgaacttgagtctgctcctagctcttcgcttactggaccatcatcggctagcttccacccatcaacacccacattgcagacgtttcctggccgcgttaaggaggaactttgcccaacctcatttccaagccctagtggtcaacaagccacggttagtcaaattttgaccatgattgttaagcctttgcactagtggcaattatgcaattggcccttgatacttatatgcttaagcatgctttagtgctcaagattaacgcacttgggagctactccttttgtttcaaaatataagcaattcttgctatgtatctggacaagaaatgcttatattttggaacggagggaatattacttatttcgcggtacttgcactttgcagtctgcacaagtacttgatcattcaggccttgttgattcatgtagcggtaacaatatggtgtatagcaaccaagtgacattcacctctcttgtttgttcaggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgaggtttgcattctccacatcataatatttttctcctccagctgagggttttttttcagttgtgttcgatctgatcctaccgttgttgttcactctcttaatgcttgctctgtacttctgttttgccagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgtttttttttctgaatgttgtttgtgatgtaataggatctttgtccattgaaaccatgtccattatcatgatgagaatatgaacccagtgtcttttgaatgaattccatgacatcgatcatgcagacacacacagcttgatgcacaataaagaagcttatgcacaagagattcagcctcttctgaatccaacaatgattttgtcactgatcagcgggcaggcagtctggtccttgatccaacacaattgaattctctggcctcttattatttatgcaaactgttttttgcagacagtgaggaagccattgccagctgaatcatgcctatgtgcaacgctgaggtgatagatactagattcatactagatttgatttgctcatatgcacatctggctaatacattacacaaatgaagagattagttagggatttggttggattggattggattggattggctgcttccctgtgctggttcagtgatccctgtcccccaacctggcaaagcaggatgcagacatgcaggttggagcagttgttgcctcctgccatcagcctcccggaccaaatccagatttgaaatgcagcattaacttatgctcaaaatcagtagaaaaatcatgttcggtcataaatatttcacgttttaaataagattcggtcaaacatttttaaaactttaaccatcaataacttttcaagtacgtacttagtttaaatagtttaaaaactaaaaaaaatggtatttcaagatttttcttaaaagttagtacactatcatagtagtaccataaacttattcctttctctttcttttcttttgaaatcatatacttattattcttctgtaagattgaccgagttttgttttaaacattaaatatttatgaccagacggagtattttctttttctcttagatcccattagcaacgtgccaatgttagctcgagagatattcgataagaaaaagaatcaatgctaaatttctagtaagcttataagtttattatcactcgtcaacttcaggatgtgttcagaaggcaaggtttcccctcttgacacggaatcaaagcaagcgatcagagcgagattaattaagt

SEQ ID NO: 252 - DNA, 5238 bp, Oryza sativa
tgatataatatttcaatggtagtaaatctttcattaaaccgttcttctacaaatgcatcaacatgtcatccaaatctatatgatgtggtacacttaaataagatcataataaagtagagtaaatgtaaaatatacaaataagatattttcgatggcaactaaatcttatattaaaacattgttctacaaacgaatcgacggaccatcaaaatctatactatgatacagtatagttaaaactaaatagagtaaacttaaaatatacaaacaaagtattttcaacggtaactaaatctttacaataaagtgttgttctacaaacgaatcaacccatcatcaaaatttatatatgatcgtataattaaatgagatcatgattaagtggagtaaaatcaatatatatatatacaatattttcaatgttttctcaattttacgtttaaatgcattccacgtattaaaataaacccatcacaaatctctataagatggtatacttagtaacaaattaataatcctgcgtgaaaatgaagtaaccgtaagtacgcaaggagataagaccaaaacacctcgaatgaaatattttctttttgtgatttttgtcggtttcaaattgtgtggtgtacacagagaaatgcccctttatcgctttactcaatcagcagatacagctcatttacagcaaaggatttgtcgattcccaaatttatcgaatatagcacaaagaaaactcctttttatatcatagtaaaatcctccctcttccaatatcctacccctccattcccctttttcactttttttctcctttttgtaaatgacacttttgctaccttccaaaggtaaaaaggaaaaacggcttgtgggacaaatttggaatcatgggcattccagtaatttcacacctctttttctctctctcctccagcagctgcagcaatggcagccagccagcagtagagtgctctcccctccatacaaataccgccatagccagcgagctctctgcacctctgcatctctgccatctccttccccaccccaccgccattgccgccgcggcgatgctgccgcggtttcacggcgccatgtggatgcaggacgacggcggcggcgaccaagaacacgggcaggcggcgccgcctgggcaggagcagcaccaccacgaccagcatctcatggcgttggcggccgcggccgcgggcggcgccgggttcggcgcggcgcaggcgccggcgccgctgctcgatgaggactggtacttcgacgcggcgggtggtggtggtggtggcgcgcatgggtccatgatgctgggtttgtcgtccgtccatggcgggattggggcggggacgtctggtggtgggcatgggcagcagttctcgctgctcaacatgggcgccgcggccgcgccgttcgacgtctccgggttcgacctcgggatcgcctgcggcggcgttggcggcggcggcgacgtggtgtcgtttcttggcggcgggaacgcgtcgaacaccgcgctgctccccgtcgggaacgcggggttcctcggcacgttcggcgggttcggcaccgcggcgtcccaaatgccggagttcggcgggctcgccgggttcgacatgttcgacgcgggcgccgtgaacaccgggggcagctcctcctcctcgtcggcggcggcggcggcggcgtccgcctcggcgcacgtgagcaacaccgcgccgttctccgggcgcggcaaggcggcggtgctgcggccgctggatatcgtcccgcccgtgggcgcgcagccgacgctgttccagaagcgcgcgctccgccgcaacgccggcgaggacgacgacgacaagaagcgcaaggccgccgcgggcgcgggcgcgggcgcgctgtccgccgacggcgccgacatggtgctcgacgacggcgacgacgacggcctcagcatcgacgcgtcgggcggcctcaactacgactccgaggacgccaggggcggcgaggacagcggcgccaagaaggagtcgaacgccaacagcacggtcaccggcgacgggaaggggaagaagaaggggatgccggccaagaacctcatggcggagcgccgccgccggaagaagctcaacgaccgcctctacatgctccgctccgtcgtgcccaagatcagcaaggtcaggattccttctcctgctctcccaattctcatgaaatctctcaaaaagttcttaattctggcgaattttagggaatgcgtaattttggtcgaattttgtgtgttttctttgccatgaagagtggaaaggggaaaataaattctgtggttagcattgctaccaatattcttgtatgatataagttctacttatgatttgaatttctgaacttcaagtatatgagtttgatgaactatttttcatagccaacggcatgcatttcagttgcgattgttcatgtcaaattgtggatatacaccaactttggaaggattttgtttcatttacagaaattctagcttctagttctatgttctgttaggaactttgattgtctttaggaaggagtagatagaatgacttcaattgtcctagtcgttgctggttacaagaattaaatgtgacttctgttcataagatgtctgcatgggaatttttactgtccatcacactgtcactacctgtctctgctgcctcctgttcagtttccagtcaatcgagtagacttgtagacagattgcagaaaaacaataaaaagccatgccctacataactgtgttttagtttagttttagtagtcagagaatctttcagtattttgttgtataaaaaatgagttgctctattttcttttactaccttttattttgtgttgagacagtgggagagaatgagttagtatactgcactgcatcatctgttatctgttcctgaatactgacattgtttcctttttcacatttcctcttgctggtactactaatatcattcatatgaaagcaattctatagtgatgcattatacttgtgatgatttagcaataagatgattatatgtgtttgcaattggtagatggacagggcttccattctcggcgacgcgattgagtacctgaaggagctgctgcagaagatcaatgatcttcagaatgagctcgagtcgtcccccgcgacgtcgtcattgcctccaacacccacaagcttccatcccctgacaccgacgctgcccacattgccgtcccgcatcaaggaagagatctgcccaagtgcattgccaagccccactggacaacagccaagggtcagtatctcctatcttctgaatgtcaccagatgagagtatagcttgtttcagatgagataacctgcatatcagaaaaggaattgcattgtcattggtataattatgcggttgataagtagtagacagtaaaatgtgcaatgtggttgatttatgcatcagattttctaactattgccaacctgatcaagcatttgacacactttctgacctttttttctacatcttgcaaaaggttgaggttaggctgagggaaggccgggctgtcaatatccacatgttctgtgctcggaggcccggtctactgctctctgccatgagggccgtcgaaggccttggtctcgatgtccagcaagctgtaatcagttgcttcaatggctttacgttggatatttttaaggctgaggtaatgcataaaattctatgctcattttcagaactagcatttcgatatagtatcctgaaggatagtggtgatggtactgaaactcaatttgaactgacaattgctcaattttaatgcagcaatgcaaggacggccctgggctgttgcctgaagaaatcaaggccgttctgatgcaatccgccgggttccataccatgatctaggacaggagagctcaatcaaactccaaaggacagagtagctcaggaattgacaaagtaccggtgtttcctggtcatgtggcattttcgacagaaggaagttcctctttttagtagttttagacctgctcagggcttgctgaaccagtttatcttctagtatttagagtccccaaaaaaaataatgtcagtagtctcttggtgctttaacattgtgttttgaaaccttctgcctgttttttttacttcccggtacatgttttcgtcttgtgtaagtctgaagatgaattcctatcaattaacaggcaaagaaacaggatcattccaagaacagctcaaatcctgtctgtgatccatccttttccttgcgtgatggtgcttgtcatatgttttctgtggctttgtgctgtttgttgggtttgtaaaagactaaagctgttactgtataatgttttgagtaacagtaacatatggtgagagatttcaggacagttatttggaaggaagcaaggcaaagtggtccttgtattgtgcaggaccaagaacgtcttcactgcatcctgccattagcagcgctggatttggctgctctccaataaaagctgggttttcttttgaaagaaactgacagaatttgttagtgtagtaaaacatatgttactgttttctttcaaaaaaatcacttgttaatgcctgtgttaattgagctagaaatgcagaaacaacaacagtggtaaagctgcatcctacccatggtttctgaaaaccagctggactgatccctggattcagggttcgaagttggttttcaatgttttctagtgcttcttcagttacattttttgccttcatccttaaaaaaaagaaataaataaatttttattacaacggtttagcgtgtatctggtggcacactcatgcgtggtgtatgtatgtgtcttttgtgtaataaaaagaaaaggtataataagattcatttcataattgcttacatccaaaaattctgtactcaaaccttttttttcctgattaagatacatattttatcttggttttcattagcacgctttttaaactgctaaatgatgcatttcgtgcaaaaactttatatatagagtttactttaaagtacaaaataaatatatttttcaaacggatctctcgtttcacgtgcccaacattgaatcttagtgtgacaaaattttataccataatcatttttgcatccagaagagtttctgaacttgattgcagttgcatccagaagagtttctgagtgaggccccaatcaaatcttgcagagaaggtagtacgcacagtacaactggccatgaaatcaagaactgccgtcact

SEQ ID NO: 253 - DNA, 19110 bp, Oryza sativa
atcggcgacggtggtgttgctcctccacctcgcgcaaccaaagacgagggggcggcagctggtggcggtggtgggcgaggaggaagtcgagggaggtggccaggcagcgccagtcgtggcacacggcgtcatcgctcctccgctgcgctcgcctgcagaagaggggttcccatcctctgccgttgaggggaaaacggcagaggcgcacagtgaaacgtgaggggagctacagtgccatctcgttgctacagtgaacaacactgtagccacaataaaaaatatactaattatttttattgttactgtagcatttaatctcgtgcatccaaaacttgatccaacgggtataaatgcccccaacggcatgttactgtagttccgcagaagaggagatgaggagagggagagggaagaagatgagagagaggggggagagggaagagggaagaagggaggtgtgaagatgacatgtggggcccacgtgggtcccaccattttttattattttgtatgtgagagtgacacgtgggccctacatgttttattatttttccggttcgaattgcgaagtaagcgccacgtcaattccacgttagatgaagaccgagtcaaattagccacgtaggtgccacgtcagccaaaaccaccatctaaaccgccgagggactttgtttgcaccggttttgatagttgaagggcccgttgtatctggtttttcggttgaaggacgaaaatcggattcggtgtaaagttaagggacctcagatgaacttattccaattttcggccacacagattttggcccaacataacggcccataaaatctaacttttcggtgggccacaagcccaaagccacggaaaagggagcgtccctgccgcgggatccggcgtgcacccagtccatatccatagaccaccacggcacgagcgcctcgaggcgtccggtccccaccgcgtccccgtgaaccgggtccacgcgtagcaccccccctctctccccccaccgcggcggagaaagatctgagccacgtcttcgctcgctcgccggcgagaggtcgaccacttcctctcctcctcctccccgcctataaatacgacccaccccccccccccccccccccccgcggcttctcccctcgctttccccacacggccgcgcgatgacgtggcgcgcctcgacaccaccacctcacctctgaagccccccacctcacttccgaccgcctttggtccccttctagaagcttccaaaccctagaggaggaggaggaggaggggtttcggtatggcgaaggcgaggaagcagaagggcgaagagcagaagcccgacggcggcggggctggcggcgggggagggggcgccaccgtgctccaccagaagctgtgcctctccatcgacatggagaaccggctgatctatgggtgaggccgcgcccccgctttgctcatgctcgttgccctaatgcgtgcccactttagctgcctttgttgggtggttgatttggttggtttggggggatggttcgaggcgtgcggattagggtttgggggttcgtgttttggagtctgacttgcttcggctaaattgtacgaggaatcgagagttgctggaattgagtaattgtggttttcgctggtctcacttgttgtctgatttgtcttcggagttgctgctggcgtagcgagtgaacttgtggtaatagtgcaatgtgactgctcaacagcgtatttgatgcggatttgctgtgcctactgcggattgctcattgtgtgtatattacttcagttctctaactttgtgggggctacttatgcaatatgtgctttagtgaaacaagtattctcctgcttttgtagctgataccaatagctatacttatgcagtatgtgctttagtgaaacaagtattcttctgcttgtagctgataccaatagctaagctcaaaattgagatgtttaaactgttgtgaaggagcttatgtgaccatagtcgatcattacctctcttgtagcagggttcgtatgagaggaaacaaattgcttatccacatcgaatccaacagaatttacgcattccaaatgaacccttatacctaaatgcagttgaatactgctgagacggccaagatataatcttaaatcgtataagaccagcttgctgaactagtccactgctgtcacaaaagtcatgtgccaagctatttaatcattgttaaagtttaaccctgttggccaggggctgagcctcaatgaatgcatgagatgatttgctatattaagtggaaattgcacggtagaagcttttataagaggaaatggcaagtgccaagtggtactgaaatatgcagggcttctgttgcagtacgtttatatgtacatgtactctcaatttcttggaagttgggagttccttacttgatagcacatggttttggtagactcaacatgtgtttggtaatcaataagttttgagagaaggttttaacttctgtttgtaaagttgattttgagaaatgaaagaaaattgtatctatgctaccaaatgtggtattggaaagaatgggaggctgaatttatgttctgtatcagcaaaaatgcagacaaatatttgtagctcactgaatataacagtagtgacaaatgcttgcacaataattgagtgtattggtgtgcttagttcttcgaatgacatcagtaatcagatcttgaaatagtggatatggaaaagacacaccaaatttgcatttatcgcttgttagaatttgttgtatggttttctagagcattggttcaatagatacaagaaatttatgattaaataccatgcagaaattagcagaaactgacaaccagccactatgtaaatatgttgtgtcttataattctaatctagatgcaccttggcttactggtaactgcatacaatttgtcaaagtgatattggagaatctaaattgcatttggtgtataaacgtgctaaggtctcatatagtatcatgacttgtgacagtaacatcttccgtttccgtagaataatccattgaaatgtcataatttcatagttggagcatgtatcagttatgtacttgcatccaaaacaggtaaacttggagtaaatgagctttcacagtattctgatggatcaatcccagtcttgttgtcacatgataaagttttatcaagaggtggtgaaatgtacctggactattagtcttttattatcctttctgattcaaagtgagcatattagatgccaacttataggatttaatttctttttcaccttgaacttggaaacaatcctagaacacaaccagttgcatatcctaacctgcctacaaataatcttaggctgcgttctaaatggtttcagagttctgggttgaagagtgtacttcttcctattgtatattgctgtgcttgtagtcaactctttctaaaagttgttaaatgggtttcgtgcattttaactgtaagttcttaactaaatgcagctgaaagaatcctaatagttgtgacttctgctttgtaattcacctgttctatccagtctccatagtataaaatttatgtcttttaacactgggagctgattgagcttacatttttggttcactcaaaggtacactgagataaaagttcaagctgaaaatgatacttttgctctgcatgctgacaacatgacgattaggaacatattagtggatggtcaagctgctgagtttgagtattctcctcagtggaaaaatgctggtgatcaacagagttggtcttcagtatcatgttcgaagactgctgctgatgctgcatgctcagtatatatctcttctctaaatagtgaagctgcacctaatctcatcatctcgtcagagagatcaagcaaggcaataactgagccacagtacgaagaaaatggtgaaaaccacgaagaaaatggtgaaaaacatgaagaaaatggtgaaaaacaaaatgaaaatggtgaaaaatgtgaagaaaatggtgggaaacctgctcaaatatctgatgatcaagctgttaatggctgcaacggttctgctgataagaaggacaaagaagaggaaactgagaaggacaatgaaaaagaaaaggaggacaaggaagaggaaactgagaaggacaatgaaaaagaaaaggaggacaaggaagaggaaactaagaaggacaatgaaaaagaaaaggagcagctaatgggaactgatgagaaggagaaggagaaggagaaggaggatgagaatgaggaggagaagttggaggaggaggagaagaaggataaggaggagaagttggaggagaaggagaaggagaatgaagaggaaaatggaaatgagaaggacaaggaaaatgataatgaaattgaaaaggtaaaaataagtatggttagttcatgttgagtatctcttcctgttacatttttggatgcggtgccttactgtgaatctttataggtgaagaacacaaaactggttcacatagattatattttggagaaggctgaaactggactttacttcactggcaacatcttacatagtaacaatcaaataaggcgtgcacactgctggtttccttgcattgatagtgcaacacagcgctgtccgtaagtgaaaattcttgcctctcaattttgcttttatgtttgctggtgctggttaacaatttttctttgtttcatgccatgtccagatttgacctagagttcacagttagcacgaatctagttgctgtcagtaacggtgacttgctttaccaggtatgcacttaatcaagactggtaatgatgcaaactaaacatatactattaaattcctcctaatggaaaacaaatgccttcaacgaggaagtatcatatgtcggccttattctaccattgttatggccatgggccaagcccatgcggcaaggttaggcaggataggttaggaataatcaaacaaagtaggagattatctagttaggaaagagatgagttatcagttatatgttaataaattagagatagagagattggattggtttctataatattagagattagttccttagatgtctagtctcctccctatatataaatggaccccatgtactcttaccaatgaagcaatgaatctctgaaccctaagcctcagagccctgcctgtgctattagagggcgagtggatccacactggtctttcagacccttaccctagccagtccatgacaagcatgataatgctctttgatgatatctctatgtactgttagaatagatatattataccatttcacaatgatcaactgcatgaatgtttcattttttgatgttggctgacctttgtgcttgcacattctgctgttgttgtacttgtatcatgcaggtcttaagcaaggaagatcctccaagaaaaacatatgtgtataaattgagcactccagttagtgcacagtggatatctttggttgttggtccatttgaagttcttcctgacaggaatgacataagtgtatcacacatgtgcttatctcagagtttatcaaagcttgaaaataccatctcatttttccacagtgtctacaggtgataacctaaattgtccaaaaaaaaaaagaaaactaatgtctagattcaagtactagtatctgaaagaccttttgttgcagctgttatgaagattatcttgctgcatcatttccttttggactatacaaacaggtttttcttccacctgaaatgatagtatcaccaacaagcttaggagcttccacttgcatcttcaattcagatatcttacacgacgaaaaggttatagatcaggtgcgtgtgtgttctttctgatttttgcctctaaaattctgcaataaaggataactttgtccctttacaatattttgacattcatggttagttattacttttactgtttttagaacattcatgtcaactatggtaaattttcttttcctgtttcttttggttatgaacatgtgtttcatctcctcttgctcactgagggcctgtaaagttttatatgatgtgcagttactgtaaccactagaagtcctacaaaaattctattttaacgagcttgtgctctgcatttgacagcatctggtgcttattaatttacctgctatttgatccaaataaaaacaaattgaatatgcttcttggaatcctatgtgtgatgcttctgttgttttgtcttgtattcttttgcattattgctgtatgatattttataaaatgatcatggttgcattgacagctccataattagacttcaggtccttttcttagtactgttctaactaacatgtagaaatagttcagataattgacacgagaatcaaagtagcatatgctcttgcaaggcaatggtttggcatatacacaaatgcagaggaggcaaccgatggtaagtcagctctgcggctctgcttataatatatacctatagtattcgcaactagataaaatgcatctgacggtttaatgttttttttttgtgcagagtggttattggatggtttggctggttttctcactgagcattttgtcaagcgttatcttggcaataatgaggcacgatataggcgtttcaaggttggtttgtattttttgctaaagtcagattcttcttgccatcaagtagttagcttaattcatacataaattatgaatgagaatatatactcaattctaagtttgtacaggtatattagattaatcaaatcaaaaggtagacaaaataaaacatgatcattgattggaaaataatttatagttggattggaatataatataattttcttttcctgcaaatccctcaaagtaaaagttgtagtaatgctataatgctgacgtgtctaggtccataatgctaaaatgttgcctgaaacgaatgctatcacatgctatttttgttattagaatattttatatagtttgtctttgttagttcttgcatttgtttatttatttatttatttatttatctgtaaatgtatgtttattattatcattgatctgctgttacaaacagtctatgatagatctcattaggagttgaattaagtacatcagaatagatatgcctactagtacacacttctattaaggtataccttttctgttgtctctggtactttctacctgacaaacggaacaggaaaaatgggcatctttcatgtttcttagaagtgcggtgtcatgtttaaacaaaatgttcctagttaattagaacacttaaaaagaatctttcagttgtaattggtatagctatgtgtcatttcttttatttctatatcataatatgtgtaggatgttgctgctgatttgaccatatttactttgcttttgaaaccagtgcacgagagttatgttgcacacagttttggtgttgattcacatattaacttgtcattcaccttccaaccaaattcactggcaaattatgtgtttgcttcttgtcttgcattcattcaccttaatcttaacggttggtgtcgggcggtaaaagggatttactggcacagttatttttcttggaacattatttatatcttaattttgtctttccagcttgttaattatcaatctgtacttgtaataggccaattgcattgtgtgtgagtttgatgtcagtggtgcaactgctttgagctctccttcagcttcaagtgatttatttggaactcaaacaatcggttcatatgggaaaattcgttctttgaaggcagtaagtttttggccttttgaattacaagtttacagttgacataaatgtattactccctcactttttttcttttaaacaggtatctgttcttcaaatgttggagaaacagatggggccagactcttttcggaaggttagcaattgcatcttctttatatgtacttattacaatttgctgtattaaatgaatgcaacagtttgctcaagcaattgatattacttctgaatgtgtacctctaacctcttgcgaagtaatatgtctatgatacatatgaacagctgcaagaactacatgaccattcttgaacaccattggctgaactgtagatgctaatgctttttatgcatttttttcttaagtttcttaatgtggtctggtattcattttcttcattttgagtaaactatccctatctacatgtactctctgtgttacgtgttttcctattggccatcttgtacttagccatgctgacaggctgtaaccattcctgatttcagattctgcagatgatagttgctccaactcgtgcctcaagaacactaagtacaaaagaggtacatcagtacatggctttcaactatgcagttttgcagtgtgcctttactaattgcatcaatctggttattttctggtctttcctgcttgttcatcatcttgagttagctacaaagtccctagccctttcttgtatccattttcctccgtcatgaagaaaaactttcacaatgagtgaagtaatttgttatattctgcaaatgtttatgctgatgcttcatgggaagtttggtttgaggaatcaaaccttccaaggatgagttggtacttcttggaggcatcccactattccatatatttgcactactatccaaataccagtccattgcaatggacttcaaagaagcatatcatatattcatatgttgtaaactcgaaaagccctatacactatacaattttccaatagacgtcaatgcactattcatcttattagaagtcacatgtgcaaatgattttagttatctgcaaatgatactacaaactcaagaaatggtggagggttgacagactcaccaccaccaacaacaaaagcttccattgtatagtttatattatcgaagaacatgaacttttaaaggatgagttggtgatggaccaacgtattccattcttcataaaaacaagtggtgacattctgagttaggatgagatgatctgtttgctgttctaattcctctagtcaaacagcgaaatagtcaaattacttaccttgtgctccatttttggcaaaagttgctattattactgatatgtgaaagtaatcactatcaagtgctaataactatagtttcaatgtttggtctcaatgtgatggtaaaatggtcaggatgtgtaacattatctgtttggatgttttctacactgttatattattagtttagtcctgtatagtgcaaccactgtggtcatctttgttagcaactgagtttctttctataaatttcgtttattcagttcaggcatcttgcaaacaaggtcggtaatcttgaacggccattcctgaaagaattcttcccaaggtgggttgaatcttctggatgcccagttatgaggtaaatgaaccttcttagtgcttgttcgtgttgagttttcccctgtacgctatctccatatacttactcatatgtgtattccttctgcttgtaaagattgggaatctcctatagcaagaggagaaacttggttgaattagctgtttcacgtggttgcaccacaaaagttgatcctggtcctgatattcgcacgaatggtgattctcgagaaggtgatactggatggccaggaatgatgagcgtacgtgtccatgaaactgatggagtgtacgatcatccaattgtacccatggctggtgaagctttgcaggtggtggaaatacaatgtcattccaaagtagcagcaaagcgctttcagaaaactaaaaaaggctcaaagcctgatggttctgatgaaaacatagatgcttcaaatcaagataaccgtgcgaggtcagtttccaagtaactacttttttttgccctgccatttctcactggtcacttattgcaatttctgggtattgcagtatggatgcacctttactgtggatcagagtggacccagaaatggagtatctcgctgagatacattttcaccagcctgtgcagatgtgggtacgtaccaccagtccaccacatgagcttaatagaaaggggcatttctgtttaaattgagtatttattatgtacaaatcatatatggctatcatgtcattggccacactaacttttcaagttcattgaatagttgtggagaatacatttttgttgctttaacccataatcaccagaaatgcaaacccctcacccaccccatccacacacacattgacaggggctgtcctctcccctcatctccctatttatcttctcttttctatgccctctccgtacttgttggaggaggagaaagattgacatgaaggaaattgcatgggtgatggcgactgcaggagattgtgtggtggttgtgatcaatggctttgttgccctttgtggcttcatgtggttggttggcgcattgttttgtactggttggctgctctctgttgatgaactggttggcaataatgtgctgttttgttactttctgacccttctcctgttttcgttttcttttccttctattttttctttttcaaatatgttcggattacattataagccatagctttatgattggatcagtgatcgtcaatcctgattcagtgtaatagccccccgcttcgcactgtagtgtcccaaagaagagtaccctctttgctacattttgagccaccatgacactacggtttgggcactatgaaagtcctcacaattcactctcaatgctctgggtatttagacagtatttggaatgagatgggactttgccgttggggttgtgacacttgtctacttctgccattttctgttctgtaaaaaactgttgacctgagcttgatttgatgactgactatgcatcagaggcatacgcttccactgcagcacttgcccagcctctgttttacatatttgtatgacatatatgacgacattgggatgtttttccctttggatgattgatcaatggtgcaaattgccctctcatgaagccaaatcatcctaattatgtctagctttcggatgattgatcacaggtgcaaattatacaaattactagatgatacccctgtattgctgctggaacttgtgtggagtcaaataagcaatttgatcaaacgataggtgtatagaatcatacagatcaaattgatgatgtggcctcacgccctcacgcgtcagctcctttacaggagtaactgcagttagtggatgaaaatcatacggaagtataggatatgacgtcaaactagctacagagtaattcacctgcagctttcctgcaacaccgcacggggttttcatctagtaatttagatggcattgctttatttgtgccctgaaaaaaatgcataacatgtctgtactacagttccatttatgtattttgcaaattttataggaaaacgaattggttgacatttgcacaactagagaaccacttctgtgcctacgtagataattaatttgtgttcatttgctgggacacactatagtgtaaccatgtaagtatgtcagaatgtttgcttatactttgtgaaacatataagatgcattttggacaactttctgccagttgtctaagcttcacgataattagaaattaaaaacttatcctaatatgtgtgtgcgccttttgttctgtgtaatcccaatttacaacattcaacttatttcaagttttttatcacttcggcagatcaatcaattggaaaaggacaaagatgtcatttcacaatcacaagcaatatctgtactggagaaatcacctcaactcacttttgctgtgactaatgccctcaataatttcttaaatgatacaaaggtatttcagcatgtttcttgagatcttgttgaatatcattgagtaacttgttaataatgctgcaggcattttggagagttagagttgaagcagcatatgctttagctgtaactgcatcagaggtatgcgtaagcttgtttgtcttaaactatttttccaaggcattaatattgtaattctgaatatttgtatatgcattcaaattcaatttagaaaatttagatcaaaaggttccatttattacatagctgactgatattctcaattatacatttttatttgtgaggaaggttgaaagtttgcgtttattctaaatttcacctgaggcaatccatgatgtgaagtttttttacttaagtcatatgcctttcccctttcactagaatcgtctgtgcaattgccagtagaggaacaaggatgaaattaaaaaagatcaaggatccaagcaaagtttgaatctgaagtaagatgtagaaaaacagaaagaaattaaacaataaaataatacaacagagaatagaacaagtaggtgatgtttgggcatttgcattcattttaacttccatacaggcatacagccctacttattttgcaacatacccccatatatatttttcatggtgcctggtcaccaagatcttggagcccgagcaccatggtgccccaattaaatttgctatatatagcacagtaggagtctctcctgctgtttttggtctctcttcttcttcttccttttttttttttgcaaacatagtatctggaacctgggaatgggcgcttacacaacggagttagtgattcacacttgacaatactgaagtagctttacataacctttaggcatgcatggaagattcaaactgacttaatgtgtatacaatcttctttctgtatctttctttgttctcactagaagttgatgtttgagcatatgaatctgtgttagactgctcaatagcacagaggagatgttttaatgttaccacttttttgcactgatgtgttacttatttaagttgttttctttcatttagggcacagaactaactggactgcttcatctggttaagttctataaaagccgccgatttgatgcagatattggattacccaggtcaagatccattctgcagtagcttattttcgcccacaaattatccctcttttatatgtttgtgtaaacagcttcattcttgttttactgataggccgaatgacttccatgatattccggagtactttgttcttgaggtaatgctttgaggtaggacttatatttgtgattacccatgacaagaaaatccatttatgtcagtattgctgacatttccgtagtgccaggttgcttgttgacaagtttacgtaggatacaagttatttggtttcatctgtaggccactttggatgggctagtgtcctgcttgatctgggggactcaaactgtacttagtttgcttccttgctagttgggttcatcgtttaaataaaattaggttggtataagtaatgagagagtgtctagagttgcgacaagcaaggattttgagatagtcttctttcctctagtttcccacctttcttactccagttcctctgtcccatactatggaattcaaaactcttgatattagtccagtaggtattgttctaaatgaaataaagttagtgtttgtggtcacttaatcataaccatatatgcaagtgtactgtctcttgcctgacttaaatagacagttcaatccttacacctggacttagtcaactaaacatttttaatccgcaatccagcattacattatgcataaacacattgctgaagtgatttaaaattgatctgtgttgttcaatagtgttttgatgtttcttatggcagtgctgcacttatgataataatttgtattttgcttgacttatgttccttctattaggcaattcctcatgcagtagctcttgttagatcagcagacaagagcagcccaaaagaagccattgaatttatccttcagcttctaaaggttgctatttatctctggtttgcattttatctgctttttaaattgtaactccgtgttatacgttgtcaaaataggaaatatttatttttcatcatttaggatcttgtacgtgaatcaatataataattttgtattcattacttgtaagttgtaaccctttgttatatttattcagacatattaggaagtatttggttttcaccatttatgatattcttgaacacaaatcaatacccattgatataatacttgaatgtgtgccgactaatacatttgcacattttatattgtttcagtataatgataacaacggaaatgtatactctgatgtctactggctatctgcaatggtgcaggcgataggtgaattagaatttggccagcaggtttgtatgcatgtatatcttctgatagagtatgaaaaatgttatgtggacacctgttgtgatgaattacctatttcaatgactggaagcttgagctatcatctatgctacatgtgtattacctgcttgacaagaaaaaaatatttatactactgtagtaggagtacatggcatgaatagctatggagttatggaagtacctgctaaatgtaaactataatggcaacatactatttaaggattttactaactgctgtgcatgtgcctgagatatgtgctttatcaattcaattttgcaaaaaatgtgtacattaaaggtttctattctatccatggcatcaccaaaataatcaactcatataaagtagataattatggccttatggtctttaaagcactgcacctgttgtttcagactacagtttttattctgcaattaataaattagaattatattcttatggtttatatggactattcttgtccttaaggttttgctgggtattcttttttaggtgttgtcaagttgtttttaaaacaatggtatcaaaaaatgatgttcattttctctgcagggtgtaggtctattgtcgtctcttctcaagcgcattgatcggctcctgcaatttgataagttagtagaaaatatccaattactacttttgacttagctgtccttcatttctgtcagtcctactaactgctagaaaaaacttgcagctttatgcctggatacaatggggttttgactgtcagctgcattcgcacccttgcacgtattgcacagagggtgtcatcttccatttgccttgtaagaactcttccgttggcaccatgctcctgcatgtgtctaatagttggtctgatctgaatatttcattcatatggtgtaactttttgtcgctgtaggatcgcgtctgtgaactaattgtgccctatcgcaacatggacaaaccatggaaagttcgaatggaagctggcagggttcttattgatctcgagtttcaccataaaggacttgatgcagctcttttattattcttgaaatatgctaatgaagaaagatctttgagaggtttgatgaagattgctatggtacttctggcatatcttgaataccttgatttcttttgacgttggagttattgcaggagggacaaagttggctgttcatgtcttgcgtctatgccaagccaatattgaatctcatgataataatcaaatacaattgccaactctagttggcctcctttgcctgcttgctggcaaaaaggcctacaacaatgtatatcttcgacataatgtgttctgcatattgcaaattgctgctggaaggttagagaagttgctttatatgtattttccaattttcacatgttcatttataactgcaaaccctagcatataaatttgccttcctgaaaaggatcaagtaaactgtttctatgtatcaagcatataaattaaatttctattgattattctatgtacttctactagtgcttaaagcatatatgatgcataaaatttaaaagatgtgtaactatctacaatcaaataacaaaacgactttttctttactactacagcggtttttgtcatatttttttcatcaatacaacattacaacccaggcatttcattctattgtttccagtttctagatgtcattcgcagcatttctgtgttcatatcatgtttaacttagtgtgttcatgtttgttctgtgtagctttattatgtatgtcaatggtcaccataaaacatagatacagtaatttatatggcagctcattgtcaatggctgcgacggtaattaggtagagtaggattttgatgatctccgagatgtatgagtaccacaatgggccctctagattgtcatggaatgtaggcgggatttgaacttctactgaaacctctcccttaagtagacctgtgttttgttgcctttatatattaaacctcgagtcctcaactacctaatgtataaggaattgccaacattagcagatctgcgttgtttgtcagtgtccctttatgtgactcctttctgcggttggtcaaattgtaggaaaaaaaaatcagtagtgttgcttgttgtttttttagacaaaaaagaagatgagatcagtagtgcttcatcttcaacatgcagttcactgccccgactggatattgctgtccccaaacaatcctatgttgtcgaataacgaatggtccaattaatttcagtttatcacaaacacaaaacattaagtcatcaaacatgccttgcaacactgaaattggtttttacttattgtaactttttgttacactatgttatcatttgtacttctatactaacatgccatgagtctcaggtctccaacactgcatggagttccgaaggttgtcactccacctcaagttgtcctggagatatctagtgatcagcacactaaagctgattcctcagttcctcaacaatcaaggcctcaagaaccttccactagcactcctagtgtccgtgaagtcttacctacctctggacccttaaaagatgcggataatatatctaactgcagtgagagaaggaatgttatttttatacccacaaaagatgcggataatatatctaactgcagtgagagaaggaatgttatttctatacccacaaaagatgcggataatatatctaactgcagtgagagaaggaatgttgtcaaaataagggttaaacgtgcttcatcatccagtaaagcagatgatgctgatcacagagatcattcacatggtagaaatgaaaatgaagcaggtccatgtagctctatgtcagtggatgcacctatgactgaagcaccagaaccagtaaatgtaagtaatcataacatcgaggagcaaaactcatgccatgatagggaacaaaactcttgccacgatagggaatcaaggatgtcagcaagcattggcaatgtcaaactaatggacaagcatgaagtatccaaggagctacagtgcacagccgattccaggctagatgctctccccaaggatcacttctctcccgttgttaatggacaggaagtcctagacaagccacggagtcagctagaagtagtctccacaagctatgatggaaatcaagccccagactccatgaatggattggaaacgaaggagaagaagaaggacaagaaagacaaaaagcggcatcgagataagaaagatgatcctgagtatctggagaaaaaacggcttaagaaagagaagaaaaggatggagaaagaaaaaggcaaaaagcagaaggaaggtgaaggggtttcttcttccgaacagaagaacacagcgaaaccttcagactcgcaaggaacctcatcggcaaggccaccagctccaatgcgaattcctgaacccaagatatcaaatgtgggtacgccagtagatactacacggacattgacaactactaagattaggatcaaagtcaagcctctgcaaagataatttgaagagagttggcagagaatcatattgtgcctgggtcaccttttgtaagaaatactgtacagtagagaaaattcgcgatctgtagggtgtacgatgagtagccaatttttaattgaatggctgatgtatcctgtagagagatcatactggcccagtaaatttctggggtaattggtgccaatttcgagcattattgcttgtggtgaaatcatgaggcctcatgctagcttgatttattttgttgtgctccttttgcttgtaagtttgttattagcttagctattgtcgggaaaggaatggagacgagacatgaatcttgccgttctgtggaaattctgccacatcccaacagaaaatatatgtgttgaaccctttagattagttactattccttaatttcaattttttgtacttgagttgtatatatattattttgattgtttctgaatggacggtgttatcctgaaatttaaatgtcttattgctgagtattgtcaatgtgaaagttatgtgcctttgctgtttcaggatgcaacacaggtgctctagttctattaaaaaaaaaggcaatcggtcttattttttcgcttatgttatgcttatcagttaaaatttaaattttcaattttaaatttaaagttgttgttagggttttttcattgaagtttatttttcagcctttgcttttagatcgctagaacatgtatataaatattttattcacaaattaatttttatttataaatatgtcgtttcacttatttctacaccattttatggggccaagtgtgacaccattttatgcatactcagtgtccgcgaatgagtgctagacatgtgaccatgcattggttaatactactctctccctatgagtcttataatatgaaatagagggtatacgacaatgtggtagtacgcgagtatctgattgatacagagaaagcaaaaggcactatcaaagtgtcttctgatgatgacacaattgacactcactaccccatttagtgatcgaactgtcgttcttagccatagatgcactacctagtaacatacatctaatatacaaaatatatacaatgaatccacaccattcgacgctctaccccatttagtgatggaactgtcgttcttagccatagatgcactacctagtaacatactcctaatatacaaaatatatacaatgaatccacaccatttgacgtgtacgtcgtgcacgcgcgccgcctgccctgccaagcgaggcgaggcgcgtgtgttctccctcttctctccatcacatgtgcttcaagtggcaaggagtgcatcatcccttttaaggaggtcccctctcctagaataagtaagatagtactaaactccatatgcatgtcatcccatgaggtgggattttatgattttccagaattaatcttcgagtgggctaaggcctatccattaattcc

SEQ ID NO: 254 - skipped

SEQ ID NO: 255 - DNA, 5468 bp, Oryza sativa
caaaaaacacatgataagaacataataaatgcaatgcaatgctattcttacgaccagattggccaatacacgattgaaactaatcagcacagggtagcaaatcaacagggtatagtggtatactgaacttatcttgctgcatgtacgtttcaccctcttaagaaaatcttgataagaaataaataccacgatatatatatgctatcattagaaatccacaggataagttgaaacttccttgatgtatgtacatttaggcgctgcttctttcagcttaggattattataatccaaattattaggagtaaactgaaagaaacaaacaacttattgaagtagcttattataatctggagcctagcttaggccctctttatttaggcttaggtttattagcctagacttttaagtcagcttatatgatttataagccggtggatttaatgtcctaagtttagtagttgagtcatacatctaactcacataagccaaaaaagcttctccaacctagcttttggcttaatagtgttagagtggcttatggcttcaaaaaaaccaaacggaaaagctgcttgcttgtttaggctcagacttttcgacttataagttggcttataagcctaaacaaagagggcttattataatatgataagctcatttaggtgagctttttccagattattgggtaaaaaattacccgtcataccacaccactttctctttagacttgtaaacccaataatttaggatgtaataatctaggaaagaaacaactaaccgtttattctactacagattataacaatctagcttatggtaatctgactcaataatctagattataataatcctaagctgggaaaaacaggccttactccctcccctccctagctcgcggacaccatatgagcttccaaactggcctctcactttctctctcgcgctctgcctctataaataccacgcaaggccttcccacgcccaccaccattcgaaagatccctcgaagatttttctcctccctctctccctctcctcacagctctctccctctctcctagcaacagcatatatagcgcaaagacaataacacacgactagctagcaagaagaagacagctggttcagaactctcaaaacagctgtggtgtccaagtgatccttaattctccagggtcatttggatggcagcctccttcgtcatcgtcatcgtcatctccttcttcatttctcttgcttttatgtgctatgtccactacacgagccggcagaggaggaaactccatggctacggccatgagaaagccgtcaggctgccgccgggctccatgggttggccttacatcggcgagacccttcagctctactcccaagaccccaacgtcttcttcgcctccaaacagaagaggttagttgccaattaattaaaaacccaaacatgctgctaatctctgcaacctgaaagcatggacgcatgcttttgaaggacatggatggcaagataatgccaagctgccaacacaaatactgcatgccatagttgtgggcttgtagctttcggcgttattgctgatgtatggcttgtgtgtgcgtgcaggtacggcgagatcttcaagacgcacattctgggttgcccgtgcgtgatgctggcgagcccggaggcggcgcggttcgtgctggtgacgcaggcgcacctgttcaagccgacgtacccgcggagcaaggagcggatgatcggcccgtcggcgctcttcttccaccagggcgactaccacctccgccttcgcaagctcgtccagggccctctcggccccgacgccctgcgcgcgctcgtgccggacgtcgaggccgccgtccgctccacgctcgcctcctgggacggcaacgtctccagcaccttccacgccatgaagagggtaagaattgccagccagagcatgaagaggaatgtgccggaaaagcagtgctgctcgccacgaggatgcatgtaacgtgtttgtttttttgttcctttcagctctcgttcgatgtcggcatcgtgaccatcttcggcgggcggctggacgagcggcggaaagcggagctgaggcagaactacgccatcgtggagaagggctacaactccttccccaacagcttccccgggacgctgtactacaaggcgatccaggtacgcagcagaagccaggcactagatggcacgagctgtagcatattctagtgccttcctcacgtcgttcttgtacgtcctgtttgcagcaacagtaggtgataaccgatcgagttcctttctgcatcttactaaatctgcaggcgaggcggcggctgcacggcgtgctgagcgacatcatgcgggagcggcgggcgcggggggagcccggcagcgacctcctcggctgcctcatgcagtcgcgggcgggcgacgacggcgcgctcctcaccgacgagcaggtcgccgacaacatcatcggcgtgctgttcgcggcgcaggacacgacggccagcgtgctcacctggatcgtcaagtacctccacgaccatcccaagctgctcgaggccgtcagggcggagcaggcggcgatccgcgccgccaacgacggcggccggctgccgctgacgtgggcgcagacgcggagcatggccctaacccacaaggtacgtatgcgcgaaaaatacacccatttcccgagttttcattcgattcccgtgtatttttgcggttaaattactgacggcgccatctgctaattcctttgttgccatctccctcccatccttcggttcaggtgattttggagagcttaaggatggccagcatcatctcgttcacgttcagggaggccgtggctgacgtggagtacaaaggtacgcacgtgcgcagccctacgctacaacgtggccgtaggggagccacgtccgttactccatgcatcgtgtgaaaaaaacagtgtagattttttttttttagttttgctgacgggaccgtgtatttttccttggcgtgtagggttccttatccccaagggatggaaggtgatgccgctcttcaggaacatccatcacaacccagactacttccaggatccacagaagttcgacccttctagattcaaggtatgggcctcgatcgatcgatcgatcctcgccgcagtgcttttgatgtcgatgcatgcatctctgaacaaactgaacactgttcctttcgatagcattaaattccctcttctctagtcaacggcagctctttgtgatactgttcgtggaatgaaattataataagacatagttgtaatacgtcaggtgcgaataggtatattcagtttcagaaataatttgtaccttttctcgtcagaatatgtcagggttttcggccattcgacaagcccacaaataggccagaattcacactcggatcagatgtataccatggaaatccaaccaaccattaatcaacttgctgctgagtcaaacccttatctagaacatttgtaaatgacttaatttatctttgcatagcagccgcagcaaatactagtggtgctaccaatctgcagatagatagagcctcaaaactgaagtaccacgagtgaaacttcttttttctgaaccttctctttttttctggttgtgtgtggaacaatgtctatgcaggtgtcgccgaggccgaacaccttcatgccatttgggaacggcgtgcacgcgtgccccgggaacgagctggccaagctcgagatgctcgtcctcatccaccacctggtcactggctacaggtgcgtgcccctccacacagattcgccatatattctccccttgtcgttgtggaccacaccgtgccatggctgctgccactccattggccccttcctcccagctgccagattccgcatacacataccacagctgctagtacacgcatgctccaacctgtggggtcattcactgctcagatcgcacagcgcctactcagcatcctagtaccacatatgagcagtcacatgcatgtcattggagacgagttggttcctcaaatttcgttgtggaacggtgtgctgattgacgtctgcgttcttgatttgcaggtgggagattgttggttccagcgacgaggttgagtacagcccattccctgtgcccaagcatggccttctcgcgaaattatggagggatgatagtgtcagtgtggaaacagatggttgccagaacggtgataatgacgacaatggcgtagcaatggtttgattaggcgtttaatgtagataagctagctagggagatatttttctttctttcattgcccttctatttcctcaagggaagtccggggagaaaaaatggagttttcttcttttttaacttgatcataagaaggtaatgatgatgagaatgggttctcggaggaaaaacaaatgataatgtgtaatatcattgacattgacccaaattaaatggcttcagcagttaatgctgctgcatttcggctccctttcattacaccaaggcaccaacgcgtgttgccatatgcgttttccccgtacacggtacacctgggtgcagacccccgggttggccccggtttcaggccgggcttaaaaaaaaaactgatgcgagagccggcctgaactcatatatagtaggctcacacaatgagttcttgccataatcctcccgatcggtcagacaaagcagctcgcaccgtcgcacgcaccgcgcgcaaggcgcagagacgcgcagcgcacgagatgcaacggattaacaggcgaaggggatcgaacgagcccgtccgtccgttggctggttcccaactccctcgcgtcgcgtcccccaccaacgccacgatcgagcccaagacgctgacggtggcagcctggctcgcgctcgatcgatcagcgcccacgcgccacgcgccccgcggaacgcgcgatccgccaccaaccaaaagatcaccgatccccacaggcccggccccagttcggacggtacgtacacgtacgtttattacgacgctgcttgccactgctgtcgagtgagttggcgcccggcacaaggccacacaagccggccgttggagtccagctcacgacgcgtgagcgcgtgaccgaccgagattgtacggctctgtacgcactacctgttccgatcgaagtatcataccatcggccgcacacgtcggacgcccgcacgggcccggcacggcaggcagcgagcgcgaggtggttcggcttccccctttcagccacattcccccgtccgtccccgtcccgcgcacgtcgtcgcaccggcagacgaccccgtacgacgcgacgtcgctcgttggcctactactagtaccacgctagctagtacagtagtacgtagtaggcgtactcgcggagatcgatcgagctggctgtctccttactcctcgccgcgcgatggtgccatggtggtccgcgtgcataaccggccggctgagctagctctctcccacg

SEQ ID NO: 256 - DNA, 7079 bp, Oryza sativa
ctctcaaacaattattatcgataaatttactcgaacatactcatttgctattgtacttattgtttatattggactctttacttagatttatacgcatatgcattgccatattacaactatgtatcactagttgtataattaatatgatctttatatgtctatgaaatatatattactactctgtaccttctgttgtaatataagcattttcccctttaaagaaaactcgattttttttcacaaggataaacctttttaccttctgaactttcgagacttctccttataaaatcattacgcatatgaggcacaattcacaagatgcacctactatgtagcgtaatacaatgtttgacgttatcgcttcatctgtttgacgccgcatgatctaagcatctttaagatggattgcttaccacaactagccttcgcattgtatgcatatgcatacgtctacaactatgaaattcatgcctatctcgatatctccaagatagagtgtttacgtacaaccgacctttgtatttttataaggtttgtgaagcgccaacttctaaccggttataaatcacagaattctctcgaagaattatgactaaacctacatatctattatctcatatatataaaaagattcaccttaaaaaacttgtaaggctaggaagattgcaggcctgtttggagcttaagatttttagaagcaactagttggtaatcaatttataagaatcttgaaaaactgggttttacaacttttgatttctagtttattttttggattctacaactatgactttttagaactattcgagaatattctgattctgaaagaaactgcaattaccggaagctctccaaatatatgctggtaacgtatgtaagagagaccccaaaatttactggcggtgtagtcgtgtagaggcagagcaagcctgtgctcggagcgaaaattaggcgttgagaccgtgcggatagcgccccgctgtcctctgaccgatagataggcttttgtccgcctccggcgcgcgacacccactttaatgcccccgaggcgacacctgtccctcccgcctccctcaaagccgcaccaactgccctctctctctttccgctctccacgccccccgatgctcccctctccctcgcccgcttcgcttttctaatctaatctaatctaatccaatcggccgattaaacctgatttccccttgctaattcgggccatcgcatcactcccccaactaatcacactcctctcttctccgcttcctcttctcgtatatttataaccccacttcccttttcttcctctttcttctcatcttggtttcttcctagtttcgggagaggattttagtgagggatttgaaggattttgaggtgggagaggagatggagttgccggcggatgggagcgcgctggcgaggcaggggtcgatctactcgctgacgttcgacgagttccagagcgcgctgggaagcgccgagaaggatttcgggtcgatgaacatggatgagctgctgcgcaacatctggacggcggaggagtcgcaggccatagcgccggcggcggcggctgcttcggcggcggcggtggttggggacgcgcagcagcagcagcagccgatccagaggcaggggtcgctgacgctgccacgcacgctgagccagaagacggtggacgaggtgtggcgcgacatcatgggcttgggcggcagcgacgacgaagaccccgcggcggcggcggctgcggcggcgcccgcgcagcggcagccgacgctgggggagatgacgctggaggagttcctggtgcgggccggcgtcgtgcgggaggacatggggcagaccatcgtgctgccgccgcaggcgcaggcgttgttccccgggagcaatgtggtcgccccggccatgcagctcgccaacgggatgctgcctggtgtcgtcggcgtcgcccccggcgccgccgccgcgatgacggtggcggcgccggccacgccggtggtgctgaacgggctggggaaggtggagggcggggatctctcgtcgctctcgccggtgccttacccattcgacaccgcgctcagggtgaggaagggccctaccgtcgagaaggtggtggagaggcggcagaggcggatgatcaagaacagggagtccgctgctaggtctcgcgcgcggaagcaggtgaagcctctcttctcttcaactgcactaggatgtaggaatacgtagcaatcttatgtccatttgcttgattaattagttctgaaaattcgatggtgcctatatttggtatgcctctcgataatgctgtactttattcacatgatgtgatccccccacttctaattcagcttgtagatgttaatttatgcctaatagccactgcaaatagcaagttagcgtcgttaaatattgttcaaccacagaggataagaatctaaagtgaataagccatggttcaagttgatgctctcagattcagagagatgatgagtggctttgttcatttcgggacactggctgagcggtgtttttttttttttttggatcgactattgctgtgatagggatagcatgctcaccatgaagcttggaaggacaattgacaagaccaattcgagaaatagtaacttccgttgatcttttctttaaaaaaaaaacttgtgggggtaataggtcttttttatgtgcaagttgtgctgccatgatgcactcatacttctataaaagctagtatatacttttattgttctaacatagcaaggtcaagtctttctgatactctgattgacagagaatagttctagacagttatggttgtgttgcgaaacacaattttttaacattaaattttggctttctgatatacaacaggcttatataatggagttggaagctgaggtggcaaaactgaaggaacagaaggctgaattgcagaaaaagcaggtatacctgctgtcatataaaattgctttgatccatgcatactctttatttttttctgtttctcttaccaattcctgtaatcagttagtagtccttagataacctcttgactttggataattcctatgtttcttgcctcgattgtcatatttgtttggggatttgggcttaccaatggctgttgttttaatctacccccagcaatgcttgttgctggtattgcaatatgtaggtgaccacaaatagcattcaaatgtccttgttctatgtatttcctgtggaatttatctgagttcaaatctttaatggttgttggaggtttgcacttaaaaggtgtatccctttttaatttgaacattgatggggttacattaattttgtattactgtcctgcaaacttgtattgaaatcctatgccatctggtatcttcttgttcacacattttccatgtgcctactattgttatgccagtatgtcattgtatcatgattttgtaattgaataacttaacaaaagcaccaaaccttttcttcttccaaattcctgacaaaaaatccatgaagctttattcacttattatgcttctaatttgcaggtggaaatgatacagaagcaaaatgatgaggtaatgaccttacagttggtagtaaataccatggttctgaattcgcactatgtttgtcctcattgatgtggaagttgtctatacctctttttgatcataccatactttcttcttttttaaataaaaaacaagagtaagttcatttccacaaacttgctgattaagggatctttggatctgggtgaattttttggggcatttgcaagtttggactaaagttctgatgacttgaatccagataccctctatatccaaacagacccaaattggggcaaaacaacaagctaactctatcgaaccaattcgtttttcttgctgtgagcctttcctaaaactggcagacgccttagaatctccatggctgaagtttgtcaaagtgcacaacaacagtagcattaggtcatttattagagctgcatgacattcaaattctttttaatgagctgcacaacaacatgcacgatttcccaattctggctgtgaggtgtgtttgttattgcattttttgtggtcatgtcagaaaatatcttactacatatggtttaaattatgtttcagaaatcccttattctttaaccaactgccatcataaatgtatatgctggtgttggccatatatttcatgtcactgacactctggcctcttatcccttctcattttcattcatgtatcatgttatctatgtagggtcattgtgttacatccatcttcagttttttaacactttagtgccatccacttgtggttttttttttcataaaataaatttgaagaaactaacagagatatgcaatactggaactcctgccattgcaatagaaaattagcacatcatgattttcagctatcacagtgtggattactgtgatgtgttttttgttaaaaaaaaatgtacactactttgtcctacactcgtccctgctgtcaaataattgagtttgccatgtacagagtaaatgtccagatgtgcaccattctgaatatggtatcccattttgggcatgcatgcttgtaacaccaaaattctgttggagaacatactacccaataagctcaaggtttcattttcaaaatctagttatctgtaattcccatgtcattatagttaaagtatttaattttctaccttctgttttatttttaactaatcagttcaattttttaaccaaagaatgatactcttttaccagggagatctgaagtgacttattggacatacaatgctaaaacaacaaactaaaacaacaaaatggacattgggtaggtttgtctgggtggtatgctcaacccagtctgatctggagtattaaaaagaatcctgactctaaatttagtccaccgctactatagacgctatagtgagcctgtccagcattcaaattaaggacattagttgtgttcgtttctaatggttgggaaccttccccctctagcatgtaaaacggagcaacgatttagcacacgatcaattaagtattagctaaaaaaaacttgaaaaaatggattaatataattttttaaaccaacttttctatagaaagtttttctagaaaacacattgtttagcagttttggaagcgtgcgtgcggaaaacaagtgagtagaggtgggaaagtgtagggaagatgtcatgttggtttgaattttgaaagtctgcaaactcttactaatgttacataaatagttttggttgctactctgcggtttcaagcagtaaacctctgcctcaatcattctgaagtttaagcatttctttgattataatcagtacagttagaaggccttaactgggtgcatttttatgttccgacttctgacgatctcactgaaatctgacaagtgttttctagctgaagatagtacattttactagatgctttgcaatgttgagaaagttctcttcatagattcttctttccctaacaggagttttatctataaatggattttgcaggtcatggagagaatcactcagcaacttggaccaaaggcaaagagattttgcctccgacgaacactgactggtccatggtaagttgatcaagtttgcacagcattgaccaaagttaagatcgttggcttccttggatgtgaccaatcgccgcgtgtatatatatcagctgaagccagagtctccggtttcgccgtggcgctcagcttcagagttgcttctctccttgttggtgaatggtgatggctcagtctcttggacggtcgaatgctggcgtcgattactcactaggtttagctgcgagatcgttgcgtgagcaaaggcatactatctaatctgtttaactccttatttagggaaatctggcatggtgaaaacggggcatgccatctgtgtttgttgtttttgtgcagctgttgcatctgctctgtatgttgctgttgcgttgacatgtcatcccgtttacagttcagtgattctgttctgtacccaagtttaagaggattcagtttcagtgatctgcatgtaatttgagctttacagtttccgttcttccggatgatgtgactgaagaatatgcgagacgaagttgctgtcctgctagcgggcctgtttagctcgcgaaaagaaaatttctgtgtgtcacatcggatgtttgaccagatgtcgaaaatgcttgttagacacgaatgaaaaaaataatttcataactcacctgaaaaccgcgagacgaatcttttgagcctaattaattcggcattagcacatgcaggttactgtagcacttatgactaatcatgaactaattagactcaaaagattcgtcttgcgatttccctataactgtgtaattagtttttttatttatctatatttaatgtttcatacatatatccaaagatttgatgtgatttttttggaaaaaaatttttgggaactaatcagggctttaaaaattaatgcactcctggtttgactggatgatgatcaatcttggcctatccattctctcagtccacatgagtaaaactttcttgttttcctgcatatgccgtacaaaattgttgctaattactgtttggtttagtggagagcacgttttgctcgatcttcttgatgagacggacatgtatagtgtactaattcctgtgccccgacaaggatggctcggtggtgtttcctgtatcctgtactgtagggtgtaccacgatttgcacagttcgacaagagcaatcagtgacagctgttcttatatacttcctccgttttgcagtgtaagtcattctagcatttttcacattcatattaagcatttttcatattcatattgatgatagaccatatgaatgtgaaaaatactagaatgacttacactgtgaaacggaggaattatataaactttgcatatcatatctttgatgatggaataaacaactcatcaaatatcttctccattctaaattataagtactattttttattccttttatttaagttaaggacaaagaagaaagactgatatctcagatgggtgaaaagcgtggcaatggcc

SEQ ID NO: 257 - DNA, 15109 bp, Oryza sativa
catatcgaatttttggatacatgtatggagtattaaatatagaaaaaaaaactaattacacagattacgtataaattgcgagacgaatcttttaaacctaattgcgccatgatttgataatgtggtgctatattaaacatttgctaatagcggattaattaggcttaataaattcattttgcggtttaccggcggaatctataatttgttttattattagactgcatttaatactttaaatatgtgtttgtatatctgatgtgacacaccaaaacttttcacccatggaacaaagggtgtgtttagatccagggtgtaaagttttggcgtgtcacatcaggtatacggacacacatttatagtattaaacgtagtctaataacaaaataaattacagaatccgcctgtaaaccgtgagacgaatttattaagcctaattaatccgtcattagcaaatgtttattgtagcaccacattatcaaatcatggcgtaattaggattaaaagattcgtctcataatttacacgcaatctatgtaattagttatttatttaatactctatatatgtatcaaatatttaatgtgatagggtgtaaaattttatgagggatctaaacatggccctatatggtttttactgtatatttcttccgaaagtgcagtgcagagagcgggtggggggctcagcctcgggttagcttggctacacgcctacgccaccacccctcggaactcggagcccattgcttcctcggccccctccctcggaaggaaggcaggacaccgaggcctctgcaaaagccaacgtgccgagtgccgacgagcccgacacgtccaaacgacaggaggcggcgtgccgcaacacaatgccaccaccgcgccccgcctacttaaccaactgcgggcagcggcgcacatgcccaactgttactgcctccccgttccccagcttcccgcaaggccgcaaacggcgcgccaccccccccccccccacccccgcgcgcgcgtgttgccccgcttgctggcgcctggcgactgtttggtttgctccgttgcctcggctcagctaccctgagacagagagcgcgcgcgagctagttggcggagatcgaccccggtgcccgcgcgccgccgtgtctcggtgagacggtggctggccccgtcgctgccggaaacggctggagaatttaaggtacgcccgccccgcggcccgccgcgaatgcagtgcactctttgctctcgtttttcttgtcatctcgcgtatagctaccagttatacttgtagtcattcagaaagtattcaacgccggttacaattaaatgggagcaaatcgtagtggagttgatgaaatttatataatgcaatttatgtgtttttttagatgatgagaaatatatgtgcttgaatggttgaatgttccatgtaagttgtttagttgcggtcattatcctttttcctcgttttggtttagctgagctagcagggcgtaaatctatcctagcttttgcttctaaaggtgtgatcagtgctgtagctctctcttttaacttcaaaaaaaaaaaaatccgtctggcattgagtcgtcaaattcttttatttttgctgaaaaaaagaggtccggttgtttataatctgcatttggcccttagataggctggccgtacatgggtttgaagtgggactacatgagatgtatgggacaaagcacattgttatgggcctataacacaggttccaaatgttggttgattttatcggctaatgccggttagttaggataaggttaaaatcccaccggttttcctatcctaacaagaaacaagaaacaaactaagagataaatctgttttgtgtgatcggtacaaaatagattcgaattttagattgagataaacccccgagccccaccagtgtcgctatataaagaaagaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaatttccgcataagcagaaggtgatcatgtttaggctaagactcaattaattagttggattaaattccaacattgtggtatcagagcctaatcttagctacttgatccacttgatcccatcatccctgattgaagccactgtgccaatgaagtgatgaaccctaatctgttaagcccggcatgatgccatgattaatctgttaagccccttattctgtttattagttcttaaagttgctttgtgttgagcattatgtcatatttaagttaattagatcgaattagggttcatgcttaagtaaatcatagcttcggctagaaatcagtaagggaaggagaaattcaatcagagagagtttttttttctctcaaattttactaagcggagaacgagtgagataaaccagattgaaactctcattgttcccaactcataaaccctaggttcttatcatataagaacagtggattaagaagtaaattggggaaaacagggtataaactagattgaaattccccactgttaagcaaaagggaataaacaagattgaaatttcccagaatccccaataagccggatccaatcggcctaaaatccccaaatgaggaaccctaatttttgggggaagaaccctaagtcacaaatacccgaattaaatccaaattcaagtcaaaattaggttttgagttcgggttaattaccggatttagaccccctaagcttgccggagctctccggcctcctcagggccgcgccggttgaccgccgtgcgcgcgccgccttggagctcgtctctccaccgtccctcaccggggatgggaagcgtcggcttggcggctgccttcgtgctccgcccccccccccccggcgccgacgaggtccggccgcatagacgcttcccgtcgctagcgcgccgcctcgccggaccgccgacgctgtagcacgcggcttggcgtcgccctcgggcgcgccccccagccagctgaggtggagccgctgcggcgctcgccgccgcacgcgcgtgccgtctcgccggaccgcagtcgcaacatcgccgccgattcgctcactcgctcgccggacgccgaatcgggaagagaaggggacaagaatgagctagggttagggttacacccattcccccctggcacgcgatttcttcggcgcgggcgaaatcttggccgtccgtttgatccgacggccgtcctcgctcccgcgtcgggccgtcgccgttaatgggccgagccgatctgggctgcggccacctcagcgccgcgcaacaataagtggaccggtccgttttgggacggcctcaccaataagagtgggctcttattaattttaatcttaagcccgtgaatttaatgttttatttatttccataaattcatttatgagctttcttagccatttaaaattgctagaaaattatgatcaattatttggtcactcagaaagaaattaatgatatgatattatatttgaccaacattaatatgatttcatgtcaatatttattaagattattatttccttaagccaattaatttatttctagttgaatggaaatttaactagaaagtatttatgatttcatgtcaacatcattatgatagtcatttccttaataacttaattatttatagtcgaatggaaccaacgagaaattcgactagaaagcattaagatctgaagatatatttaacccacgttattataattgcatgtcaattataatttttttccttagttattttctaccaaatggtgatataattaaggaattaattttaagattactcataattatttatgaccaatggtgttttgactatgaaattctaagtttattttgcatatgattgattaagccatagtaaactaattatatgcaattatcaatgcttattatttaagattagttggaataccgagtaaattatttctagataaatggaaccaacgggaagtttatctagaaagaaagatgatttcattaagattgttatttccttaattatttctgcccaacggtgatgtaattaagggaagaaatctaagtattgtcaatcattattttaattttctctgtcattttagccttaatggtgatatgacttagaattttatttatgccattagtgcattaattccttttatcacttctaccttgcggtgatgtgatcgaggatctaatctattagtaagcttaattcctttaccatttctgcccaacggttatatggctaaggattttaattttaattctatggcatcactaatggcgtcatttcctaatcatttctaccgtatggtgatttgatttgggattttaaattatttactttatcacttctaccttttggtgatgtgacttaagacattaatgtttattccctaatcatttctgcccaacggtgacttgattttggattataagtaatttcatttattgattccttcgttttgtctctgcccaatggtgatacaaagcgaaataaagattaagttattgttgtgtaagttagtgtactattgtacgtaatttgcacaagcaaccacaaataatagtgccacttaattttatttatcagttaaagtctatggaattattattattattcctcattgacttaactgagcctaaggcctatttgagtatgacttagcattaacaaaggattccttgtgactcccgcagctaatgtcactaatttttcctaaactcaagaggcatctttagcctgggagaaggccaatataatgctatgtttcgcatgtcactcataaatattgagattatcatccctgttagtgttaaggggagaattttgagcatgacattgcgtctagcaaatgttgagatgaaatttagaagtttgtcaagactaatgcttagtacaaatttagtgcctatgcacatttgccgccataatttaaaggtagcacaagaaataaatcacatggcgtgcaaacttagtgggatggacattgcacatttcaaatgcgccacttgtccatttcatatgattcttctcccattagactacggtcattttcagagttgtaatactaagacaaagtggaccataattgacttggttcatcattctgcaaatcaataagaaatatagaagactaagaggcaaactaagtaagatcctgttaatcttgcatttgatggcaaagatggagcttcactaaggggaagtgttgcaacttccaaatttaatgataataaagctcatattcctcgcaaggggaattcaaattgcctcgatgtcctatgtatgctactcttgaaatattcttgtgtaagctctttgcaagaaatagggacatgcttaatgtcctgatttaatggcattattttgggttgaattattatgagacgttgtcgaaattatggccttattattcggccacatttctaggggagaatggacgtctcattgagatcgagacacttcacccttagaaatttctgacatctattattacttaaatgctaattcactaagtaaaattaagtgattcaagtttatgaaaaataagatagtatgcttccattaaataaataatacaatcagtgggagctcatcaagagctctaataagagaagattattctacctcattaatgactcatagctccattatgtggacgctagaattttgcatctcttaatttgtgacttgcacaattaaatatacataacatgacttgggggttttgttatggaaagacaagtcacatatagggtgcagacttaagaaatccatttgtggacttaatcaaacattgatgatgttttaatttccgctgtgtcattagtgaactaagcttaaataacaatgaggagaatatttattctataatgatggaagtaagacatcattgaaattgtgtcattgtcgcttatgtcacatacctaggggagtttggaacgtctcatgagatagagatattctttctcttagattttaatggcgttgtttagctttaagtgaaaattttatgaagttaagatattagccaacaaatgatttttatggctatgtttacctataagcgacctccgatttcctttaagaaatttaagacactaatgctaaaatcaaatgaagttatgagatcggattatggtggtaaacactaaataaagcttgttcaccttataagacattaaaaataagcgttcatccaaatggttttcgaaccatgtaagagtaaattgagatggatgaacaaaataagacattaaagtgttcatctaaatggttttcgaaccatataagaataattgagattgatgaacaaaataaagaatggttttcgaaccatataagaataattgagattgatgaacaaaataaagaatttagtagaagtttctgaatgagtcaaaatattgggccatttaagtgggttaataaaattaagcctgactctgatggaaatttcgaacaatccaagtgaggtggacagctgcatgaaaattaaaggtgggaatttcattcactggtactctatactaatgaaattttattgtcaagcaatgcatattgctgttagaaactgagaaaatttttccatgaattattttggtctgaaggagtactgggcttatatcagttagtcatacattgacaagaagaaataatttgagagaattcaattaaagttaatcaagctgaaattaagttataaagataatcatttatgattcagctgacagaagcttgagattggctcaaatctggatgcatatagatttggcatatatttttactgggaatcttggcagtatttaattaaatccagactagaccactggtattaagaatgttttgcattattgcaagacaatctgaagtaacatgctcatatttctaaagtccaatgatctcagaagtttagagacatttggacacttattttgtgagatgtttggatatttataaagattattcagattaagctatatccacacataggggagtaataaccatggaaaagctccaaaataatctcttactgcatagtcgacgatgcagttagattttaaagcatgttatgattaatcatatttcccagaactaagagtggtaaatagcgctcataaaccactcaaaaggtgtaaaccactcaattatactgtgtgcaacacaggtttctattctagtagcaacatgttatgtgttttctgcctaacacattgacatagttgtgaaagatatgtcccaggatcgaattattattaagctaagcttttgctcatggatccatactctaaaggctcataaagttaagattaattaagatatgttctggccagtacgtgcataaataagagcctcactaagatcctggatgagggggacttaatttttcaatcaacacccactaagttaagcttgagtttatttgggtactatagttcactataggtcttgttgtctcggtgacgcataatgttgttgaagacacattgccttggggaggtattttatttgataaactcgtcagttagtctcaaaatcaaggggagaatgttggttgattttattggctaatgccggttagttaggataaggttaaaatcccaccggttttcctatcctaacaagaaacaaactaaaagataaatctgttttgtgtgatcggtacaaaatatattcaaattttagattgagataaacccccgagccccaccagtgtcgctatataaagaaagagaaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaatttccgtataagcagaaggtgatcatgtttaggctaagactcaattaattagttggattaaattccaacaccaaaagcttttaaaaggaaaaaaaatcagccttggcccgcctgaatttcacatgatcacatcgtgacttcttgttcaaccaaagaaaaatgcaagaactaacaacagtacgaggttctgttgttggtaaattacaattgcagtcgaaggaaaattatggtgtgttgcacaacctatagtaatatcgatgcaagtgggttggtccatggacactcatattggcctacgctagataatttggcttgcagtttcgcatccaatatgaacaggtcgggtacccatgacgtcatggatacatatccaatatttgcatccctaataacacacgtataatttctgcttaccttttgatagtagtttaatcttctaggtaaattggttggttgtgcatgcaactcaatgaagccaagagaaacttgtgttagcacaaaaaaaaaccccttatgtatagacgttttgtaatttgcctctaaaatcatgagttttatagtgtagagaaatttttagaggcactttaaaaattgtctaaaaacttttactctaaagacactttagaaacattttcaacacattttgttaaattttatctcgtagatgcattatttttgtcactttaaaatgtgtgtgcctgatatgtaaagatattttcttgagacattttaaactctgtagagacacttcttagaatacaaatatatactaatggaataaatataagtacataaggcacaaacacaacaacaatgataggaggttgagttggttagtgcattgaagataacattagtatacctaagagatcttgagttcaatgattggctatagcaaggggaaaaatactctatttttttgcattggttcgatatggttatggtacaatttaataactctggaaaatgtctccaccctcttacatgcataaaaagtgcctttttcacatttgttcttatagccataaaaaagtgcctctttcgcattggttcttatagacataaaaaaagtgtctttcacattggttcttatagacataaaaaagtgtctctttcacattggtgtgcagtttaatatcttaaaaaaatgcctctactctcttaaagacataaaaaaagtgcctctattaaaatgccacaagacatagatacattttataaaatgtggtttgacataaaaaagtgtctctttcacattggtttgatatggttgtggtacaattttgatatctctaaaaaatacctctaccctcttataaacaaaaaaaaaatgcctctattaaaatgccatagtccagattcgtagggtttgttaacgcactcaagctaagtcggcagaatgaggtatctttcgtggcggccaccgtcggctattgaaaggaacaaaccgcacgccaattaagtcagcacgagtttgtcctttcacaaggcccttatctcatggatgtattggcgatatatcccacacaagctaagctgcaagcaaatactccgaaatggacacgcctcctcgcatcctgtctatccatagtgaccggtccttttgaaaactgagctatagtggatatcacttgatttttcttcttttttaaaattatgactttcctttggacactgacacactagagggtgcattcatgttctcatgaaactctatagaaaaaattggcaattactaatatcggcttgaaataacaatgttctaaagttagctggcacatcacctattatctgattgggagtgattaagatgccatttaacctctcctacccgtcatggttcagccaaagcttatgtccaatatttttcttaagaaagaaagactcacagaaacgaagatatgttcaatcgagatataaagctttggccgagtttagttccaaactttttcttcaaattttcaacttttccatcacatcaaaactttcctacacacacaaacttccaacttttccatcacatcattccaatttcaaccaaacttctaattttggcgtgaactaaacacaaccaaactagtgcttttaccatgccttaggtactaccatgccagaatgacaaactagtgcttattgtcgtttgcaaggtgggtgacggtagtgaagcccctcgccgatcacatgtgcatgccaagtcgcctacggaaaccaccacaatcaggggcgaagctacatgcagctatgagggttcctaggcacctgggtaagagaaaagttttagctatggttaccccatctccaccatatatgcacccccctcatcccaacaatgtgtacccccaagcagaccatcaggccgagcaaaggtaacaaggccaacagagaagcgcacagccatgaggattttcttgtggtgcagcatgtttagttgacaaatttgccctgcataacagcgttgttaactacttcaaggtgaaacagaatgcactcggtggccagccacagcctatggtcttatcacctattaatcgtagcaggcaaggggtgacgtcaaaagaaagttttgcaatttgctttcatagtttcattccattttttcgataatttcaaacgaaaaattaagttgttttgtctttttttttccttgagatgctgatgttggacgagtagttctccaattttggccacctattggttgtgattttaatcttaacttcttcaggacactgcgctgataagtatcgtcattgggaattcccattttggcaagtagttttataatttaccgctaagttttcgttcttatatcactcgttcatgttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgctatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtgagatggcatcggagatgagcaagaacgtgaaggtcaccgatgatcaagaggttacatcacaggagcgtgaccaaagtggtggtacaaaagtaggtggggaggaggaaattgctccactggcgcggcagtcgtcaatcctctccctcaccttggaagagctacaaaactccttgtgtgagccaggacgcaactttggttccatgaacatggacgagtttgtggctaacatatggaatgctgaagaattccaggctaccaccggaggttgcaagggtgccatggaggaagccaaggtggtagacagtggaagcggaagcggtgatgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggtacacatgttgctccgaaccttttagtttctatgtatcgttaagacattttgcatggagattgaaatttttatgaataatgctacaggcttatacggtggagctcgaagctgaactgaactatctcaagcaggagaacgctcgtctcaaagaggcagaggtattaaagcaagaaacattatccactcagctttcattgtcattcctaaacagtctcgttccttccttttctgtaacattgaactgataaatatacaatgtctatattatcttccttttacagaagacggttctactgacaaagaagcaaatggtattgtcctctcccatgtggcaatccccattccgcatagtgctcatcgttttgtgaaattattaaatacatatttgttattcatttatttgtgtgtgtatatatgctcatggaaatatgtcgtgttcctgtgatttttcagctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagtatactagtttgtatctgtaagtttgttctcatgtcatatgcgctggaaaaagaaaagctacagtataggcaaaccttggtagtatcgattacggcccaaatttctggccgaataaactggaaaccgaaacaagctgatgatgatttgggctttgcgatggcgaaaagttcggcttctatgatccgatggaaaagttgacgcgaggttacacggtttgctagtttgtgggaattccccgatcctcggttaatctcgccgtgttgccgtcgcttgagcaggagcagggatgcaagcgggacaggcaagcgggtttttttcccgcttatcccacttctagtctatcttttttttaaattttgtactactataaaaaaaataaactagcaagcaggtttttatgcaggtagcgggattacctacttacatccctaagcacgaggttgccagcatcgggcttagcgtctccactcgtgttcgtgttggttcctacctctccaagtctctacaagtctaatactctcaatctcaatgaccaccataacaatagcgtgcatgacgacgggagaataaaaaaatatattgataactagagggtgtggctggacatgcaaagacgaagcggagggacggtggtggtctcattgagaaagagcggtggtggcggtccgtggagcggcaggtagtgattactggtggtccgaagagtttgctatcgacacaatctctaatcaagtttattgtatttttttctctaagtagtgctaatatgtgagccaccaattattataaaaaaatatttcctcagtgtttcttttcccatggcctctgactatgacattatttaaacaagttttatactgagacactttctagtagattttggacagatgtgacacttttatattttggacggatgagacactttctaatagattttagacggataggacatttcagtaggagaaagtgtcatatttgtttaaaattagaacagtggaattactaagccaggtttaaagt

SEQ ID NO: 258 - DNA, 5590 bp, Oryza sativa
gcattttttgaattatctctatttataaataaacattaatttgtgaataaaacttctatacacatgttcttagcgatccaaaagtaaatgctgaaaaataaacttctatgaaaaaaaatcccataatcaagttgaaaattttaatggctgaaaccgcaatgatacaatccgtatattgttatctgagtgagccatcctaaccgtcaacgtgaaactacctctgcctcacactgtcgcacacacaaaaccttagcccacatttaacctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtgggggccactgcgaggagcgtgttcgccatggactgcgttccgctctgggggctggagtccatttgcggccgccgcccggagatggaggacgactatgccgtggtcccgcgatttttcgaccttcctctgtggatggttgccggcgacgcggcagtcgacggcctcgaccgggcctccttccgccttccagcccatttcttcgccgtctacgatggccacggtggcgttcaggttccctttgcttttgtttttgcctcatcacagtcacagcacattaaacgaatccaacacaccgatgataaccttttctccatgctctcatctgttgcaggttgccaattactgcaggaagaggatccacgccgtactgacagaggagctgcgtagagcggaggacgacgcgtgtggctctgacttatctggccttgagtccaagaagctgtgggagaaggcgttcgtggattgcttcagtcgtgttgacgctgaggtgggaggaaatgctgcgtctggagcaccgcctgttgctccagacaccgtggggtcaactgctgtcgtcgcagtcgtttgctcgtcacatgtcatcgtagccaactgcggtgactcgcgtgctgttctctgccggggcaagcagcccctgcccctgtcactagatcataaagtaagccatggactcccattgattccatgtatgagtaattgactcgagtcctgaggataattggatacgaattgccttgttcttcttcgtgcttcagccaaatagggaagacgagtacgcgaggattgaggcgctgggtggcaaggttatccaatggaatggttatcgagttctcggtgttcttgccatgtcgcgatcaatcggtatgcattctcacccttttgacataattgaaccagtgtttgtttgtgcttcattgtttatgcttctccaactttactgatgtgactgtgctgatgatagctgattgggtaattgatgtgtcaaaggaaaagtctcttgactggttcattttgttattttgttctgaattgtgatgatatatggtgctctagggtttgtgacttttctaagtgaaaaatcactggctgattgttgctccctggtgtaatgacattgtacccccaagtttatttacaaataccttgcatcaatgcgattgtttgcaactggtagtgagtttgtacctatggtggcagagagagctcctcggctaattactttgttagtttgttcctagtcatactgttaagtgatttgcgatgctatgattcaggcatatatttctatatttgttagctatgttgccatatgcgatactggtataggcgtttggtgagtatacatgcagttcacaataggaaaatataagagaatatgagagacttagacattgagatcaccttgatggaaaaatattaagagtaatactaaatggcagaatacttcaaagtagtgatttctgtcataccaaacactaggatgagtcactaactacacgacagctgtataagccattgtttgcattcattgtgatcaaggaacagctgtactatatcgaggattgtaaggactgatgtaataatgtgccattgtgcatcaattgagctttggatgttagcttcacaccttcacccatgttgctgcacagcagtcaatcatatttgttaatttactgttgcagtcagatgaggtttcttcccattgaatcttaagggagaaagcctggcccaatatatatcacaagacttgaataactctttcatcagcatttactctgattcgcttttgctgtattgatgcttcaaactagagagagaatcataacatcatgctattcttctgttgtaccccggtttattagttccagtgttcatgtatcctgtcagtttttgttgctcttaacatgttattctgtgactggtaatttgatttcaatgtctttaatatatggcttttgttgatacttcaaagttcaaagtagataaattatgtttgatttattggtgcgcttgccaatacttctggtctgtgcattgatgtatttgcaggggacaaatacctgaagccatatataatcccggtccctgaggtcacagttgtcgctcgtgcaaaagacgatgattgccttattcttgcaagtgatggcctttgggatgtaatgtcgaacgaagaggtctgtgatgctgctcgcaagaggatattactatggcacaagaagaatgcggccaccgcatcaacgtcatcggcccaaataagcggtgattcttcagatccggctgctcaagcagctgccgactacttgtccaagcttgccctacagaaggggagcaaggacaacatcactgtcgttgtaattgacctcaaggcacataggaagttcaagagcaaagcatgacattgcctccatgaacaataacaatagtttataggaagctagaaatgtgggaaatccaagacaatttatttagctgctgcaccggtacaatttgtttagctgctgttcagtactggtgctgctgcagctgcagctgcttctttgccctcgccatttatttctgccgagggatgtactactagtatactgtatttttctacacggtacagactcccaaatctgattcagggtcgaggacataaggtggatctgggaattttggggtctctcaagacaagacagaaaacataacaaaatctgtagatgtaggtaggagtcctaggacagattgggtttctgcctctggcattaatcgtttttgttaaccggtaaagatactgctacttgcaattgctgtttcatatatactcctatatctttcttgtgccttcccttgtgatcaatacctggtgtttctcccttgttcaagacggtcaatgtacttgccgattttggagtacttgaaatacagagaaaataatgtctgaacctgaacttgtacactggtgagctgaagagaaaccggactctagttaactttagtttgcagaagtgtaggagaccaagaccagtgacgaaactaggatctgagtattaggggagtcaacttatcaaatgattatgataaaaaaatagtagtataaaaatatacgaaaatttaaaggtttttcatagataatatatcatatcaatgtaaagaaaatgataatacttaataggtatatgatacagctacaatgtatatatttatttatttcaatcatgagctgcaattaggagtccaatcacctcaagttagcatgtaagtttttagagagatatcttatacgattgctcatgcatttccaaaaaacgaacttaaaacctgactcaaatacatatctgtatttccaaaaacgaacaaacttaaaaaccgactcatacacggatacacggatgacgtaccaaagtaccggaaaaaacatcttcaatttttataatagtagatattttaaagagtaaattgcagtttgggtcatgtatttttacccttgttgcagcttggacaaggtcttagccatgatttccactttgcaccacataaccttgccatttgtttcactctgcaccacccctcatcttctccgagtcaggcagccttattatctctctcccaacctgttcttgttatgctatcaccgatcaggaggaggtagaagtacgacagttttccaaactccaatcaccctatccaatctggagggaagagtagcaaatcatcacaggttcagcaccggtacaggtgctcaagctgagatgaagtgcatggtgataatgctgaagtcattgctggtgcctgagctcgagcgtgggagcagtactacaacacttcgtcagggactagaataggca

SEQ ID NO: 259 - DNA, 14265 bp, Oryza sativa
ttttttgatattcactcctgtagttaaaattagctttttttacagcattactactccctacattccaaatataaggtattttgattatatgcgacacatactagtgcaacgtatctagatagacttgtgtctagattcattgtactaatctggacagactccctctccagatttgttgtactagattgtgtctcattcgtccaaaatcacttatattttaggacggagagaatactcacttggaatgtgccattgccaccatagcataccatgtttaaaacaatgaaaaataatacaattgtcataagaaatttctgaatttcgcgactcgtccactttatgccaaaagaaacactacccaactttggcaattgcaaaagtcgggcaagaaaggtttgctagcagttttttgataaagttactataaaccttgggttgagttttggaaaaatattagcttgccaaatttttcacaacaaatcaaataaatctataaacaccaataatagtttatcaccatccaccaccaatatcacgaaagtagatggacaatttatagggagatgtacaaatacatatttagaagtaattatatgcaacttgacctacaaataagaaatgatgccaaatattggtcacaatgagaatactcgggactctatagatagtggaattctatagttttttttaatgactcgcaatagacaactcgaagtcatatcgatagagcagaaaaaaattactgattatgtttaaattttgttgcaattaaaatatttcagcttgtttggcccactaaccagtgagcagcagtggcacatcccaacaaagaacacctggcctgtacctggcactggccgcgtgtaatttcccaaaataccttttacgcaaaatccaaaaatcttttttgtgccttctacgaattcctcgtttcccttttttttcgcttggtaaccgatctccgtgtcaaaaaagaaaaaaaaaacaggccttctcctcccccccaaaagcaacacagggcattcgctcctctcctccgcggccagactgcctctctctctctctctctctccccacctctccgcaagtgaagcggcggccgcgcgccgcgcgtggtgagctcttctagggttttctcgtcgccgggtcggtgtcatctctcctgcgagctaccgcggcggacatggagtccgcgtcgtcttcactagcgaccagcgggcggcgccgcagcagcagcggcggcggcggcggtagctggggcagcatcggctccgccgccgacccgttcgacatcccggctaagggtgctcccgtcgagagtctcaaaaaatggcgggtaagccgcacccgccggctctcagctgtagttgttgttttttttttcagctagattttgatgttatgcttgcgcagctccggtgatgttggtagtggatactggtggttttttttttttcgcagatttggcttcgcgatgagcggttttggagcagtttagggctcgtttgtattttttttttagcgaaacccagtttagtttctctgaaccggttgaattttggttgagaatttgaaccgccgaggcggctgcttgtcttcgaatacaggtgtctacgctacgcgcaaggctgtcattgttcgcctccgatttttcgtgtttagacgaatgttaaatttgtccgtggtttaaattcgaacgtctcgctgggtcggtcattttttttcccggaaaatatggagtaattatttaaggaagacttggtgagtgagatatcatgtgcatgtgatctggcttcccgtgattttgtctcgactctcgacatttgagcggagattgcatcggtggacggttcagtgtttctcctttttaatgttttttttttacttttctcccttttaacgctttcacttcagattagatttgggagtttctagcttcactatcgttttgatgagatattaccccataattttcgacgaattcgttcatatacctcgtgtgaaaatttcactgttctgagtgcgcgacccatcaagctagttgcattttttcttcgcatcgtcgatccgatttcccgtgggacccctgatgagtgcaaaagcaaccaacacatctgttcagatttgattctgaacacacacctttccagtaacggactatgccgtcagatttgttcaacacgaatttgttcgggctttcacttgctttgttcaacacgaatacttttgtattgttctctgctttttaagcgcctggactttcgttaaatttggatcgcttctcttgagcttttccacctgtgggcgctttaacatttcctaagatggatatggtttagctctttctttgtgatgagaatgttctagggcgccacgcggctaatcgtagcaaagttgagctggtagtatgttgctactctgtagcctacgcctgtgctttccgtcctaaaaaactaacccaactagtctaatcggtgggccaattgtttatagatcacaactgtgtatgtactttgttaagttactccaggactccaaataccctcataaggacgaaacaatcgttattattctttaatgattcctccatattttctgtgtcctcttttaataactataactgggccctgttgcatctcattcacgatatttaatagaggtggtggaattagctggaagcctggagcgctggacatgtttgaaacaaatgaatgtagctggactcgcccctgttgtgtaccagctttgagcctcatgcacacaagttgttgcttcgcaattgggttttccgggtgattttgttttgtttctttatccaacatcaaatattagtttgccgatcttttgacatctgtgcattctgtactaaagattgtattgctggcataatctttgtatttgcatatcgggctgggtgtcgtatccaaggttctgaataccggtccctcgggaaattagtaagcggctatttagcacagatgttttagctggtatatgaattcagaattttggactcaaaacttttgcattgctgctatgtaaaatttcatagctccggcatatgtaatacaataatttacctaaacatgaatttgcgaaaaaacagtagttaaaatttcaatttcaagttcagattatatttagtttgtttttggcagtatgtcttgtactggctgctgcttcaggggtcgacgcagggatttgcatacctgagtgtatctatctcttcagaaaacatgtcaagataattatattcatgtccataaaatgttatgctttcgtgcaaataagagagatgtgtgctttgctggtcaccataagctgctggatcttttctctgcagagcatcattttaattgtttcttcaatcaagttttacgcttactgactggtatttggtattttgtatctaattgtccacccttctttctattgcagcaagcagctctagtactcaatgcatccaggcgctttagatacacattggacttgaaaagggaggaacaaagggaggaagttataagcaaaattcgtgcacaagctcatgttgtcagggtgaatatcattacttttttttgtttttttttcccttagtttcagctgatgtcttgatttccttcttcaggctgcattccgctttaaagaagcaggacaagtccacgttcagcaaaaggaggtggcaggtgttatttctatttctacatattcaatatttggttcagagttttcatgttctgcacgataatatatcagagtttcgtgtaacttgttaaactttattttcttgtcactatggttgcctgtggtttgcaatggtcatatattctagaagtgggacatctatgaatgctttactggagcgcagttgctatatgatagcgataagaatttagagtacatccatggaagggttgtatgttttgttctcgctgttactcaatgtttgctacaatattgactttgcagcaccgccagttgatggtgcactgggctttggtatcaaagaagaccaacttactgcattgaccagagatcacaattactctgctctacaacagtatggaggggtgagtatttcttgtgccattgtccttacatgtatgtgcaaaacagtttacaccttgtgacttcgtccacagatttctggggtagcgcgcatgctaaagacagacacagagaaggggattagtggagatgattcagatttgactgcaagacgaaatgcatttggatcgaatacataccctcgtaagaaaggaagaagcttcctggtatgctgactgctgagaattctttaatatttgtatagcattttttccctttttgatgctcattattggtgtactgacacttttgtttaggctttcttatgggatgcttgtaaagatttgacacttatcattctcatggttgctgcagcagtatcacttgctttgggcataacaacagaggtaggatttcattactcaattctttgcttcctgaattgaccaaatatcatctcttactgtctcactgacttgtttgccccctattgttattattatttgcctggtgtcattaaccactaaatttagtccagtttcatccagcatttgtatatttgcaagtctagctgccatcctgtttcttttccctttgatgtttgcttggccatttgccacttactgtttatcgctgtttttttttttggtttgtagctataactttcattatttttggagttaattaactccttttttgtgtgtaggggataaaagaaggctggtatgatggagcaagcattgcttttgctgttctcctagttgttgttgttacaggtatgtaattagttagatcaatcatcttacctgattatttctatggtcgattaatatgttaatccacttttagaaggtttatctgttgcattactgtcagtaatgtctcacctactggcataaagtagggaatgctaaaccgttgatggtatggactaattacacaatatgtgtagtgctttggacttgtccagccaactcaaataaatgtgtcctgaaactttttgtagttatctgcgatctattgaaatctatttgcttctaacgtttgccatttgtttcagcaactagcgattacaagcaatccttacagtttcaaaatcttaatgaggaaaagcagaacatcaaattggaggttgttaaattccagatacttttaatcagtacttcttttgtttcttaattcacacctgacaatttttctttcaggtggttagaggtggaaggcgaatctcggtatccatttatgatttggttgctggtgatgttgtgccacttaaaattggtgaccaggtgcatagtctatcgagcttgtcatttgaaccatttgtttgccaatataaattgtggataattataatttgtttgccaggtccccgctgatgggatccttatcagtggtcactccctgtccgtagatgaatccagcatgaccggagagagtaaaattgtgagttccttggttaatttggaactaatatggtttaggtgttaagctcacactgcaaagttttggttaattgaaggttcacaaagatcagaaatcaccattcctaatgtctggttgtaaagttgctgacgggtatggcactatgctggtgagttttctgtttactgtctgcgtactcaatgcctcaatggaggggatgcacagctactttcaccttctaaatatatgtacattatgaagtagtaaaattgtagtagcatcaacattgattactgatgagttacatggttttacaatttgatctatctcaaatatgcataaattcttaaatgctcaggtgaccgcagttggcattaacactgaatggggactgctaatggcaagcatttctgaagattctggtgaagaaacacctttgcaggtttgattttttaacttgttgacttttgcacgagttcatgagttgacatgaatttattgttctggagtaggttcgcttgaacggtgttgccaccttcattggaatggttggactttctgttgctctcgccgttcttgttgtccttctggccaggtagagtttgcttatatttgttttaacaaaatgtctatttatttatatgtgtcgctttgttttcctgtaggtacttcactgggcatacctataaccctgatgggtcagtgcaatatgtgaaaggaaaaatgggtgtaggccagacaatacgaggaatagtaggaatatttacagtggcggtaggtgtagactctattgtacatgtctgatgctttggtgtttccattttctgttatcttaccaacttgagatgtaactaggtaacaattgttgtcgtggctgttcctgaagggttaccattggccgtcacgttgacgtaagtgtgatttgataatgtattttactttgcacccttatcagcaacctaatacctgtacttatctgtgtcaggcttgccttctctatgcgcaagatgatgagggacaaagctctggtatgctcgcttgttggtattgtgcttgcttgttattcctgcaaaatgcattctcttgagtgggttaatgcttataggtcaggaggctctctgcatgtgaaactatgggttcagccacaacaatttgcagcgacaagacaggaacgctgactttgaatcaggttgggtgctgttgtcatattctcaatgttgtgcacttcggtggatacaaagatgatccatgattccagaaatttgctcagccacgacttattccctatttcttgtcaattttaagatgactgttgtggaggcttactttggtggaaagaaaatggatcctccagataatgttcaggtgttatctgcttcaatctcatcattgattgtcgaaggaattgctcagaatacgtctggaagcatatttgagcccgaggttacacttatacttttatagcacttctgcatttgtttgtctgtgcatcttgttgcattccatttgcccctcttgctctaattcctgttggtgttcacccgatcatcccaactttgtggttatgtaacaagaaccttttactgtccatgagaccaaacacttgttttctgtcatgttctcgattaaattggtgactagtggcttaaattcaattacctctgcagaatggtcaagatccagaggtgactggatcaccgaccgaaaaggctatactgtcttgggggctgaaggtacacatacaatcctattttagtagctgaatcacagattctagattttttgtatgccttctgtttggtgaccatgctcttcatatttccacagcttggcatgagattcaatgacacaagaacaaagtcctctattcttcatgttttcccattcaactcagagaaaaaaagaggcggggttgcagtgcatctggtaattcataatatctgcaactttgacagaccccttcccctattttttttcttattgtgtatggtacattaccatgtaaaatggcatgcctagtcaactattggcatgcctagtcaactattgacaattatgttgtcctagttagttaaattgttgacattttggaaacagttccctttttgcagcatactttcttatccacattttcatgtttgttttacctagtatatatctgtcaagtttatatatctaattattacctggaattacgcctaagcatttgcattcttgcattgaaggctcgaaaaaatttcacagaagtttgaccataagcagatataaatgttctgttagcttgtcagtatgttttgtttgattcactccattacttttctctgttcatttcaagatttattaatgctcttctttatatttctggagggtggctctgagtctgaggtacacatacactggaagggagctgcagaaattattttggattcatgcaaaagctggcttgctgcagatggttcaaagcattcaatgacacctgagaaagtaaatatccattcaatcttttgtaattcacttattttcatattatggttttgttggtgacaattagttgcttcagattagtgaattcaagaaattcatagaagatatggctgcttcgagcctccggtgtgttgcctttgcttatagaacatatgagatggttgatgtcccaagtgaggaccggagggctgattggatattgcctgaagatgacttgattatgcttggcatagttgggataaaggttagttgcgaatgtacattttactctgcagttgaagtaattattttggtagttgtgccttccatttctcctgcacgagctgtattgcaattcctcgtatactcactgcataactctgattagatgtgccgtttctttgtctcctatgactgcatgcttcatggtttttctgttccctgtagccaatttgtcaaataatacactgtcggtattgggttggatagttactagtagtcagagctcacaagtacaggtgcaaacggcaaccatgaaccctttgaaaaagtgctacaccacgaccactgtagaagttttacttgttctggcagcaccatactgtgatactactctgtaattactaactgcatttatgattgccatcttgttttctgattgaatacacgggatggattacaactagctgtagggagttaagtttccagacatgcgcttttatgccaaacagtcactgaccagagtcctgggaaacagcacaacaggcagctgacccaagagataaaccatgaaacactactgatggctcaacatgaagcacttgagtaatctgcttgaggtttcagagaatttgtgtttgcagctgtcacacacacacacacagccgtctacctaactcaatcttgtactggataatgacaatctgttaataacagatctttcagactactttagcatgctaccaattgtgccatgtgctggaaactagcaaaacttgtagaactgctataatttggaagtacttgctgattggtttgtttgattgcttcacaggatccttgccgcccgggtgttaaagattctgttcggttatgtgcagcagctggcattaaggtaatgttgcgttgtggtaatcctgctctgtgagtcagtggtaatattactttctgctatctcttagtaactaaaacgtagaagagatgtgttacttaacttcgcttcttcaggggatgttagctataaatctgataagttacattcaatttctttttggattgttaggtccgcatggttactggagacaaccttcaaactgccagagccattgccttggagtgtggaattttatctgatcccaatgtgtcagagccagtcattattgaaggaaaggcttttcgtgcactgtcagatttagaaagggaagaagctgcagaaaagatttcggtatgactgtttttcctacatttctgtaccctccactgttaacaccgtatttttaaactgctgcaagcatataatgtagtagtagccacaaaataccctgaaatgttgctctatcaacacccaactttctgataactggtaagctattgtctcttgctaacctttctcattttccatgatcatggacaatgaatttggaaggagatgtatgacatggcaaacaagaaaagttgccatgagtaatgcggatgatttgcatgagctgtgtcgaataaaggacacatttctaatttgcctgcgttgataataaatagtgggttgaggaactgaacctagtttagttggttgatgttgtggtgtatgtttagaccacccaagttcgaaacctcctaggttgatcccatttttttaaataaacagcgggttgtgtgtattgtttacaatgtagcagcttctttttttctaaaggtaatccataggagaggcttctcctatacatttacagacgagtagaaacaatatgtacaaagattatgcacagaccttggttcattttggaaaaaagttggcacatgttcacatgcaggctaaggctcttgataacgtaacattagaccctcctggtcctgtattggaactttttgacttgtatcattgtctttctgaggaataaacatatgcaatcaccttatccaactaattataacataactctccaaatcatattgaactattaatttgttggagagtatgtttattgtgttatgcttgtgcatacatcaatagtctgttatcttgaatagatgcattcaagtgcctagtttataccaggtcggtttttgttcagtatatgttgtctatcttcacctcgacaattaaatataccctatgtaaatggttacaggtgatggggaggtcttcaccaaatgacaagcttttacttgttaaagcattaagaaaaagaggtcatgttgttgctgtgactggagatggcacaaatgatgccccagctttgcatgaggtttatctctcgactaatgttccatcatgttttgaaagaaacaatcttcatgttcaacaaccataatccagtctttcttatgcaatgctgaacttaataggcagatataggtctctccatgggcatccagggaactgaagttgccaaggagagttctgatattatcatcttggatgacaattttgcatcggtcgtgagggtatgtacactgtgttctgttattggccttccatgactgcaacttatagtattcttttctctcgcttttaggttgtcagatggggtcgctcggtttatgcaaacattcagaaatttatacagtttcagttaaccgtcaacgttgcagccttgattattaacgttgttgctgctgtcagttctgggaatgttcccctgaacgctgttcaggtttgagctcatactctgtttgttactgatagataacacggaagttatggttaatattctctctcttttgcttgggcttgttggctggcagctactgtgggttaacctaatcatggatactctgggtgctcttgcactggcgacagaaccacctactgaccatcttatgcagagaccaccagttggcagaaggtttgttctctgtgttcttgctggacaactgtcttgcttggtttctggagataatttttttgagatttcatttaaaggaacaggacccgatcgaaatgaataatgagctcttggcctaatgtcctgaactaatttacacagacaactgtttaatctcatgtagaccaggaaatatgagatatttataaaggctgtttgatcatgattttatgtcgttatcatactcagttgatctaatataatctgtataatcatgtctatttcatactacctccgttattgaatagatggtgctgttgacttttaggtagtactgtactgttagctgtgtgatactttatatgtccatttgtgccaggaattgctaatacctttcaatgtgcaattcaaacagagttttttgtttctgcatgctgaagctgtcctaaccttgttaccttgttttcagggaacccttgataacaaatgtcatgtggagaaacttaatcataatggtatggtactgttgtgtattccaatttgaatttaaatatctcaaacgctttcaattgaccatctgttcttccttcaggctctgtttcaagttatagtcctccttactctcaactttaggggcacaagccttttgcagctaaaaaacgacaaccaggcacatgcagacaaagtcaaaaataccttcatattcaatacatttgttctctgtcaggtgagttaccactgttttactatttctcttttaaccacccccctcccccgccccccagtttcctcatgtagcttacatccatttatatcaatgaaatggtctaccttctcacgtaaaaaaaaaacataatactttcatcctcaggtgttcaatgaattcaatgctaggaagcccgatgagctgaacatattcaagggcattactgggaaccatctctttatggccattgttgccataacagttgtactgcaggtagaaaacccaccgtaataattcctccttactatatctgttactgggccctatagctgtttatatggagctgaattgatctagatctgttattggcttcacatctgttaatgtgcaggcgcttattgttgagttccttggcaagtttacatcgacaaccagactcacctggcagttgtggttggtgtcaataggtctcgccttttttaggtaagctctctcgctcgtgtgaaagaaaaggcagatcttggtatagttgtaacatctgccttctggaagtatgaaaatcgtgttgtctcaactatttttctcagatttgttctcatagagtgttgaactgtacttcactacctggttgatctcctttatgcagctggccgttggcatttgtgggaaagcttatccctgtcccagagagaccattaggagatttctttgcatgttgctgcccaggaagtaaacaaggtaagcaactgcattagtgcatttctgtatttatgtttgacactaaaacatagtgcactttcttgcggaggcacagtaccgaagtgaaattttacagtagtaattgttgctagtagaacttcaaatcttaaaaaaaaaattaggacaaccaagaaggcgcttggctatcaaataattataagaaattgtgagcgtgttgagaattaaatataaaaccttggagttgaaatcacatcccttgcccacgcactatcacgggcatctcaatagaacttcaaatctaactgttggtttccgaggtttctgtctaggtgttctattttgaccacttttaatatcctcctgttccacatccgtcacacgtgactccatttggtgcagctgctgatgccaagggtgatgacgctgatcacagcgatgtatgaagctacggatcagagggaaacttgtgccaaggtttacttttaacatcattaaggtgtaattaactgctatcaggattgtacatacactatgcttcacatggataggtctgattacctttggaaaattgtggcactattaaccatgcgttcagatacttgacggggcaaggtgtgattttgcggcagagctgctgcagggagatttctaatggcgttttattagcgtattggagaaaagattttggatacttatttgagcttacttcactttaacgttgctccagttttacttcttggagttagagcctatgcagatatatagtagttcgcagttttatgtggacaacggagcgagaagaaatctccgtatctgagtgcgttgttcctttctgtggtgatttcagaagcttccatgttacagtattaatggcagtcgctctagtctctactccctccgtccctctaaaaaaaaagacaaaccgcgggtttgcgtgccaatgtttgactgtccgtcttatataaatttttcttataattagtattttcattgttgttagatgataaaatatgatgaatactttatgcgtgacttttatcttttcaatttttttcataatttttttaaataagacgtcaaacattggacacggtaaccagggtttgtctttttttttttttttttggaacggagggagcagtgatttatttcgtttggcagcatgtgctgtaatgcttatttggatgccttcatttcatacgtatctgcctgttgcgacctatcggggccatatgcgtctgaaaattcgtttcgactgcagccttgcaggtgcgtccagcaacctggcgcatttcagatggtttgggatttttcttctgttttctgttggaagcgggtcctctggccgcttgttgcactttcgttgctgcttttctttggtcatttactatcgtgtaggagcatgtcgaatctctagccacctgttgttgagacgttaaaagaggagcagctgacacttccagaacgtaatgtcaggtttttcgtagccaaagctggaccttctagtcttccacgacgctggttaatcttgtccgatgtgacgatggagcatgctttgccgtgcatgatgagcgcggcctcgctaaaaatttcacctctgatatgtgatgacacgtttggcctttaaaacccgcacggtcagtttcatccttgacgttccgtgaagggatctcctatctctgctactgacggcactccgtcgtgatatttctatcctactagtaccacttttaagtcgtccagcgtttcaaacacctggaaaaaaaaagtctgcgtccgtacgtgctacgtgcaagcgtattcttcatttctcacaactctaaataacagcagacagcagcgttaagatctacaggtcctatg

SEQ ID NO: 260 - DNA, 5914 bp, Oryza sativa
aggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctccagtggcatcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggcggccgccgccgcgcccgcgccggagaatgccttcgccgccgccccgaagatgccgccgttcgactacacgccgccgccgtacgacgggccgcgggcggaggagatctcccggaagcgggccgagttcctcagcccctccctcttccacttctacgaccgccctgtacgttacgccacgatcttttcaccgctcccatttctttggaacgatttggggggaaaacactgtagtattacagatcggattcttgattgtttataccttaaattagaaagaaatactgcaattttgtctctataacaagacgcatttttccattttacatccaaatgctgccacaaatgcatcggcgttcggcgatgttcagagatgatcaggctcgtagcttaaacaaatctccttaatttgtttgcaaaggctgttgttttctctgtttttttatgatctcttgctggtggcttattagtgtatcttgttacaagaaaaggcagcccttttggaagtgcaacgtctttttctgtcgctattggataggtttggttggaatgccattttacctgttcttacttcttactctgagcatttcttacttcttaccgtttggagtgggcttaccgccacccgcggtttggcagttatcgcgattatcacaaggtatcccgtggttttaaaaactgaaaagattaccgtatactgtttggtaaacctcacaagatgctctgcagaatctccaagatagtcgtactactaattgtagtatggggaattgtgaatctagtacaaaaatgtagttgtcttttctctttcccataacatagatgttctgttctgcttagtaaaaacgtcagcctctatgttcttgtctgcaaatatgcatagttaagaagaaataatttttttttatcttgtgaatagtagtaggtcagtttgctcaactacgtcttgtgctagtagtctgctagatctcaaacatatgtggctgcgccaataacatatgcatatgtctctctctaaaatagcttcataactgacacctttccattttaaaattgcacatgcattgccaagtactctataaacaatgttaaagattggattcctgaaggaggatatagcaccaaccaaactgtgcacctaacattgtgtcttgctgactcctctcatcactggagatcatgcacattgctaaactcctcgtgaaccatctgaaaaatactttttgacagggacgtttatctggttgataaaattggtaggaagaaaaagaaaacaacaatagctctttgagatcaccttgaattctttagaagagggttattaaaaattttctaaaaagggaaaattctcgttctaaaacatatcaatatgtgataaagatatggtttttggagatttcaagttccaaaaactgaccatttagtatgtaacaaacatttcagttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggtagcttgagaaaactggactttctctatccgaatattgctaattgtttagaaatacatgaagattgttttgcctgttgaaagctttacctgaatctgttcctttcttttcaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcaggcaagtgttggtcctgttttcgcttacagcattaggtattgagtaaacacgcaggacttaaaactgcgacttttgttgtttcaaaaaaaaaaaaactgcgactattacatgtaaatcattgaaactaatgattattcatttataatttgttcagacgggagtgcaccatgcacttaatccagacccatatagaggtgctttcggttctgatggcgaaaagtatgcccgagatgttcaggaaatcattgattttggaactacaggaagggtcggtggtttcatttcggaagccatacaggtacatatatcaatctcaatgcattatcatacaatggccatcttatttgtcatttcgatcaacagtgatttcttatcattctgaaaacgagttctttttcctcctccagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaaggtgaatcttgaggatccttccataacattcagagtttcagactcaattcatccctcctttgacgaatacaatctttgggaaactcacatgttccttctcttcatcttcagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacagtgagtatcagtaactaagataaaatcagtaaaatcacgttgcaaccacatggatccagggtagatttgttccttacattttggcttgtatggatggattttccagtcattggtgatgttagagggaaaggcttccttcttggggttgagctggtgaccgatcgccagaagaagacaccggccaaagttgagatcggtcatgtcatgaaccacatgaaaggtactactgatcctctcagcctcttccagttttgttactgaaagatctcaccatgagtgatttctgaactttcttctttgacacagacatgggtgtgctggttgggaaaggtggtttctacgggaacgtgttcagagtaacacctccactatgcttcaccaaagaggactccggtaagacctgctactctgctgctgataaattgtcaatacatgtttcagtaatttctgatccatgactgtaacatggtttgatgaacaacgtatcttgctgcatgcagatttcttcattgaggcgatggacatttcactatcgaagctgtgagtcggagagggactggcaggatcaacctgtccgcatgtgatccgtatccataaataatgttggggattggtgagatagcacctcgttgtctcgtaatatgtcctgcaaacccaccatgcgctgctcaacacatggtccaataggcgctcctccggtctctaatcagatgtgttgtgactcgtgaccaataagcgcatgtcaatgtcagatgtattgttatagttattgtttacatgctgaacgacaaaacgaaccaatcacaatgcccaggcgatgtaaatgttgaaacaattatattggcaaatgtcagtgatttcgcaatgatgttgtgcaaaagttgtttcagcttggcaatatatgagagaatgtctgcacatcagctgaatattatatacacatacttcacaaaccaaagcggtgaagttaaacgagcaagaagccaccctcggatgaatgtcatcgatcatttacaagcaatgatgctctactcttttaaaatacaagcggcaaccacgaaattaacaaatgtaaccaacgcgaaaccttaacagatatacaacagcaaatatagacacgtgtggaacaaccgtagtagctagcttggaactctagaactatttcttcccacccagcaaaggttggccactgccatttggactaggcatgctcgccgttctactcatcttgcctccaccataactcttcacatcaatcaaatcaccaaacaaattgtctggcatgtagtatggtttggccgcagccgctgtagtttctgatggccgtggattaccattcattctaacatcttgagccattgccggaccacttcttgtttgagaaacaaaggagttgtactgttgcatcggtttggttgcaggagatggcacttgttgccttggcggagcagcatacggcgatgaaggagctggataggtatttgtgggggcaacagaagcaacaggagggttctgcatctggtatgttgcaggctgaaaaggattggttgagttgacacttgctggcatcgcccatggtggtgctgggtagctagatccatattgttgcatgggctgagtttgatatgctcctccagcctgtgtgccctgtccagcttgggcccaaggtacaacataattgttgtatggggtgtaagcttgattcgttggatatgcctgctggttagaagagtaatgtgatccatttgatgcagcaggctgatagtttggtggtaattctggcccatttgacgtgacagactgctgcgtgccattttgggtctgtgaagaagaatctgtagatgcttcaggggggctgtacagggtgaggcttagaaggtcgatcatgtcctgctctctt

SEQ ID NO: 261 - DNA, 4298 bp, Oryza sativa
atcagacagcctaaacagcaaaacgttttccgactttctgtggtggccatccattgacggccgggcagggcaggcaatagttttggtgaagatgtgaagctgctaaggatgttaggattgttgcgtccttgcgtgcacattgctttaattcctagtaagaacggttacgcgtgtaaccctgtatgatccgtcaatagtaagttaggagcgctaagcaacggcgtataagtataaccatcggcctaaacaagctagtgtcccaatcacattgttacaaccagccctaatacagcatgatttaatttaatctccgtgctgccacccccaatccaagtattctatcgccaccaccaaatgcactatgaaaagcgcacacatggttgttcttggaatagggatgaaaacggatcggatacggttggaaactaactttatcatattcattatcatattttttttctcggaatcgaaatcggaatcggaaacccggatacgaaaacggaatcgaatattatcaaatacagatacggagcgaatacgaatcgaaacgaatacggtaacgaatattaatcggaacataaaagccccttaaactgaccttcacaaatcaacgaagaaatataacttcttgtttttttctaatatagcatgttatatttgtaaagatcaacaattaataataccataacgagaaacatccacaaacttgcacatcccgacaaagtcacactgtcacacgtattaccggttacaaacttgcaaatgatgacagtcacacgcattaacgccttggacggtcttaaccaccacctaatccacttaaggtagctaaattattcgtcatcaagaccttcctattgatgccatcaccgcgtccagttgcccaacatgtggcgtctcaggcacggacacgtactgaagtctcgggtcccaccttgccaacctctcccccgtgatcgtgtctttccataccctgcgcgacgcgacgcgacgctgtcgccaccgtcaccgaccgcgcgcgcacgcacgcacactccgtgtccaaactttcctcgaactcctccccgccgcataaatccccttcgcctccccgccgcgccccgcggcgtcgcacgatctcactgaggcataaagtgagagaccgtgattggatcgatcaccggagcgacgatcaatggcgacgctcaccgtgcccgccgccgtgccgcccgtcgccgaggactgcgagcagctgcgcaaggcgttcaaaggtcaggcgcgcgctccgccgtcctcgccttaatcctccgccggccggcgcgaggccggaccgggtgctgacgcgatctgctttactggtggtcccgcagggtggggcacgaacgagaagctcatcatctccatcctcgcccaccgcgacgcggcgcagcgccgggcgatccgccgcgcctacgccgaggcgtacggcgaggagctgctccgcgccctcaacgacgagatccacggcaaattcgaggtccccgatctagcttgtgcggattaatcggctcccccctttagctccgtcgctatctgtctgatttgattcgtgtgggggttgggattttgtcagagggcggtgatccagtggacgctggacccggcggagcgggacgcggtgctggcgaacgaggaggcgaggaagtggcacccggggggccgcgcgctcgtcgagatcgcgtgcacgcgcactccatcgcagctcttcgctgcgaagcaggcgtaccacgagcgcttcaagaggtcgctcgaggaggacgtcgcggcgcacatcaccggcgactaccgtaaggtgatgatcctgaatctatcatctaccacggagttcttgaaattttgatagatcgatatctctgtcataatcacagaaaccatgaattttacacttgctgctatgcttctcagggatatacgagatgtttatcatgacaatagacttatgcgagatgtttacttcttgatctccttgttctcatgattagtatgtagtgtatagtggataactcaatattgaagatgaattgttttgctaaggatctaaatcatctcttcaatttaactctagtatactgcaattccactttttttatttgtattttgtgtgggcattgataaatggtaacgtagttcttagatgatcatatctgagaagataatgcagttactagctgtgtgagatgatatcacttcagttaccctggtctgtatactagaatgtgaccatctcctcagtttacgttgactggaccattttattattgtgctttaaaatttgtgacatactactaaattgcatacgtcaatgctaaaaaaagaacacccttgttaccaaaatgaattatttttatttctttcttgcagcttttggtgccacttgtgactgtatatcgctatgatgggccagaggtgaacacatcgttggcacattctgaagccaaaatactccatgagaagatccatgacaaggcttacagtgacgatgaaatcatcaggattctcaccacaaggagcaaagcacagttactagcaacattcaatagttacaatgatcagttcggccatccaatcactaaggtaataatagcattgataaccgttttttttcccgttgaaaaacattttacttaccattccttgtccaatcactaagctgaatgataacatgcattgtattgaaatgtttcattcagtaacatgccattgtttgcactgaacatggtattttaggaactgaaattattacacattgctagtggtccataatgtcgtttgccgacctgtccttgtctgaaactcttctaacacattctggcacactgacaggatcttaaagctgatcctaaggacgagttccttggtacactaagggcgatcataagatgcttcacttgccctgacagatactttgagaaagtcattcgattggctctaggaggaatgggcacagacgagaactctcttacaaggatcataacaactcgtgccgaggtagacctgaagctgataaaggaggcctaccagaagagaaacagtgtcccattggagcgagctgttgctaaagatacaaccagagactacgaggatatactccttgccctccttggagcagagtgaggtgtatatctgctccatctcgtctgtctgatcctccttgtttgatcggaaaataagatctgcatagaactgtgttctattttgttgtttctgaatgatacaagtgagctagtctgcatagcagtgctcatataataaaatctgtcctgcatactggtttgtcatctgagctgcttcagatactattggagtattggttcattatcaagcgttattgttgcgtggggaattcaggtagttttcaaaaaaaaaaaaccccagttacatcgttcgggaatagggtttttaaaaaaaaagcccagttacatcgttcgggaatagggtgccatgagttagcagaggatggttacagacataggagaccatagaatcgtggaaacttaattgttcttaaggctaaacatgttttgtcggatactcccatgagaatctcatggtatattcaactcaatactatggcacttttgcggcgtagattggatcggctgtcaattttcacgagtgaccaagacttgtcacagtgtagtaacttgctacgcatggctcttacatggttcgtgtgtatcaggacttgacttcaggagattatcagaaggtggcaacctgcagtagtgagtacatgacagttgttacttgtacgctgaaacctcttccacgaacttatcaggctcttgtactcttcctgtttacagtacatgaattaatttctttgagcatgtcagcggcgatcttttaccttccgtttttcgtatgtccgcgcaatgttgtcactcgtgacggtgtatactggtgcttgtatgccattaggccggctcatgtcaacaaccgattaagacagacaatattaacagacaggtcaattccaagaagtagttgaacatctgacagctttttttttctctctgaaagaagaacatccgacagaattgctagactaatttcaaccaatcttgtaagtaacgaagtccaaaaaagccaaccaagaattgagattacatgagtgtattaacgcatatttctgcaaatttgggaaagcttgagtacaaacgccatcatttttttcaaggatgttataacacactaaccttaagagatgcatgcgcagaaagaaagtactgtactgccaattaccaaacctttactacagtattgtattggcttccatt

SEQ ID NO: 262 - DNA, 4677 bp, Oryza sativa
aaaataaatttgagctcccgtgttaaacttagaacttaaaccgacgaggggatgtccccttagaatccacgcccacgctacgcttgatatttccttttgtgtccattatgcgcatacaagcactggattgttatttcccttgtgtgcgttatatattacgggcgtataaacacttactgagttgtcatgagcgataacaccattgacacgtttgcttattcagattgtggttcatgtggcaagcacgtacgtacaccgccatggaggcactttccaaaagcaacatcccagatgtttctagctgcgtatactagtcgcaattagcaatagagctgtttagtcacgttctggaattgtcagtggttagattaaggatctaataatagaagttgcctaatttgactgccatcctggatggttggagtctttcttggtccacaagacaagcaacagaatcaggattcgtttccagtttggctttggctttgttgtacgttccgttttccttgtactaccgggcacttgcaaattgcttgcgcattactatccttggtgtgaaatggttctaaacggaatattctacttgtagtacgtacacttgtactccacctgtacaagtgacgcatttttttacattgactttgtgcactttgttatattagcctcttttgatattaggcagtagtaccatcctaagaaaaaaaaaactcaatcaacatgtgatgcgtgtaccaacgacacatcacatactttaatttggcgataaaacacatgtgaaccttttattattagtcacaggcagtttgaaaaaaaaaatcacaagaattagtagtactgctacagtactactaaccgatcaacttggagaagaagaaaagatttcctcagagtcgggaaagcccgaggaaagcccatctcccccgtcactgacggtgtggccccaccaccggttcctctcctttcgctcttcctccctatataaaaccctcccaaaaaaaccctctccatttgcaaatcgcaaccatctcgtcaacaaaaaggcgcctctaagaattcctcccaaactttttggtgttgtcaagccgtgcgtttcggggtacatcaacggcggcgatgagctcccggatggccggatcggcgatcctccgtcacgtcggcggcgtccgcctcttcaccgcgtcggcgacctctccggcggcggcggcggcggcggcggcgaggccgttccttgcaggcggagaagccgtccccggggtgtgggggttgcggctgatgtccacgtcgtccgtggcgtcgacggaggcggcggccaaggcggaggccaagaaggcggacgcggagaaggaggtggtggtcaacagctactggggcatcgagcagtcgaagaagctggtgcgggaggacggcacggagtggaagtggtcttgctttagggtacttgcgcttcgctttgctcctgatcggtttcctgtttcgattctgtttgtcccgtagattgatcgccagatcgatgtatccatactccgagatagtaggctcggtccttaacttgtcgcgccgccgtgtgtaattttggtttgattttctccgcagccatgggagacctacaccgcggacacttcgatcgatctgacgaagcaccacgtgcccaagacgctgctcgacaagatcgcctactggaccgtcaagtcgctgcgcttccccactgatatcttcttccaggtataattgtgcttactcgatcaccatgcaccgcccgacggccgtttgattctccgggtgattagcgctgtgtgtttagttcaacgtttttttcgaagggaaaaactgagaggccgcgtgactcttggcgtgtcataagaggcaaagtagcattgcaaccagggcacttgagaattttggtttccttgcttccgggaagatgccatttgtatttaggacgcctgggttctacctgatccacctgtgtgattgattttattttcggaaagtattttctacacctaggtaacatggcacctatgtgtatgcatgcaatttaaaccgttataaaaaaatttacaaacattatacaaacatgtaagtctaaattcgatcaacatatgaagaaacaaaaataataaattttatatgcgctcttcgggtactattcactgtctgattttattatttttgtttctctagttatagatcaaatttagtcatgcatgtttgtgtatagacttatatcatcacaatcgatgttactaatttttttttcaattttttctataactatttgagtcgcatgcaaatgatgggtgtcatagcacttaggtgtagaaaatccctgtccttttattttccgctatactatctgataacaacggctaagaaaaggacacgcattgtgagaaggactcaactttgatttgttaatctcttgcccattaaatcaatcataggcttattactgtttgcactacaatgactggtgatccaattgtttcctagtgcaaattaatctatatatgattctaatgtcttatgactaatttggaagaacaattatattacatgatatccatttctagtagtatgtggaaatgatctctagtcggtcgctaattgctgtaactgtcaatggttaacactgcaaattgggttgggtgcagaggaggtatggctgccgcgcgatgatgctggagacggtggcggcggtgccggggatggtgggcggcatgctgctccacctccggtccctccggcgcttcgagcagagcggcggctggatccgcacgctgctggaagaggccgagaacgagcgcatgcacctgatgaccttcatggaggtggcgaacccaaagtggtacgagcgcgccctcgtcatcaccgtccagggcgtcttcttcaacgcctacttcctgggttacctcctctcccccaagttcgcgcaccgcgtcgtcggctacctcgaggaggaggccatccactcgtacaccgagttcctcaaggacctcgaggccggcaagatcgacaacgtccctgccccggccatcgccatcgactactggcgcctccccgccaacgccacgctcaaggacgtcgtcaccgtcgtgcgcgccgacgaggctcaccaccgcgacgtcaatcacttcgcatcggtacgcatgcatgatcagcgatcttgctctttgatctcgccttttggggatgtatgttgaattggttctgacgtgtgatctggtctggcttgtgatgtgcaggacatccattaccagggcatggagctgaagcagacccctgcgccgatcggatatcactgaggatgtttgtctactgccgaggatttgcatcactaataatcaaatcaaatgagtatacttcgtttttcagggaaagcaaatgagagctctttagctgtatcggatttggtaattgctactagtaactactaagtactgaaaaataaggagtctccttgtttgaagtacaaatctaggagattttttgaaccaactctatctgaattgggcctgtttttcgtacgccgcactgcttcatgtacatatattccatcccctatcttatgtgtggcaagtgtctttctaaattcttggatgtaatgacacctgaatttctttcgttgaactattggcagctgagttatatatactacataccattcttttgttaaagcaggtcagagcatagttttgtccatttgatgtctgtcacaattctggtggtaatgttccaacttcgagaaaattgcatatctaccatcccataagaatggcttcgctagaataccattatgaaaacgggcttcgctggaataccttcctcaaccagagtgtcttcgccaaaatgccatcccggacagaaatgcccctggctcttcttcttcctccatctcgcgcgtgaagagctcgccggcggccatggctagctccctccctgccatggctagctcgccacgggctccggcggagggctgcgcggtggcggcaggcgcggtcgacggcggcggccacgggctccggcggagggcggcgtggtggcggctagcgcggtcgacggcggaagacgcgggctccggcgtagggcggcgcggtggcggctggcacggtcgacgtcgtcggccgtgtgctccgtcggagggtggttcggtggcgactggctcggtcgacggcggctggctacgtggtggcaacgaggaggcggcgatggccaggagctgcgccaccggctcacgcgcgtcggcgggatccacgcgtcgtctccggagtccttccgcgacgacctcagctgcacaggcgcaggtggggatggcaggggagggcagcgccccaatcgccgtcggcaaggcagcatcggcgcggcggtggagatggccatggccgccggcgagctcttcacgcgcgggatggaggaagaagaagagccaggggcatttccgtccaggatggcattttggcgaagacactctggttgaggatggtattccagcgaagcccgttttcataatggtattctagcgaagccattcttatgggatggtagatatgcaattttctctccaacttcccatttcagcttgcctagatgctggatgctatcttgtttgtcttcttccaaattgcctgttgtgacgcggacggcgtacagagatggagtcgatcgatctcaccggtc

SEQ ID NO: 263 - DNA, 2876 bp, Oryza sativa
tgcatctatcagcctaacataattccagtgcaaaatatggcttttatatatagagaaagaaaataccgttggagagttaatgcaaccgttttaaatagtttacggtataaaataaactgaaaaatggtttaggtggttaaccgttccggtgaaatagtaaaatagacatttcacttattttttattaaatatggaaaaataatactatattagtaaagaatggagatggatatttttcactcatctcacatatacaaacacaaaagtaaaaaggctagaatattcctattttatcaaatcccaatgtaacaattctcactctatctactcgcaatattattattctctactttcacaaactctgttgcaactattacggtaaaactgaatttatttttgggacagatgaaatgagttaaaaatgaacttaatatagagcctgtttggcacagctccagctccagctccagctccacccctcctggagctggagctcagccaaacagttttagctccaccaaaactggaagtggagctgggtggagctctctcacaaaataaactagagttgtgaagctccacaactctacttcagacttaactcttggagttaaatttaggagttagagctatcccatcgaacggaggaaggaagtaagtgttggaactgattaatggcgtttgtaattattctagatggagaggggtgtgtgtgtgtgtggcatggcagggcatggatccctcctcctcgccccagagacgcgccatccatgaccaatgatccccacacgcccaataatggccatgcactcatgccacccccgagcgcgcgccatcgcgtcgcgcgccatcgccatggtcgcgtcgcgtctctcctctccccgcttgcactgcagctcacgcgtcgcttttgaccatccccgccacgctgccccctcttcccgcgcgccctctctctacttatacctcccctcctcatctcgctagctacctacccacctccgcgtcgtcgtcgtcgtcgtcgagcgctcgatcgatcgccatggcagccagcgagcagagctccgagtcgtcgtcgacggcgtccacgtcgtcgtgcggcaagaaacagcaggtggccgggaagaggaagcgcgaggacgtcggcggcggcggggagcaggcggcggcggtggcgtacaggggggtgaggatgagggcgtgggggaagtgggtgtcggagatcagggagccgaggaagaagtcccgcatctggctcggcaccttcccgtgcccggagatggcggcgcgtgcgcacgacgtcgccgcgctcagcatcaagggcgcccgcgccgtcctcaacttccccgacctcgcccctgccctcccgcgcccggcctccctcgccccccgcgacgtccaggccgccgccgccctcgccgccgtcatgcaccaccacaaacacccctcctcctccacctccacctcctcgccgccggctgctcctccgccggacgaacaccaccctcgccacgagccgcagcagcctgagtcgagcagggaggatgaccagcagcagcagccggcggcggcggcggcggcgcagatggcggtggccgagctggtgttcgacgagctggcgccgctgtgggtggaggacgtggtggagttcgggacgtcggatcattgctggacggcgtacgatgcgcttgaccccatcggcttccagcctctcctctgggagtactaggctgctgcttgtaaaacagcttcctcttcttttcttttcttttctttttttggttttgttttttgtgtggattttttcccctagtgctgcttaaaatgtggcttgttttttttcttctctctttcaatcttgatttgagttggatttggagtttgtgtgatatatgcgatggaattagttcgagatgcgtgcacattttgtcccaggaaaaatgcaatgcttaactcgaagcagaagctcaatattgtggttgagactgaaccaaaatcaatctaaaatttgagggttgaaaatttagacttctgcgaaagttcgagggatgtaaaagaagaaaaatgtcaccgtattatctatttttgaacgagaggtttaagctatatatataagcactttgtttactctgagcaatgggatgtaattttcatgaaagcaagcagtgcatatatcgactaaacgagtccagaacttcagataaaaacatatgctagattttctagaaactgacggctcatggcttttgcttgcgtaacagcacctatggtaaaatagtctttctgaattaatcgcaaaaattaaaaaaaaaatctttctgaattctgacaagtcagaagaaataaatatttttgctggctcgatcgcacaaatacctgcacatcttgccattgtgatcactttcactatgcgtaacataagtcatcgatttttttttcgaacacgcaaaagaattacacatcaatatattaaaagaaatcagagttttggttacactacgcaaacgaccagaaggctattgccaggggacatgaaaaaaatggaaggaaaaagaatgtaaaagaaaatttcattaccatgaattccttgaaagcaatttcaaggaccttactactgtaatacttatcagaactgactactactaccactacttaaactttgaccactaatagcttttaaactgccagattatggcgatttaaacaatgcatagttgcaatgatgtttatcaaaatttacctgcaatttaaactgtatcaatcgctcagcaatcgaaccttacctaaatactaataattgactctgcagctgggacctgcagaaacctagcttgggaattaactaagcatggtgtcccatggcaacgccgatcaat

SEQ ID NO: 264 - DNA, 5357 bp, Oryza sativa
gtacgagtagtaaatgttggttagttgcgtggatcccaccttccacgggaggagtacatagccagggcaaaccctagtttccgtgtctaacttttactgtctgtcttatatgaattttttttataatttgtatttttattgttgttagatgataaaacgtgattaatattttatgcgtgacttatctttttaatttttttcataattttttcaaataagacggatggtcaaacgttggacacggaaaccatggtttgtctttttttggacggagggagtattttttaagttaccttcaaacttctataaatttcattgcatggagtattaaataagaatgaaaaacaccaattacacagtttacatggaaattacgagacgaatcttttaagcctaattacactatgatttaataatgtgatgctaaagtaaaacatttactaatgacaaattaattatacttaataaatttatctcgtagtttacagacgaaatctataatttattttgttattaggtaacgttaatacctcaaatgtgtcttcgtatacttaaaaaaaaagtgtaattttggcacacgaactaaatacgaccagtaattaattactgacagcaatagtaggatcggaggttggggcacactgcccgagaatagcgggcccggcgttttaccgatccagcaatttcaggatcggtttcaacaggatcaccaaacgccgcgtgccacgtgttcaatcagcctgtgaggcgtgaaccgacgccgttaacgccgtatgaaaatgtccattatacccatgtcaccttcccccaaagtttttggcccccgtctccggcgaccaatcagggccatccaaatatgcaacgtcggatcgcgtgatctgggatcgacggccaggaggcgccctactggaagcttccattgtctcttgtactgcaccagtggcaccgtcctccagtcctcatcctcctctcggccgggggcccatataaacccccaaggggagcgtggcttccattcgcccaagcctttcgagtcgtcttctccccttcttctcctcctcctcctcgattcggagctccacccgcagccatggctaagaactaccccgtcgtgagcgccgagtaccaggaggccgtcgagaaggccaggcagaagctgcgcgccctcatcgccgagaagagctgcgcccctctcatgctccgcctcgcgtaagccgtcgccctcgcactcgctcgcttctaggttttgtgtagaggcggatttccgtagactgatccggtttttgtggagacggatcgcgcaggtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccaggttcgccgcgagccccggatagatctggatggacggccccgatctggtcaaacggacgtggttctgatgttttttccccgttgtttttgcgcagcttgccggagttgtggccgtcgaggtgtccggtggacctgccgtccccttccacccaggaagggaggtgagatttcctattacctttcaactcttggggtttttctcagggttctagttaggccttgatatggcagtggtaaactggatggcgtgtggatttgtttgtgatgccacgagattagtcgtaatttgttagtgctccattgatgtgtgtgcttttcatttgtggggactgggggttggtggttcctagagagtagacaaagtgatcaccactaatctaaggccagcagtataataatattttaacagtacggacttttctatattatatacccggataataccgtcaaattgggtttgttcgtattcttgttggtgggtcggcgttacttgacatcctctagatctagaggtggttaaatatccgtgacctcatttacatttccgtaagaccttgtttatttaccataaacatgctaattgttattttttagttattgttggctcatgtgtttgtgtcagttgagtcacataggattcattttcatgcatgctgtatggtgtgaagtttgttatccattcatgcacaaggatattatttttaaggatgtcgccttatcctttttctttgtagtctggctattctcaaagtagtcactgatttaccatggttgtttgcggcatttccctgttcagggttttgatagttactgatctttcattttatcatttttattttttactcaggatagtagttctcatcctaatcgatgtcatactctaaaccatgacaaataaacaattattttctgaattaatggaagaagccttggggacctggaagaagccttggggaccggggttgtttccgttctctatgcatgatatagtttgatctgttggattgtgccatgtaggatatttgttgtgctttgtgaatataaacttaagaaagcatccattatttacaagtctagttggttcagataaagtatattagggcctcccaacttattgcattgacataaaatgataattaggggttcaatctgaaggcagttggaaagcttaatgaaaaaacagtgggccgatatatatctatatgttatgttttaggaaactttagaaaggtgacttggtgcttgttttaggatataataactgttatggatatatctttttttataaatacataatgttcagtaattattatgcaccttcaacaatatcaccgatgatagtaatatatatcatatatgtaacattatacagtgcttaaaatttgcttgtgcatatctggctcatctttatatttatttctaaaatggagagatgattaagtgtttttttatgttccattttatattcattgtgttgttaattgagattgttttcatccttccttgaccttttgcaggacaaacctgcacccccacctgagggccgtcttcctgatgctaccaagggtatgttgccagtttacactactagtctcttccaggaactatagaaacattcaccactattgccataaaagaaacccttgcaaataagtcatcctttaaaatgtttttgtttctgcaatagttgaggtgttatttctgtgtagcacatctaaaatgcttagttatggtagaagtttttcccactgcacacttgacaaatgattcctgtgttgttgtaggcatgttgtatttttctgcatgcttcatttctgatatgatcctgctttgaccttgttctagtaaacctcatgtaaagcaccattgcttacactttgagcttgattgctttaccaggttctgaccacctaaggcaggtcttcggtgcgcagatgggcttgagtgatcaggacattgttgccctctctggcggtcacaccctggttagtttggctattaaccattgtatgcctctgcagtatgtaggagtacatgttctaatgtcggatttctgtgctttgttctgcagggaaggtgccacaaggaaagatctggttttgagggaccttggacaagaaaccctctgcagtttgacaactcttacttcacgtaagcgatgttacgagtggttgaattttgttcttatgctgaacaaagttggtaacaaaaatgttgaactcatctctccgcgacgattttaatagggagcttctgagtggtgacaaggagggccttcttcagcttcctagtgacaaagccctgctgagtgaccctgccttccgcccactcgtcgagaaatatgctgcagtatgtctcctatcaatcatcatcttgtgttccacgttttgcatcttgtgttcctcgttttgcagagatatgccagaacatgatactgattgtgttttttttccccaattctgctaggatgagaaggctttctttgaagactacaaggaggcccacctcaagctctccgaactggggtgagtaatggtttgtcaatccatttatcgtgttatctttcatgacaacaaggtcatggtagctaattgtactcttgtgatttcaggttcgctgatgcttaagaggtttctagtctactactgctagtacattgcccgtggtactcttgttttgcatctaggctagggccagtgtgaaccagcagactaccactgtgagtcgcctctgtaataaaatttgttcggcctatggccatcctcagtacgttgtcaatgtctcggtgggctgttatgctcaactgcaatgctgcatccactgaaacctctttctagatgtgttggtatgaaatgcggtattgcgttcccgatttcccctgctactgtcttgaacctgccgtggtacaatccttgtttgctgcacttcatttttagttcgttctaattccgcctggaatgacttttgagtgcttcacgggctgactgcctgaccgtgttgctgtacatgcctaccccatcagttcaaaaaaaaacaatcctacctacgaaattcgttttttattgggacaggacatcggctgagtttaatttcaaaatttttcaacaaactttcaacttttccatcacatcaaaactttccctatacacgtaaactttcaacttttctgtcatatcgtttcaatttcaaccaaacttttaattttgatgtgaactaaacccacccatcattggatggacttggcaaaacatggcttgaccattgagatcgttttggggattttgttcagtcagctcttccatggtgtctatcagaagagttggggccgtacaacgcaaattatttcccagatggtgttgatatcatcaatgatcatggcaatttggcaaaccatttcttatttcccagatggggttggtataataattaatcatggcaaccccatttgtttggtgctaacttgatgaaacatgaatgccctcaacctcaacagatgggctccagtccggccggcgccggccagcactcggtcaacacaatatgggcacgagtggggctcaaggaagtgtggggcgcagcacaaggagccaagagacaaggagtcatgttggtcctttcagtttcaggcaaaaaaggaaccgaaaggagccaaggatcggaccctttcgaagcttttttgaccatttcgtccgacttgcaaggcaggcccagaaacaaaaataacccaactgtctagtggtaatatcatttgggatctgttaggattttcagttcgaagaaactgtcctgattcagagttcagacaaaatacgccttcagtagttggtcctgccgcccctcgtagtttcactatcgaaagggatcgctgctgtcgtaata

SEQ ID NO: 265 - DNA, 4329 bp, Oryza sativa
atgatgattactccctccgtttcacaaatataagtcattttagcatttttcacatttatattgatgttatgtctagattcattaacatcaatatgaatgtgggaaatgctagaatgacttacattgtgaaacggatcattaacatcaatatgaatgtggaaaatgctagaatgacttacactgtgaaacggagggagtatacgattatgtaatgaaaaaaggagtacaatactagtcgccgtctccccgcaaaaaaagtactagttgtcgtcaagtaggggagtaataataataataataataagggataatatacaggctgtgtttagttcgtgtgccaaatttttttaaagtatacggacaaatatttaaatattaaacatagactaataacaaaacaaattacagattccatctgtaaactgcgagacgaatctattaaacctaattaattcgttattagcaaatgtttactgtagcaccacattatcaaatcatggcgtaattagctcaaaagattcgtctcgcgatttacatgcaaaccatgcaattgatttttttttcatctacgtttagttctatgcatgtgtccaaatattcgatgtgatgaaaaaattggaaattcgaggaaaaaaatttaaatctaaacacggccacagtataaaaaaaatagtagcgttgttgtttatgaaagaggatggtaaagtaagacaagacaacgcaagggcctaaaaaagtggagacgaagaagaagacggaatatattgcattggaaaagtgagcgcttggacgagagaaaaactcggattcaagcgtccatatcagtggacaccaccaatgggaggtggccacgtgggcaggtcccgggtggaatctggcgcgttcacacgggaggttccgaaattacggcaacgccactggagtgcgaggcgcaggatgtgagatccacggcgggggctccgctactagaaacttcttctggtcgtgggtggtacgcaccctcgcgcctcgcctttatattactagtaagaagatctcatccctccttggtgaggtgaggtgagttgagttggggattgattgattgattcggattgggaagaagaagaagcaggggagcatgggcagcaagtcgtacccgacggtgagcgatgagtacctggcggccgtgggcaaggcgaagcgcaagctccgcggcctcatcgccgagaagaactgcgccccactcatgctccgcctcgcgtaactttcttcttcttcttcttctactgattaatttccagaagatagagtaggaggagtagatgttgaattgcagtggctggctggctgcaggtggcactctgctggcaccttcgatgtgtcgtcgaggaccggcgggcccttcggcaccatgaagaaccccggcgagcagtcccacgccgccaacgccggcctcgacatcgccgtcaggcttctcgaccccatcaaggaccaacttcccatcctctcctacgccgacttctaccaggtaaggttcacttccctcccttcctcccttccttcctctcaactcatcaacctcttaattggagtctctccctctctattggcagcttgctggcgttgtggccgtcgaggtcaccggcggacctgaggtccccttccatccgggcaggcaggtcagaatcacatttcccatccctaaaccctctccctctctctccccccttcttctttcttcttctggtagatgcaaatggtatttttcttaagtcaattcttttctttcgtcatcttgtacgccgctgtttcctttccctgaattctccactgtcttgtgaatgttgatgatgtgatgtgtttgtttctaggacaagcctgagcctcctcctgaaggccgtcttcctgatgccacacaaggtattaagatttcctctgtattaagttacccctatgacaatgcatttcccaatgtgttggtgattaaattttctagatctatgaccagcatttgtatgtgctactgatggagtagttcatattgcaagtccattaccagaattctttcatgcttaagtaagttgtgtaacctacataagactaaaattttccaaccctgtttatgcaaaccacattactaaagtttgttttgtgttcctgtttattcttctttcttatatggagcatacatgttacctgtgtgttctttaattaacagtgtgccaatttgtggatgcgagataactaatatgtcatggtcttctggctgttggtccaggttctgaccacctaaggcaggtcttttctgcgcagatgggtttgagtgacaaggacatagttgctctttctggtggtcacaccctggttggtacacttgtgcaattgccctagtgtgtttctcatatcttgtaaccggaagggttattcatgcagcttcacttcatcttctgtagggaagatgccacaaggagagatctggctttgagggagcctggacgtccaaccctttgatctttgacaactcttacttcacgtgcgtgatctctgattctttttaaagatgcatcctgtctgttgataaacagccagccacagcttgtttccttgtatgctaaagaatgaaaaccaaaatctcctctcgatcaacagcgagcttgtgagtggcgagaaggaaggccttcttcagctgccaagtgacaaagccctcatggctgacccagccttccgtccactggtggagaaatatgctgcggtacaccccttgatccttgcattattttctctcgtcttctttctaaagagttgttttttttaaaataaaagaaataagagaaatggatcatcgttgatctcttaaaaagtagatgattgttgcctgatatgtaggatgaggacgccttctttgcggattacgccgaggcccacctcaagctctctgaactggggtaagggatgcaactggtgtgcttgtctgtgatgcgttattggagtgctttgtgccagagtttcactaattattgttgtgtttgtgggtttcagatttgctgaggaataagaagcctttagagagcgggatatccgcaaaagattaatgccgatttgtattttgcgccttagagtcagtacgatcaagactgtcgtggcggttgtaataaaaattagtgtgctttgggccatctttttatgtgattccaattgtctttctcttcattcttgctttgatgctctttgtctggacctctagaccgccgtattgtactgtggagtttcaaagttaccaagctatttgctgtcaagataactatggattgaattccccttgatggatgaaccaactgttgttgtttgcccgttcttcagctttcgtttgtgcggccatcgatcgccatgcgttgcttaaacccatttctagctcccctaccctgctgcatccgccctcttctgcgcgatcgttggattgcgagtggttggctggttgcacgacttgtggagaccgaaacaaataatttttggtcaaattgatcggtggtactgtcggagcatctattttttctttagcttagatcgtataattgtaggattgggatttgtatattaatatatacaggtcgattaaaacaatgcaactattcgtgatgtcatgtgacctaaacaaatgtgtgccatttatgatatttttcaagagtggttcttatagacttcttactaacaaaaattcacgacaattggactgagcctcaaaagttaataaaaaagaatcaagattcagtcacaatgtgacgttacgttagtgatacacaaacttgtcagatggatacaatttataatacagacttgcaaaatacttattatatgttgtatgatatgtgtggcgcaaactaactatattgtgactaatcatgagtttgattatagtattgtcacacgcaaacacgaggacatacgacatatcctatgcgtaaataacctttatacatactttgtatttattaattttgttattgcaatacattattttagaaaggaattgttgtaaccaattgcataatccttaatgctaatttggatatgatgtgaacaaaatgaggtaatgtaaagataaaaatggctgaaaactggtgcatttaactttttgtcactttaaacagtcatgtggaaccaacctaccaaccatccatcgatgtattggaattgcacatttcaaacgagttgaatgtgagcagatggaaacgcaacgctgttgctagcccagagaaagaaagacgaggaaaggaggagcaggcggcggcgtccagggtccagcagcatagcattgagcttgagcatggtttccccttcgcttcggat

SEQ ID NO: 266 - DNA, 7079 bp, Oryza sativa; identical to SEQ ID NO: 256

SEQ ID NO: 267 - DNA, 2966 bp, Oryza sativa; identical to SEQ ID NO: 215

SEQ ID NO: 268 - DNA, 4898 bp, Oryza sativa
ttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagctagggcatgtcaaaaccctaagactaccatgcatagactacatttatgcatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattctcctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttcaccgactggacccagcctttcatgtgagttatatatacaagccaattaattaactcgtactagctaccatatcatatggagagctagcttagctgagatcgatcctgacatgtttgcatgcgattttgtgtacgtttcatcaggaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccgttctggaacccttctgccggattcggcatgccggcggctgtggcggtggcggcggcggcggcgcaagatcaagctagcgttcgctctgccaaacgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttacccttt

SEQ ID NO: 269 - DNA, 8458 bp, Oryza sativa
ggcatcggcgccggcgaggctggaggtgcttgagcagatggagccatgggtggagcagcacttgctgccattgctcaagccagcggaggaggacgaggcggcatcggtcgtggcggagatggcgaggacagcggcgaggagcatctcgacgacgcgggtgtaggcggcctcgtggcgctcttgtcggcggcgatggcgccgcagatgcgggcgagcgcgtcgtcgccatgggcgcggacgttgcgtgccgtgttgccgcggtggcgcgctcctggaaggcgacatagctgaagccgtggtcggggctcaccagcgcgtgcatggccatgccggagctgatcagccggtgcaccgtgcgctccacctggcgcatgtcaaggcggccggagaggtacatgtaccggttgagcacgtcgtcgtggtggttctcctcggcggaccacctgcagatccatcgcgcccatgccgtcccgtcggcgccggtgacgtcgcgcgccgactcgaaccggttcaccatgctttggtacgtgggcagcgcctcctccgtcaccatgttccctaccaggcacactaggtgcgcgtcgggcacgccgcgcagcgcactcccggagctcaaggcacgccgcgcagcgcactcccggagctcaaggcacgccgcgtggaacccgtccgcgccgagcgccgccgcgtcgggcaccatgtcctccggctgccatgcctccttcgccggcttgagcagcaacagcacatgctgctccacccacggctccatctgctcaagcaccaccagcctcgccggcactgacgccgcccccgtgcgcctatgagagtgagagagaatatagagagagatgagaagagagataggagatagagctgacatgtgggcctaagggcatttttgacatttcacgcgatttctctctcctcttcaaccggaaagtattattttaatcggcgcggtgtccactggcaaattaccacgtttatggagtgttttcccccaaaagtgagtttgggcaatgtcctagggctaaaaccacacataagtagtgtcctgtagcaaaatttgccggcaaggtattggtttctagaataatttttttaagatctatttatagaataagatttttaaaaggaccaaaagttaggcactgattagttcccaaaacaaaaattttcatgctatcacatcgaatgtttggacacatgcatggagtattaaatgtaggaaaaaaagcaattacacagattgcgtgtaaattgcgagacgaatcttttaagcctaattgcgccatgatttaacaatgtggtgctatagtaaacatttgctaatgatggattgattaggcttaataaattcgtctcgtagtttcttggtggaatctgtaatttgttttgttattagactgcgtttaatactttaaatatgtctctgtatatctgatgtgacaaccaaacccaaaaaattttcacaactaaacaagggctgtgtttagttcacaccgaaattgaaagtttggttgaaattggaacgatgtgacgaaaaagtttgaagtttatgtgtgtagaaaagtttaatgtgatggaaaagttggaagtttaaagaaaaactttggatctaaacacggtgaagaccttaaagaaaaattcagctgacatgaaccttagatctctcaccagctgaggcggcgcagcatgcaccgcgcacaagacggccggatccccgccttgcaggggtcgcaggcctcgtgaccgcgtagctccggccgcgcggtggccgtttgccgggtgggtatccccccggtcggcacacgcgcgtcacggtgaaacgcagcgcggatcgcgtacgtgaaaaacccatcatatcctttcgttttttgcacgagaaggaaggagggccgcggcctacctagcttcctcggcgtaccgcgcggcgacgcttagcttttcagctcacctctcctccacccaaccatcgaacgaccgagtcgcttggacggcacactccgctagctctgaccgcgaccagtcgttcgtacctggctacgtactgcactccattctagtactgtacgcctgtgtaccgctcgtgtcgactaacctacatgtacgactgcttgatgagctcactatagctagcaacaccaacacgtatgcacgcgcatatagtagctttcgcacgggttaattgattaatccttaattaatcgcgtcgcctgctggtcttgggtcgtcgtcttggcacatgtggtcttgtagaagctactacatgaaatagcagaagctatttttcctccccgcgaccaccggtcgacgctgcattgttggcacgtttgctctgtcccctggaatttgcaagagcaccttctctgcttttttatcatgcggctggtattagttgcaggtgagcaccggtttctctagcgaagctgcttactggctcaaccgtcgtttactcatttgatcaacagagggatagtggatagctttttattagccctgtttggaacagaaaagtattctgtacgatttttttttggtggggtgtggggagggggaataaattaatttctagtaataaatcgggaaattgctaagttcaaaaggggcttggaattcttctctcccttttttttggaatatagtctttttagaaataaaccgggaaattcgtagttgaaaggagttttgaaaatttgaatgctacatgaaaatcttctatatataaagtcattttcaacaattatattaattccattggaaatatatacgatctcataatttatcctgtttgtgtcttacgacttctttggggggtttgccaagttgtcgtgttattttaagttcataacctcttcttatgacgattctcaattcacgtggctttactatatgctgttttcaatctctaattttctatatcattattaaacatgtgcctgtgagttttttagtctccggtccggtagtatagaggaatttcatttgcctgatagacaaattgcgatagaaattacagcacagaaggaggaaattgttatacaatttttttgagcacatgataaacaactgagagactacgacaagttaacacacgaggaggctatcacggggaacacattgtaataactgaataattggaatcactcatcactcatgactttgccttgaccatttaattaagccttgatttatataaacagcattatcagagtatcagtccataactcctccatgcatgcatccatgcacatgctaaaaacatcctcaaggtattttataaaggtcctaattaattagtaaattgaaaggtacaccttgtcaacagtaaactaaccacttccaatagaacccccaaaaaaaaaacagcacagtaaccactctatgaacaatttagaagtttccataggtttctgtgccgccaaaaaaaatggtgtgccggaaggagaagattcagctggtccaggagaagtctttactcgtcattagctcttcaaacatcgcactagcgacagcgtgtggtaaaatcatttgacgtgttgattaatagttgggatgctgattcaagttcacatttgtgtgagcgtctcctgttcaatctactcgttgcttgaatttttcccccttttgttcgacagtcggagaaatactattttaagtgtattgaagggagaaaaatacgccaacatgctaataagataatcatgttgattagttgcaatgatgccttgaaaatttgggatccctttcatcagagaattgttaattgttgttgaggaaaattgcaggaatccctctaaacttgaagtacagtgccgaacaagtcccttgaactttaaagtaaatttgaaaatgtataaaatcaacaataaggttcaattagatctcaataagtgtttgcttagctaaaagtttggtggtataccttaactttcttccttctgttgaaagtatataccaacaattatttttccttatgtccccgcaaaagaaaaaaaaacaatttcttccttctgtttactttttgattttttttccgagaaaaaagtactttgttatcctatttcattgcaaaaccaggattagagcactagcctgccaaattttcttttttttcttaagaaaaagataatggtttgtcaatttactgtatttatacatttaaatgcatggcattttgctaccataattttagctgtcatccacggtattcgtgtggttgcaaagcagaggcctcattgattgcccaagagcttattatgaacttattagcgattaaaaaaatattttttaaatctctaatacatatgtacttagcgacttaaaaggcaatgaaaaagaaactatgttaaaaatatcttaaaatcaagtttaaaattaagtttcagaattagcatagagaaaatgtgtgttactctatatacatactgtaaatccatcatgtaaataccgaatctgtaagggtctaatccgcgaaaaagcaatcaacgcaaaacttcccaatcaatcggcctcctacgtggaaccttctctgcctgccgacgtgtacagccgcaagctgacgtcacacccccttcaaaccgcgtagccgtacccccctccgtttctaatcccacgtgctcttttgcatcccaacccctcctcctccgaataataacttatttatttattaatcattttttcatcatttgaccgcccggttttagtagccaatcccactcgcctcacatttgcgcacacggctattttgaccacgtgacccaaaaaaaccacacgtgaacttgttcttccattttccgcccccgcctatttatatcccgcgttcgaatatttcccgggaaaccatcgccaaccatcacatctgatcgagaacaagaagaagaagaagaagaagcaagaacagcaagaggaagagatgcaaatggagtcgtactacggcgcgttccacgccgacgaggccgcgttcttcttcccccaccacgtgccggcgtcgccggagctgccgttcggcctcattgcgtcgccggagccggagccggagccggagcaggcggcggcggaggcgaggcagagcgcgttccaggagtacggcggcgcggtgcacgccggagcgccggcggcggcgggggctgtcaccaccggtgggacgaacatccaccggagggtgatggacgtgctgggcaggatgggcggcggcggcggcgggggggagaagggggagggtgaggagatggaggaggaggaggaggtgccgcagcggcggcggcgcgggcagggcgccgacgtggagagcagccgcggtttccgccacatgatgcgcgagcgccagcgccgcgagaagctcagccagagctacgccgacctctacgccatggtctcctctcgctccaaggttcgtcggcctcctctgctcacagcctaagcttatcactctcacttagtactctacttcacttcgccgctcacttcatttcaagctccatttcatctttcacctagattccatcgagaaatgcctaatgtagactgctaatttggccttctttaagctcagattttcgtttaccatcgcattgtcccatttcattggcttcaatttgcctcttcttgatttccccaatgttaatctgaaattcagagcatcttcagctcaaaccaattctgttcagcttcagaatgttcgaaatccccctttaatacctcttaaatggagtgtttaccaaaatcgggctgacaaaaaaccgttcgtgtcactgcagggggacaagaactcgatcgtgcagtcggcggcgatctacatccacgagctgaaggtcgcgagggaccagctgcagaggaggaacgaggagctgaaggcccagatcatgggccacgacgagcagcagccgtgcgtcacggtgcagttcgaggtcgacgagccgtcgtcgtcgatcgactccatgatcgccgcgctccggcggctcaagggcatgagcgtcaaggcgcgcgggatccggtcgagcatgtccgggaacaggctgtggacggagatgaacgtcgagaccacggtgagagctctctctctctctctctctctctctccccccccccccccccccccccccccccccccccccccccttggcttgcaattcttgaaaatttttgcattttttcccctctgaacttagcctacctgccttgttgacagtaactgtcagagttttaattaggttaggaaagatgcagcagttcgtctcctacaagattagcctcattttcgtgttttatcaatacactgtatcttgccttggatagctacggattagattgttacgtacagtagtagataggaaaccgtagtggcaacgggataactggataaggatgaagagttctaatcaacttcagaaatggaagatggaagcatattggttgggagaatttgggctatttttttttcgaataagaagaatttgggctaaattagagaagcatcagagtaacgtttccgaaggaaaagattagtgcagtaattttgctgaactattttatatcctgtccacttgaggtcaagatgcaggaattccactcgaaaccccccaatttgacattagtcaaccgtgtcaagagttcttgtcgaatcttttggtttatgcataaatcatttagcagatcctcaaccccaagaccccaattacaaatagctgtaattagaggtttaattaatcagcaactgttgttagttagcactggtcatccaactgccaaatcaatctttcctcaaaagattattacaagtagttcacaaacatccaaacatgatctttcaaaaggaaacatccaaattccaaacagccataccatattttatactacagagcaacaatcggggccaattacagtccatgcctatccaatattaaactgaaaaagtttattataattataacactagcagttgattaataatagtaagccaattgtacactctaactaacgacgtttaatttcgcatgtgtcattttcacagattgcggcttgtgaagtggaaaaggcagtggaagaggctctcaaggaagtagagaggaaccagcctgacagcgatgccccatttcctggaagcaaaggctggacacagacatctcatgtgcaaaatgtgttttgatcggttttgaaacatgatcctgctgggacccccatttgttcatttttttaaaagcttgtgatggagcaagtggaaaaaaaatctccatatctccttgtcaatgtaccttttttttgtccatgtagatacaatcatacaaataatagcttcctctcttttctacaaggaaaaaagaaagagaagagtacaaaaaagatttaagcagcttgtttatcagttaaaaaagaaaagggaatcagatttgtcatatctcagtctcttcctgttccaatcacaaagggatcaatttcacatcccacataaactcacccccttcccacttccacccttgcactgcccttctccctcagccatcgccgctggatgcattaccatgttttcattgcgaccactgccttagtcacaaatgagagaattatgtcaatgaaacactgtttctacctctaatcaattattgagtccatattgttgatgagcaatttcagaaacattcttcaggcctgctgctatcaactatgatctctggccatgctgcaccgtccacatactcactatggttttttttccaggtggatctaaaaattctcgcttataaaaataacaagagggctgtgtttgtaacttggggttgggaacccatcttctccacacagaaaatgaagcagtccattagcacgtgattaattaagtattagctattttttaaaaaaatgaattaatttgattttttaagtaactttcgtatataaactttttttaaaaaaacgcaccgtttagtagtttgaaaagcatgcgcgcggaaaatgagggagatgagttggaaactgagagcaccgaacacaccctaggcccgctagtaaaaattgaatttcactaacagagtcttaagaggacagctttaaaaaatacctcattttcacacatggtccctctttagacacggttagtaaaaattgatttttaccaacgaggcataaagaggcccactagcgaaaacatggaaacactacaaaaatatcagcacagcaagagcgagaagtcgccgagcataagaccctgtttggtggagcttaagattttaagaagcagcaggtgagaatatggagaagctagtaaacccagcttttggcttctagtttattttctggattatacaactacagctttttaaaatatgggtgaaaatctgaattgtttgggggagcttttggcagttggaaattctaggagaagctgcaactgacaggagctccccaaaagaggccctaagtacatttgccccttccttccctctcaggctctctcaac

SEQ ID NO: 270 - DNA, 3031 bp, Oryza sativa
tagaaaggctaaggctcagaaaaagcaatggtcaaaaggagtcatcgttaacaatcatcgactttttaatgataacaacataaattgattgctaatcagtcacaagaacatgaaatagttcttctacacaccaaagcgatttggtacattctgattaaacaatcattgccactactgattggtaagtaaacaaaagctttcaataacatgagaagcctagttgcctagtccaaaactaaagtacttcgtaatgccactgcagagtacaacataaaatcatgtacacaaaggactgttgagtaatagcacattggtatattatttatgaattccagaaaggtcaccatatctacctactgttttaggtaaaactagctgtcaatgaatctaaataaacgattgaagatgaacaagtagccaaagactattcaaagaaagagaagaatttaccagtgtcttgatcaaacagtttccaagctatacgtaacatgcagagtggaatgaacaattggagtgctggcataggccatgtttaacatttgcagattcactgaagatattgttgtcgcatcttgatataaaaggctaggaaggtaattgctttacttggtcacaagaaccaatttggccagagtgcctaatgcattactctatgtttgagcacacattattcactataactgtgtagcattcaagatgatatttgacatattaagaatgaaaaagaaaaggagaaacttacatctgattgtgaacttagatggtgtaaacaactggtgcaatttctaaatgaagattcaaatatcatgccctgttcatatttccaaatctttctcatctcccttctctgggtaaatttcacatgcattgcaatcgccattccataggaaaaatgacggctatgcgcattgcagattctacctggaacagagaaaacagttgttactttagacagaatttccacacagaaaagcattttttcgagaaagcatacctttctctacgacgccgacatgttcgcagcaataacctaatgctatatctcataaatcaacatgataatctcaaacagccacaaagatgcaaaggcaaacttgcttacaacacaagtaggccattgtctacaactttagatgcttttctgacaatttaaaaggaacacatctctgctcaaccttcccctccattcattcagagcacccaactccttgaaactaaaatccactgcctctttcctcctccacattgcaaaccttccaaaatccccctccctatcaaacatgcagcatgatgccatatccaacattgcataccatcctagcatggatttcacaagctttttcctgccgcaaaccgacgcttactcgcatgatctcagtgcattgctggacatggctgtggttgatccatacatcagctgcaatggcagcagcatcaccatgattccagtgactgaagatgaagcaaatgctcagccgatgaaccatggcaatgacgagaggaagaagagaaggctggtgtcaaaccgtgagtctgcaaggaggtcccgggtgaggaagcagaggcgcctggatgagctctcatctcaggtttcagagcttcgagacaccaaccagaggcttcttgttgagctgaatcacatgatctccaagcatgctcgcattgtcagggagaattcccagctcagagaagaagcttctgacctgcagagaaagctcagtgagatgaaaatggaagatgctgaagtagctgctgctgctgctgcagcaccacgaacattagaagtagcttaattaattatttaagctagttctaatgttcactaattaattgcagcatatcatggctagtagccttggagtgttgcatactgcatagttgtactactaattaattataggtgaatattcttttttttttatttttatttttcctttgtgcaaagagagcatataggtaattcgagactactacctttgtattttgtactaatatcgattgaattgagaatggctgaattctcctcctctagatatgtcaaaagaatatgacaaaagaatttaaagatgcatgtcatttcatttgatagcaccttttgactggtcgattaagagcatgtcaattgtcaatcagtcctaaacgctactactaccaccttttgttgggcattattgccctgtactttatccatgattgccagtgttacatcaatttcaaatggtaagcatggctgatgatgttttttatgtacagagcacagttacatttggcaagtgttataagagcactttcagaaatcaaaagatgcataccaaaactgtaataagacagttctgctcccccctcagaaattgcaggtctgtgacctccaaagagaggtaaagagtggtagagaagagattacaaaaacaatttgtgacaattaaacccatctaatgcgtcataaaaacaattaaacccatctcaatttgtcagacagacaacttgtcagagagaacatttggggtagctatcacatgtcagaagcaatctcctgggcgatctgataaaagattcaacaaatcccaaccattacaaatcatgcattcgaaggggaattctgttttcagcttcagaaacaagaaaaaggaactgtagctaatcagattagtgcaagagccttgaagataaccgacaactcatcattcatacgagccgaagaacgagaaaatgagtggatcgaactacttagttttgtacatttacagcatatcataggacaacaatatgctgagtgttagccaaaatgttggatgccggtacagttttcctgccaacattccaagggagttggggggtccctctacctacgtcagttcagtttcttgtcttagctgcctgatcatcataccaaatactgggaccgcatcaaaatgaagttttctcaggtccattttctaccacacattcacttgcgccttcagcacccatggttgcgctgtctccacagccctgtcaatgtaggaggcaatacatcacattacaacacagc

SEQ ID NO: 271 - DNA, 7065 bp, Oryza sativa
cgctgtcaggcggccgcccatctacgcctgtcggtggcgcgcacgtagccgctgctggcgcgcgcgtagaagcctgcgcccggcgttgaggccctcctgctctcgcgtcgtcgtcgccgccgcctcgtcgcccgtcgtcggccgctggactcccgcctcccccaccggcctcctcccaccggccagctgcccctgcccaactgatgaggagaaaagtgagaaaagaagagagagatagaggaagataggtggagaggggaggggaagaagaggctgacatctgggtcccatgtgggtttcatgttgacttagccgtcacgtaggataaaaccggtgttaaaaccatcgaaggatctggagtgcatgatttttgtaagttggaggatgccatgtatctggttttggttttgcggttgagagacgattttgtaactcgatgacaagttgagggacctgtggtgtactttttccttatccaaaaggcctaatgcaaagcagttaggcccttcccaccaaggccacactatccagcccaatgctaggtgctccctctcacgcggcccgcgtcacggctgattgcctggttggtggtggttccaccacgatccgcaccgtccacctgtcccctcccgcccgcacagatgctcccacctcgcgtcctcccatagggcagtccgtcgcgtcgccacccgtcagcatcgtgcggatgccgccacgtttcgcgtcccccgcgcacaatcctcccccccgtgtggtccccaccacgttgagtccagcatcccaaccaattgaaccaaacacgattaaaataccttatcccactcgacccaccccaccccaccccgcagatcccccacaccactgacaccccggccccactgcgaagcccccgcgagatctgatgaccggagtacgagtggtggaccaatcgctgtgtgcgcggtgcgaaaaggggaggaaggagtatactaaaactttattacccggcacgcactaatcgagattggagggtgtcacttcgtcgctctcgaggccggcgttttaaacgccccccccacacggctcctcgctgccgacacctgtccggtttcctctcctcgcctcgccgcggcgcccgcgtcctcctcaccaacgccagagctccacatcccacctctcctcaggttcccgtctctgatccctcgttgcgttacggggaagcaggcgtggtggttgctccccgtgcggagttttcgattggtttggttgggtgagtttggtgctggggtgttggggattggttggttggagtttggagatggattttccgggagggagcgggaggcagcagcagctgccgccgatgacgccgctgccgttggcgaggcaggggtcggtgtactcgctcacgttcgacgagttccagagcacgctgggcggggtcgggaaggacttcgggtcgatgaacatggacgagctcctccgcagcatctggacggccgaggagtcgcacgccgtcggcgccgccacgacgacgacggcgacgacggcgtccgtggcggcggcggagcacgcggcggtgggggcgccgcccgttcagaggcaggggtcgctgaccctcccccgcacgctcagccagaagaccgtcgacgaggtctggcgcgacatgatgtgcttcggtggcggcggcgcctccaccgcgccggccgccgcggagcccccgccgccggcgcaccggcagcagacgctcggggagatcacgctggaggagttcctcgtgcgggccggcgtggtgagggaggacatgtcggtcccgcccgtcccgccggcgccgactcctacggcggctgctgtacctcccccgccgccgccgcagcagcagacgccgatgttgttcggtcagagcaatgtgttccctccgatggtgcctccgctctcgctgggaaatgggctggtctcgggagctgtcggacacggcggtggtggtgccgcgtcgttggtttcgccggtgaggccggtctcgtccaatggcttcggcaagatggaaggcggggacctgtcgtcgctgtcgccatcgccggtgccgtacgttttcaaaggtgggctgaggggaaggaaggcaccgggcatcgagaaggttgtcgagagaagacagcggcggatgatcaagaacagggagtctgccgcgaggtcgcgccagaggaaacaggtgaaaagtcctttttgttgcaacttgcaactgtttagcatttacttgtcgaattgccttgccttctagtacttgcctgtagtgacatgtgtagcacatatattttcccttttaagcatttcttttcttttcgatgcgacaactaacaaatagtaataaccgtgagaaatgtttatcatcatgctgatcgttttatttgctaactaggatatgtgcctcatatttgcaaagtttatgctgtatttggttcaaacatactgaaatttaattagtataaacgctataaacatatcttttgcacgtattaagcctagcctaaaattagtatacacgctataaacataaaacaaagtggtgtttataaaacataagcatatctttctccttgctaagttgctattgatgttctaaaactttttgtcattttttatggatttaatttgtgcttcctgatatggagcaggcatatatgatggaattggaagctgaggtagcaaaacttaaggagctgaacgatgaactccagaaaaagcaggtactctccatgttctgtttacatttctagtttgagttttgttcgttataatttggaaatacttcttcatgagttgaagtacgtagtacactttggtaatctttaaactttcaaacatatggaattccaatgaagcatttgatgctggcatattattcatttgcctgtgaactgccactctttagattggggatttgatgatacgccattgatttcagagggacccttgtgtcactgtcacatggtggcaagttgctaatcatcaaactaaaaaaattgctgttttgaaatcttaaactatcagtttttgttattctcaattgtcactagtttgccacatgtccacttagtttctagcagtagtctccagagcatttgaccaagtgaggtccttaccaatagaaatattataggtgttttcatatacttcctccatccttaaaagagtatctttttagctatgaacatagacaataccactcttttagtgacagaagttgtattgacgctatactctagtgtagccccttactttatagtctactcttgaaattggaaactaattctaaactgacaagttaccatgaaatatgttccacgcttgaaagttagttctaaacaaaactgaaggcatggtagagtaatcaaagtcggttccattttaaactgtttaaatagtttggtggtggactgctggttagttgcttgccttctttgtacaggatatttcattttataaattgtaatatacgtagcttatcatgcatcttaattgcaagtctaactaaaatagtacttatgaatgttgcattgcacccacacccacaattgtgattatttcattttgcactgtcttattacattctttgaggtttgcccttgttttgtccgcctttcatggtaagtacttctgagaaggaaaacaaaagaaaggctttacatgattcaaacataagtgccttaagacctgacaattctattcccttaggatagtggactagtaggcagtagctactctattcatttgattatgctttagcatttgaacttatttttatgtattctaatgtgcaggatgaaatgttggagcagcaaaagaatgaggtaattgcttatcttggaaaaaaaatcttttgctctggataggtactatgttttgcttattaatgtcaaacaagaaacaaaacgaagctgtgcaacctaggcatgctctgttttactgatagcttacttgtttaccaaaaagttttactctgtaaaatctgatagttttaccctttacatgagtattacagcctaatctgtcaatatcatacatatgctctgctctatgattatttttcgctcgtaatgtatggtgtgaattttaacaattattgttaggaaaatgtatgctgtgtatattaacaattattgattcacttgtttgaatgtcaaacgttatgttctgattgatagctactggtcgtgagttttggctttcacactattaccttatagtatgggattttaagcaatgatgaagtaaagctttgtggggggttgagaaataatgaggcaaggactgatgtcgatgtgattgattgcattttcctacatcaggggttaggtggcagcatttaaatggcttaaactaaaaaagaaattctttgaattgatcagtcaactgccatcattgttgaattataaccatttaaatgatatttcatctataataatacagttttaactaaatgcaacattggaagggcaagcaaatattaaagtttattcaaaaaacagttatttgatgtgtgtatagtttaatgcctatgtttccatcgtagtggggtataactgtattttccacaacataacacttaaaaaagttatgacaggatagacaattgtgaaactgtcaatattgtttgttacaatcaatttaactgacaattttgactgaactttacatgaagttaacacatctctcaacactgtaaaatctgtggatacctccttaggccaatcgttgtaaactctgctgagaagactgactgttctctgtaaaaagggatatgttctcataacactgaggcggcagaatttcaaaccgcactccctccatgtcctagttgtttttccacatcttagaccactagtttgaatgtgtacagaagctaagggagtgccacaaatggtttgaaacttagaatcatcagttttttagaggctactctaaccctgaaaaaatgtggattggacaaaaactgaattactgaatgcttgctctaactaatactggtatgtagcacacatacttggtatttctatttctgagaaagagcctcttgtagactcttgccacttctactcgacataattgtattttggtaaaaaggaaaacaatggagcctctgatgttatcataaactgtacaattcatttttgaaaaagcaaatcaccactcaattctatttaatttatgttgtcctttggttgggttttaatgacttcaaaatggggttccttatttttctgtcagcatactatctgacaattgttcctggtaaatttgggagagaagtttccaagcttttcgtttcctagtttgagattttcctctggcttcaagacaccaccgcgtaaaagtctaataatgcactgttaatggtttctgcaggttctagagagaatgagccgacaagttggaccgacagcaaagagaatttgccttcggaggactctgacgggtccatggtgatcgaagctaaaggcctagttacctgtaactagaacacagtcctttcaatgtgagcagtgatcatagtagttgtaggatggtgaagctgaagacctggttacctgtaactagaacacagtcctttcaaagtgagcagtgattacagtagtagtaggatggtgaagctgccagttacctgtaactagaacacagtcctttcaaagtgagtatagtagtaggttagttcagaatcgccagatcgatctgcccttgtaggccaaccattagtccgtgggcttgtctcttgggcggacaggctgcctgagatattcactcgataggttttagttgtctgagttatatccaagcattgtatgtaacctatttaaccatggtgcctgctacctgtattgtattttgctgctgtaggaacctatgtcggtgttaccatcttgttcttaatttgtgtacttctcttgccattttggataagatgtatctgaacttatacatatgtacttttccttgccattttggacaagatgtatctgaatttacatgaacccattttggacaacgtgtatctgaatttatatgaaccatggcactgggctgtgtgtgtatactgtatagcattgtgccaaatttgtgagaaacggattgcttatcatggataacacttggacaagatgtatctgaatttatatgaaccatggcactgggctgtgtgtgtatactgtatagcattgtgccaaatttgtgagaaacgcattgcttatcatggataacaccacgagcaatgtgggggcgcctggtcatgtggccggccagtgacgcgacatgaatttgggggacgtttcgtgtagctgtccgtctccgtcgtggccatcctactccgggattgatccaactcgctgtccagacacgtgcagcacctgagggggcatctcatttcacctcatcacttcatcggaatagctctcctggagaatctggacaagcatctcacgattctttcaccaattgggtattattagcagcgtcggatagtataacaaacattctcagaggtcacgttagttagtcaggctaaaattctctcagaagtcgcggtaaaatcgtttttgcagcacaggacacacccgcgtgccacttgaagggcactgtcagagccttttctttttacattcactgactttttacgttcactgacagagctagctatagctcttcaattctatcgtgagctgtaggctgtgtttagatacaaactttggatccaaactttcaactttttccatcatatcaacctgtcatacacacacaatttttcagtcacattgtatcaattttaacccaaactttcaactttggaaggtactaaacacagccgtaatgcctgtacgtcgcggcgccaacggacgagcaccgtttgccactcaaaaagagcccgcatcaatgcacgccaattaacacaagattgacctccgggttagtaccagcaaaccttgcacggcgagacggcgttgctgtttactgcgacgccgccgtgcgcctgacgaacgtgacgggtgtgaccctgcgtgtgtgtagagtgaagtgagaaagagacgagagcccccg

SEQ ID NO: 272 - DNA, 7079 bp, Oryza sativa; identical to SEQ ID NO: 256

SEQ ID NO: 273 - DNA, 4230 bp, Oryza sativa
tgtaaattgttaatagtagtatactagtatagtgcagtagaaatcaaaaaaaaaaatcggtgtgttttttgtttaaaaaaaaatcggttcatgctgtggtaacggtatcaaatcacataaatagttatgcttagcaatttcggttttgatcgattgattgttgaaatggtactgcttatttgtatatcagaactaattcactctgatatcacatctctgttatatatacatatggagaagtatagtaattttgaggagatattgatgcttcatttgaggctgttttacccacagaaaggtattcctgagtttatctgttcttttgtacaaaatgaatttccaagttattgtgtcaacacatatataattgaagtgtcaacacatatataaacgtatatgcgtgcaatcatgcatagggctggtggcaagttattataattgaagtgcaaacaaaaattgagaattcaggagtacttctacaagtcaattgtgcaaaaacctgatgtgaacgtaggagttgtctgaaactctgaatgaatattgccctttctgctcagcagaggccaaaggcaagtgaccgagacactgaagcaagaatgatactacgcacttgtgtaatacataaaaaaaattatacaaatacttagaaaatattcactcaatttttactcaaaaggacttctgtaaggacttctaatcagcaaagttctactctgaacatttctttagtcaaactatgctttatattttgattgaaggagcagtagccacataggagttcctgaaacgcacgctacttgggatatatcatcatcctatataaaaaattgaagagatttattattcacaattgatgatgccatcttcagatagaaacaagagtacccgcacgggataacttgtaccaatattatctatccatttttctactcacaaattaaaagcactgtgttcagaaaccacaggtgtcacaggcaatcaaaccaagaacatagaaaatcaggcgcccacatgattcccccaattgccagcagatgctgcagaagattccaaacacatctgtctctacttttatctccttttcctctccactagtattttatttttttgcaatatttttcacactccaaaaccccatcatttttcagctataaatggccccctcctccaagcttcaattcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtagttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtttatatatatgctctgcttataatatatatatatatgtgcacaaaagtctaaagtttgtgatgcatacatagatctagtttattgtttttgctgtcataattgttttactttattttatctttatatgatagcttgcactcatgtgcaggtagaaagcaaaaaacagatgaaaacagaagtgccacttgaaatatctgccaaaaccaactcaataattgtgctgcctttttcaaaaggccccatcatctgtttcctacctaattcgttcaataacactagaaaacaattcatcatcatgatcttccttgtcataaattgagcactcaccaaactagcatcacaaccctgcatcaaaaatcaggaacagaagtctaaacacatatcactaagaaaatattatgtgtcactgaacaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctccatatgtgtgtgtggttatctgaaaatagattatatgattaacatctctatttattttgagtattggttcaaaaagggtagaatgccattttgacatagtttttcttttacctattatttgcttcttactcactccagtgtcaaaattattgacgttttagctaccgaagcaaagtatgctaattcttgacattttggttttgcttgtgcatcttgaatctgcttgccactgcatgcatgtacgcagaccatgtccaaaacatcaaaaatttcgaaactggagggggtatttcttttacacaagtgtcaacatacatgacgaaagctgcagtcgtgacatatgtaaaaccacctttttgttttttcatgtgacctagatatttcgtcaacttttcttcacttatttctcaaggccctctatattgaaagcttgagttttacccttaattgtggacttcatctagcacttcagatttagcagagccatggaagcatttatcaccttttgaaggtgttatgtccaagtctgaacatttagatacagctcaaagggcattttaatttgtatagcatcaatatgtctggaggacatgtgaaatattttctccttactgatttgtctaatgaaaaatctagtatttcagacaaaccttgcttactgaagaaccaaaatgaaaatccaacacagcaccaaccttgggaagaaaagatctagaagatgcgtaagaggtgaagaaaagaaggttgatagctatatgtcttggtacgtactgtagaacagtgggagcacttatcaactttttccaaagtgcgatttcacaatgaaccaatcatcctttatttcgaaaacgaggaagacactgttgtgctttgccaaaagctatgtgctcccacatgctccaattccatataacaacttttgcaattctctggcttcagcaggaaaaaaaattcatttctctgcataaacacctcttggatgca

SEQ ID NO: 274 - DNA, 6058 bp, Oryza sativa
catcgcataaatatataaatgttacaactatctaagtagaatatctattattttaataaatagtaagtcaaactgattaagagtacggtttgtgaatatcaagtaacaaacaccaaagtttatgtggttttgtgtagcctgaacaataatagttggggttttaaaaaatatactctcattctaaatctagtgggtgatgtcatatgcctaagtttataggatgcatgtcatctgcagtactgctcactgacatggcccacatgtcccctcgggtctacatgtcagtgagcagtactgcacatgcaatactgaaggggtctcaattaaagtttatatatccagctcgattgcttggctgaaccaatacaaataattttttggcatcaattggatgtgctagctgccgctgccgcctacggccattttcaattgtcgtagccttttatagcagcaagcacaaccaagcatatcgtctttatatgacttctttaaaatacatgaatctcacctgattttcataagaattgattttgtaaaatttctttagaaaatccacgattccaaaaggtggctaaggtgtatgaaatcatcgtctttctattgagaggaaacaaaaacatcgagtgtagtgtagtttagcacatactccaccctaacatcttttctgataacaccataatttttttaatttatgtcgcacgatacccggcccacgatgagggggagagccaccaactacccccctgctcccaacagatgacgctggctgttgggccccacatccctcctgggctccgacgatatttttgtccggaagccgccgtccgagcaactgacggaagccaacgccaccacgcgtcgcgcgccgattggccgggtggtcgcagtcgccgcctccctcgcgcgccacgtaccaggcagcggacgcagccgcactccgcgctccaccaccaggaggatcctctgcgccacgccgcgcgcgcacgcacgcacgcacgcaccgcaggccgcagcatcatcatcactcgcaatccgcagtccgcaccaccacgccaacggatcgccctcgcgaggcgcaggcagcctctcgctcctcccaccactctctctactactagtgcttttcccaagaaacgcatgtgactcgtggcgatcctgagcttctttgggcgtcgaattcctgtggtgcgcggccggcgtggtgcgttgcttgatgctgacggataggtggggagggaggagggaggcgatggagttcgggaacggcgggtcctcctcgtcggagcgcagggcggcggcggagggggcgacgctggcgagacagggttcggtgtattcgctgacgttcgacgagttccagagcgcgctcgctggtggcggcggcggcggcggtggtggaagcgggttcgggaaggacttcggctccatgaacatggacgagctgctccggagcatctggaccgcggaggagagccaggccatggcctccgcctctggctccgccgcgggggtgggcgtggccgtgggggcgccgccgacgtcgctgcagcgccagggctcgctcaccctgccccgcacgctcagcgccaagacggtggacgaggtatggcgcaaccttgtgcgcgacgagccaccgccggtgggggcggcggatggcggcgatatgccaccccagcggcagtcgaccctcggggagatgaccctggaggagttcttggtcagagccggcgtggtccgagaaaatccacccgctgcgccgccccccgttcccccgccaatgccgccgcggccagtcccggtggtccccaagaccactgccttcttgggaaacttccccggtgccaacgatgccggcgcggcggcgctgggctttgcgccgctcggcatgggggatccagccttgggcaatggcctgatgcccagggcagtgccagtgggcttgcctggcgccgccgtcgctatgcaaacagcggtgaaccagtttgattctggcgataaggggaacagcgacctgtcatcgccgacggagccaatgccttattccttcgaagggttggtgagggggagaaggaacggtggcggagtagagaaagtggtggagaggaggcagaggaggatgatcaagaacagggagtccgcggcgagatcccgcgcgcgcaagcaggtcttaaactctaaattctttgtactgattatgcatctattgctattggaaccattctgtgagagtgccaagttgttgagcctacctcaaaataagatgatagaaatactattggcagtaacttagtttactggagtttcccatggcatgctaatcttagcaactataatcaaactttgtgttatatgagcagagctgttggctagtttgttcatccctgttatggattttgtttaaaagcagataatttcatcaaatttcctgtcttgctaacaatttccttattggaaaaggcttacacattggaattggaagctgaagttcagaaactcaaggagatgaacaaggaattggagaggaaacaggtttctttctgacaaactctgttgtagaatgttgaatggactattagcacatgattaattaagttttaattattacaaacttgacaaatggatatatttgatattttaaaataacttctatatagaaagttttcccacgaaacacaccgtttagcggtttgaaaagcgtgctaacggaaactgaggtaaaatttgtatagtctcctttcagtataaagaacaaggcctacttttagtatagtctccttaagaaggatttatactgctgttctaaaactcgtagcttcagttcttaaaccccagtattagctgctttgcttctctgttcatgttcatgacatcagagggttcaaacagggttcactatgacttgctctttcgaagtaatgcatatgtttctcagaaacaaagcccattgtgtccaacattgagtttctcttttagaataatcttccaatgttgctgcagtaatagtttcaattccttgtctaggaagaaaatttttttcatatctgacatgatgccaacagccctgttgcctacgtacacaaaacgcatattacccagcttgcacttcttataaatgattggtgaacatgtcggtaaattagggctcaagtatcatacttgaagtttatcatttttatagactttttttttattccagtctatgcggaaagcatgcaatcaaccatctattattacaaaattttagggctttatccataggctaccgaccaatgctagcaaatagcactcgtttacagaattcaaagtttggatatgctcatagcgtactcctttgagagtcctgatattttctttttcttccatcttgcaggcagatatcatggaaatgcagaaaaatgaggtaattgctttcgtcgtttgtttatgtcaaatgtgtgcccttgacacttttctctgtttttacagttacaactataataaatgtcaagataacgctatgtgctgtctgcttaattttttactatgtttttagcttaatttcatttcactttctgttgttcgcataatttagtctgaggttggaatgctggatgtgcatttgtgggacaaatgcttcaatacttacaagttacaacacaaatatttcgcacatgtaaactttgcattctctttcaggttattgcctacagatgctatcttccagttcgtttgttgaattgttgtccattctttttgtttcaaaacatttatttttaggtgttatgcttcttgtattcattacatgaagaaaaatctaggtcatttgctgctttcagttaaaacccttgcttctcattgtatgcacaagtatttttacatgctagcttattcgtgttctcattttctcattagtagactactttttatctcgtgtgtttttcatggcactatatgatggattttttttgacataatatatgatggaatttttattaattcttctttctctaatcaaaccatctcatattaatttggtaatttgtggaatccagtcctttttccttattttggtgtggattgtgctcatttctaagaacagagtagttgtgtagctgcagaatttctttatttctggtatatttacatatggttagctaaatttcatgaaaaacattttctgattttcagtactctctgaaaactactattatggtacaatgttatttgcagtttttctcgagccaatatctcccaagaactggagaaaaaattacttagtgattagcattattatccaaatcatagggttttgagcgtcgactcttgcaaaattcaacttccagtaccataccatttcattcagtattcagcgaacctgcttgtcagaaaaaaagtgtggaacgggtattttatcgtattttacctgtgtaactgcttaaattttgtttcactgcttataggtagaagaaatgataaaggatccatttggaagaaggaagagactttgcttgcgaagaacactgactggtccctggtgatgacgagtggtcgatggcatgcaaattcccaccttcatcagcgactgtgcataatttaatctgttgtaaaccaatggtggacgaacttgtgcttgattaatcttctagtttcatttttcctgctagctgattctgagaaggcttccaaaactgacatgtagattatgtgtagacgaatgaagctgtcagaacaacttcctgtaatccttgagaaaacttgtatagtgttgtctaggtttgtatcatgctagtctttctatctagtgtcccaccctagagaccagacatcttggatgagttcagaggtcgatttaagcaagtcatggggaccaagaatcatactgcaacctgcctgatgactagctaagctaggtagtatgtagcaatatctgatatctgtacctgcttcctgaagtatgtattgttatctagtgtatctgatatctagcgtgtaaactgtaaaggagtataagcagacctagttctcaagaaaaaaaagtataagcagacctactaattgcttataagcctgttacttgtatctcgctggccttgcactctttccgttggcacgtttttcaaattacagacggtgtgttttgtgtaaaaactttctgtatagaaggacctctaaaatactaaataaattcatttttcgaatttaaaataattaaaactcaattaattatatactaatagatttcttgttttgcgttcctgtatcatatccgttcttgtgtgtgtcatggtctcaataaagggaatataaatccccgtcgttggacgattccacgtctcttcatatcgtcaaaccggacccacgtgtcatactcacggaatggacccaatcagacacagccaggaaggacctcatttgctagccgagaaatagatttggaatatcgtggaattgtgggagacgggaagagatttgggaattattactgacatgtgggcctattgattttatttatttttttctattgattgtattgccacgttagataaaatcactctacaaaccgatgagggagttactttacactggctaataattgagggagactttgctctgtttaatgagcttaagattcaaaaagcaaccggttaatagccagcttctaagaatctgaaaaaaaaataggtttcctagcttctaacttctaactttttttggattctctaactacatctttttaggcctttcacagtgctccaccctggactggtgctatgggacggcacattggatttttgctgccgtggcgctcgaacccgcgtctcaagtaggaacctcgtctccatgttgagcgacgcaggacttcgtcaaaacgatgtcgcgagcagaggagaagactggaggcacgcgcgctgtgggcgtcgtggcttcgcccacgcgtgccctcgcagcgaaatccaagggcgaaatccccgatacgccctccaaatccactcccaccacagcaaaatccagggcggcctcgccatctcatcggacggcaccgcagctgccaccagggtgcccgacgagcagggaggcg

SEQ ID NO: 275 - DNA, 14351 bp, Oryza sativa
ataagccacacatcctcatctggtactccatcgtagtaggctgtagacttgtagtgtaccaaaccaagaaaacaagaaaaaaaatgttgtgttttaaaagagtgattttacaatgcttgaagaggtaccgggattataatttgggacctcacgatatcttcggcactataagttccgaaatttgcattaaaattttggtaaatctaagtacttattaaggactataaaattacttttcaaaaagataaagtactttagcaaattctcatcactcccagcgtattcaacggattcggctatatccatttggccctgctgcagttcagaataagggttgaatttattcaaatatcataatatataagtagagactatttttagggcatatacaatagtctttattagtgatctctctctattgttatgcaaataaatttgatgacataaaagaaagagaaatgaatatggttgttatgcatgacaactgctcagagttgactcttagcatttattagagcaaattttgttgcatggtgatgaaaaaaaggaaagaagagtaagaaaaagtatttttatatattaatgattatagaccatattgtctctaactgttgtaggatgctagtctctagataatataaatctcatatctaactgtatctttgtacatgcacttaggtcgccaaaattgggttacatgaatgagacggccgagttacggtgatgccatcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgaaattttaagatcagctgaggtcttccaagaacccatgttcttggaaatcacatgttcaagctttaaaatgcattgataaaaggcggatatcatggtagcggccattttaaaatgcattgataaaaggtggaaagaaaaaaaaaacatctccaagtgtaccttggattgtgagaacgataaatattctaacaaaaaatttgaatgctagaacgacaagtaaactgaaacaaagggagtattagtgaagattcaaagcagtagtaagtaactaatttgaatgttcataatgatgatattgtaacataaacaatgatagaatataaggtttaaggttaagttttcataacacactataccatttatatttcatttccggagtccaaacattaccgaatcggaataaaatggtccttacaaaacggggacaacctatacggtcaaaaatctcaatatggttttcattcatgttttaggttgtgttcttttggcagttgagaacattttcctagcatgcaaaacgaagcaatggacaaacgtatgattaattaagtattagctaaaaaacttaaaaaaatatatcaatataattttcttaaacaactatcttatataattattttttaaaaaaacacatcgtttaactgttcagaaaacatgcgcacgaataatgaatatagaacttgggaagagggagtatagaacacacctctgctaccgtacgtaaaagtggcgtagtggtagaggcactactacagaaagtgtttttcagtacaagggggttattagtttacatgcgggcggcttaaaccttataaatttctgtacgagggggtcatactatggtggccaaaatctatctattaacttataaaagtaatagaaaaaggaggctccaagttcgctcttatgacttaaaaattctcacattaattagagaaaaataaaaaaaagagtccatattaaaatacattttataaataattaaaatttagaactaaaaaaataagaaatatggaagagaagactagagtccatgtagatatacaatttagaactaattaaaatttagaattaaaaataagagattaaaactagagtttagagtctatatacaaatataatttgtaaatatataaaattcaaaattaaaaataaataatattgtaagaagagtctagagttcatgtatataaaaaaaataaaatggctaaaatttgaaacaaaaaagaaaatattaaaagatgggtttagagtccttaaagaaatatattttacaaatgaaataaaaaaaaagagtccatattaaaatacattttataaataattaaaatttagaaaaaaaaaagaaatatggaagagaatactagagtcgatgtagatatacaatttagaactaattaaaatttagaattaaaaataagagattaaaactagagtttagagtctatatacaaatataatttgtaaatatctaaaattcgaaattaaaaataaataatattgtaagaagagtctagagttcatatatataaaaaattaaaatagctaaaattcgaaaaaaaaagaaaatattaaaagatgggtttagagtccttaaagaaatatattttacaaatgattgaaattcgaaatgaaaaataaggaatattgaaagaaaagactagagtctaggtatgcaatttagaactaattaaaattctgagataataaaataaaaataaaagtagagtttagaatccataaaaaatacaattttttaaatactaaaactcaaaatttaaaagtaattaatattggaaaaagagtttagagtccatacagtaatataatttaggaatagctgaaattcaaaatttaaaaagtaaaaatattgaaaaaggggtttagagtccatatgtcagtgttacggtccaccttaggatttaggaacataaactgacacatcacaggtggccatcttaagctaatgggccagccgcccagctcgtttctatctgcaacataaggcagaaaaccaaggccttgacatttcttttaggacacacgggctggaacggccccggcccaattaattaaatcctgctattgaaaaagggttctgtaattagagttcctactactatacatacttccgcaaggtaatctagcacccaaatcaaactacagccaacgtgtatcatcagtagattccaccccaagatcgtgtgcccgctccgatcggcagaacctaatcacgaccaatccgtcgccaacacagccacaaacccacaattacgcggcggtgcattctcgttgctttgacggcttcgctaaacgaaagatatttaccgtggctaagcaagccctgatcacacgttccacacctcgcagcgccaccacatccgagccgatcgaccggcccaacccccccgtgagacagactccagaggccgcgagcggtggcatcgtcatcgcaatatcaaatccacatccacatctccatcgagcgatccacccacaacctgcaacggcgcgacccaaccgcaaagccgctcgcattgaaacccgcgtaggttgccttcgttttccgccccgcggcggcccatcatccgcgcgcgtgtggaccaggacgcgcgggcggggaaccgttggccacggcgccgcggcgcgttatcgcgagcctatccgcgcgcgtgtggcgcgctgggtgggtgaggcgccgagtggcccggatccacccgcccagccgggccgcacgccccccctcgccccagccacccggcgccgcgaacgacccatcaccagtcacgtacgcaccgctcggcgctcgctagctgccaccatctccctcccgctgtccgggggcgctggttgtcggcacgcgggggcgcgggcgtctatttgttgcgcgcgcgggcgcggcggcgagacgcgtgtgtagctactgctataaggagcgcgccgtgcaccgcctctcacaatgtcgaccgccgccgccgccgccgctgcccagagctggtgcttcgccactgtcaccccgcgctcccgcgccacagtcgtcgccagcctcgcctccccatcaccgtcctcctcctcctcctcctccaacagcagcaacctcccggcccccttccgcccccgcctcatccgcaacacccccgtcttcgccgcccccgtcgcccccgccgcggtacgtgcattatgcatggtcacgccacccctgcagctagctgcatgcatatatacacgccgcccggcacccttcgatatctcaagcttttttgacacgttcggtctcatgctaatttagctataacaaggctgcatatacatacacgatacgtgcatgcacgcgcctcgtgctgcattaggcccgacacatgcacgggtcgtacgtagcttgcattcctgccgctctctctagctctacgtacacacaacatgtcatttggttttatccatacctgcaaactgtgcaagaatggctacatgcatgcatgcatgcactgcagtgttatatctaagactaatagtctaatactgtgtgtctaattgtccatacctcgaaacatagttgtttatgcgtcaatcccacgtaccatcatcacacacaccccgcaactcggcaaattgtccaactaagcactgttccgtgaccaccgactctcttagttttttaagcaatcattgaacagtgtacagcaaaagaaaatgtatgttcaatttttaatcaacactgacaacatataggagtatatattgcatattgcccttcttatgcttttttcccaatttgttttctgtcaatcaacgtgcacgtcaacaaactctaaatagaatattcgggaggagaaaaggttcccaaacagttggccaattatattgttcattagagataagaaagcgctttggatataaaagatacccccaaaagtcttgagtggaatgaacaaagctccaagtacattaagaaatcaaacatctaggcggcttttccctcaaacgataaggtaaagttctagcagggacagatagtgttcgttttctactttgtttctttttcgcttgaggagaagcgtccatgatttagctttagtaatggactgtcgagtcactatcaacttcgttattttaacaattatatattttccattttattttgaaaaatgatacggagtattgtctttagtttctcaagccatataaagatcatagtatctagtatatacagaaatgctagaaaggtcaagtttgctgtttttctaggcaattttttatttctccaaacattaaaaagggaatttcactgtaaatggttgaactcaaaatattttttatattaattttatttcgtacgtggtgatctgacttgttggggtaaccagtacaagccctgatttttgttgcagtcaaggtcaggctgagcttgacgttgaccctcaccaaaaattgagtggtacaaaaccattcaagaccattaactgatgttagatgcacagatgagatgtcaacaagaaaatccacctgttatcaaaaccggtttgaaatgtttccttaatatttagggaaattgagctttcattaatcaataccggcgagggtacatccaacatgaaaatatattttttttatttaaagagtcatattgggaattaatttctatcaattaagctctaccaaaatttgcctaacagtactgaaattcctggttcatgtatacaagacaagccccaacattaaaactagcttgcaatactgatttgtcaacctatacagtcatacagacgcatacccgaaagaaacacctactctgtaggaatatgcctgtggttgcagttaacggattagggaccaaaaccttcccatcttgtggcgaaaagctaattgtaccttgcatgatgtactactagtaggggacctctatgccatttgtgtttagtcaagtaatatgggcgcaaagataaggaagattccgcgaaagagtagttggccgattggctcttccagcttgcaaagcgacctctcgccttgccgaaaacttactgttccttttcagatcagcctaagtgcctaactctcccgttaactgggatggctgcatactgatgcatgcagagtagttagcagttgtttttgtctaagtactgcagatagatggataaacagaaaaactaactgctgagtagtgacaagatcagttccggattaacgcgccagattgcgcaaatccagcatagattgtgtagcttgctcccgtactactggtactgatatagtagttattcaggcatatgggatactatgaaatggttcttggtctcgtttggagctattgtttcttggatcacggagccagtagctgctccatgtactttggtcacctgatgcaccaggcaaaacggctcttaagatgtgaggatgcagtagaaaactgctcaacctggcaggcatcctgctgacgcttccgaggcccaaacagcgcaaacaacttgtagcacttggatcaccccagaatcccagataaatcttgctgctgggttcatgcatggtgaaatctgcatctgatttagataatcttgtatttgtcttgcaaacaaatccactttcaagatttgtctgatgcgtgacataagtatagtagtaagaggttgtcaatgtctgcaaagtaagagaggaggagagctgatgatcgaatcagaattttgtgaggtcgtgaagttgcttcagctttaacttcaactatcaacaatcagatactccacaaaagaagtgcctaacgaggcaaccctactgctaagtactagcacacacaaacactagatcaacctgaacctttttccttagcgcgcacatgatttaatcaaaacaactgccattcttccacaataagaaagccgtgcacgcacacatgctagttagctagtagtttcatttctgggatcaatagtatagccgtcacgagtcaaattcaaaaagaaaaataaaggacgatccacacgaccgtttatatgtgtatacacactagcaaggagttgttgatcatctggatgcatcgacttaaggaaaaaggcatatgaccatttcgtgtgactaatcatactcccttaaaattaatcgatctccatttttgtaatcataatcctgcatcatgcaaccccatttcttacttgctctgccaaaggaaggaaattaaacaaaacccgcaaaattatgtttggctgaacagcataccaaaacagggggagggctcttgccattccgatcggccatttattttggccacaaaaccagcccctccatccatccatcgctgctatatttttacctctttgctagctgctccaactcaccgcgttccacgtggcgcatgcatgtttgctagtgatccgggaggccgcgacgaccgccagcgaacggaagggaaaaaaaaaagtcaaaaactagagccgatcgtttgatccattcgatatagggaagatgagtggatgcctctgcctcccccgctataaaaaggccccaaacgggacgccatcgccaccaccaccagcagcagcggccgaagcggaagcagcagcagcagcagcggcgacgaagccgtccatagattcttcttcctccccgtcactcctcaccaacaaccatcccccaccctccaaggtccgtccccctgtctcctcctcctcccgcaccatccgtcaatacagttactgctctcatcatcatccatccatcctcttctcctctctctctccttttcttgattcatccgtcgatcgattcgcgcgggcgtggcttccttttttgttgggcaaagagaaaaaaaagggagatcctttgcatccgctttagatcgccttttgtgcatgcctcgcgtgggcgcagggaacccacaacgacggcgatatcctcctctctcgcatattttcatgatgcatatgggtgtataaaaattttcacgcgtttttgtgtgcgtgtgttcttggtttgggattgggatggcatgagagctgatcggtgtgattaattatttttgcttgcagatggacgccgccgtcgaccgcctcaaggatgggttcgccaagttcaagaccgagttctatgagtaagccccccttgcctatagatggttaatttgagaagaatttgggtagccgcgcgcgcggcgtgagatgaaactgacatgatcaccttgctgtttgtctttttgtctcctccgcagcaagaagccggagctcttcgagccgctcaaggccggccaggcacccaaggtacgctgctccgtccatttcctgctcaaaatttgttcttctttgtctactagtgagccaacccagccagctggagttttacggttactcctccatggccgctacaccgtccatccctcagctcgcaaacctcgtcagcaaaagaaaagccccaaccttttacccccgatctctgcggttgatttggggattcgtgaacacaccttggcccacagattcctaccggtctagatactactgctactcccaggtagaaagtacacgcatgcttgcaacctgcaagcaaggcaaccaggcaaagcatatagccttgtgtttgcccatccggtgtacactgtttacggtgcccacagcatatatggccatcaaggtcaaactggacaaaagttagcagcaactggcctgtccaagttgcctggccaaagttatataagaggatgaacagcttgtcgccggcctgttaggccggggctggctgatcagttatatacgaggatatgataagtacaaccaagattataaaaagagagagggagattagattagattagaatgctccatttggcaggcgtacgcagcgcaatcttaattagtagctcgggtattggtaggccaggcaaagaagctgctgtagtagtggaaatccttcctcataatgcacgcacccaccaccgaagaagacgaggctcgcacctagtaacatgcaggatttcttcaccgtcccccatgtgcttgcccatgttgtgtttccgccgagatgtcgccttcctcgtatagggtttagcatccatcatcactactgttttccttttgatttcttcgttgcgtccagcttaattttagaatagtaagagcaagtttaatagtacagccaactactaactccaattcatatatagctaatctagaaactcattcatacaatagttacatactacactactaatacctgatcccacctgtcatacacacactgtgtcttggagtccgtgctagagctggctacaaatttatagcccactgcttttctctctttttatttagcttcttaaaatatgtttacagctagcttatagcatgctattgtacatgctctaataagctaattaggtcgtcgatcgaggctagggtctcctggcagcgcctcggtctaaattggcgtacgtcgtcctaacatttgggtacaaaaatttggaccggccggcaacctcgctgtacgtgttgatgaatttcaaagttcatttggacacggccattctcatggggatactgcaatgatgcccaaattaatttgggcgatatcatcgtctttgctgaccccacacaagctagaacgtaccgtgaaccacaagttctcttttgtttatagcaacggagaagaaagaaacagtggataaagccttgcagcttgatatactccatactatagctgtagctaagcaaaagtatttcctgtacgacatggcccggaggacatcacataattgtgggcccagcaatcacgcatttgtttgcacgtccaactcaacagcctttaacgaaagtttaggcgcatatccaaccttttgcttacactacattttggcatctgcctcgctatacagtaacttggattggccagccacacgcattgatgagcaggtgcaaaagtccagcagtttgcattacaacatgcgtacatatatactttattaatatcaaatctcctctcccggaaaatgatggcccccatccaaaaacattaatctacgccgcaactgactgcctgctgctgctgctgccgtaagcccgtaatcgatcggccccggcaatttgctaaagggtggggcctgatcgccatgagcatgctttggatgcgtcagctcgcgtcttaatctaatgctcggttatttggccgtttttgtctccgtcggcgttgtcgccagtgggatcgttagttcattaggattagtactaatcagcgcaacagttatatgccccccatgggccatgaactcatactcgtccgtgtcgtgggttatccttgcgtatccgttctgttttctgggtggaaaaagtggtcagggaaaacagagcagacaggtcaaaaagctggcagctttgggggcaagagaacgggaaaaaaatgtcagattcctgtgggggttgtgggcactcggatacgcctatcagcatctgctgcctccttatcgataagagcagtagtggtagtactagtagaacagatgctaatcgcctaatcctaatatgcttattgatctcctgatatggctgtgtaatcgcaaaattactactccactactagttagtgtggagtaatgaactgagctgattgttgggacaaatgcagtacatggtgttctcgtgcgccgactctcgcgtgtgcccgtcggtgaccatgggcctggagcccggcgaggccttcaccgtccgcaacatcgccaacatggtcccagcttactgcaaggtaaccaacttcatcgtacgcgttttcgtcgccggccggtcgattggtaagctagctattccggtcggtcgccgcggtttgcattgattttgacccccctcgtgtgtgtgcgtcaactgcagatcaagcacgctggcgtcgggtcggccatcgagtacgccgtctgcgccctcaaggtcaactctctctctctctctctcacagatagtgctctattatgtcaactatatagtacccgttgctctaattgtgccggcaacttcacacaccggatcagagaaaaatattttcgtacaggctgagaaaaatgggtcgtgtctgacgccagatggtgtgtgaattattttattgatcaagaagaatcttcccttccccacataatccatccagcttaggtttatgtagggtgtgtaacattcatggtgaaggtggtacttgcgttacatatgaatcttgtcaaatcaagcagggagcataattagcgcctttgtttagtatatttggacggtgttagtaggaaagcaccgtactttggtgaaatctattttatgctcatacagcacatgtatgcgtaaagtgtgcgtgcacgatttgattgtggggtattgacctggatcgaataatctgcaggtcgaactcatcgtggtgattggccacagccgctgcggtggaatcaaggccctcctctcactcaaggatggagcaccagactccttgtaagttgctgaacaaaagaaaacttagtgatagtactatagtattggcaacttgggcataactgtatgcagacaaacaaagggttgaagaaataaaaatgttagcgtgtcttgatcatcgtttgtttctgactcgggtttgcactttgattggttcagccacttcgtcgaggactgggtcaggaccggtttccccgccaagaagaaggttcagaccgagcacgcctcgctgcctttcgatgaccaatgcgccatcttggagaaggtaacgcacgtactagtagcatgacaaccactatgcataaatcaaaatgttaaatgaaattggaacatcagaattaattacattcataggaaggacaatcgaactgtctgaaacttgcgttgtctattcaattcagcactgactgaatttctgcgtccctgatcaaaacaattgatctgatgatctgcaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggtatttctcgctggcgccagcattttcttttggtgtgcaagattgtcaaaaagctagatatcgtgcaattttttttctcataaaaaaataataccaaccatcatccacatgtacaataaggttgtgttctttcatgggtgatctggtgattgtgagtgagttttgtttcgtttttcgcgcacacgcttcccgaactacaaaacggtgcgttttttgcgaaaaaaaactataggaaagttgctttaaaaaatcatattaatccatttttaaagtttaaaatacttaatagtcaattaatcatgtgctaatggctcacctcgttttacgtatctttccaatctcctctatctcctctcctcaaacacagcctaagaagtgatgataagtagatgctataagaagtgatgataaatgcatataaagaagagaataactaaaatggtgcttctatacatcacccctaacatgagttgcattatattccaaaagcaaattagcatccatccctgggtcatgctttaatagctatcaaaattgtatcaatgcttaattcagaacataattaaggttcattgctgttgcaggctaatactaactgattatttgactatatagttctggttgtaatcggaatatatatacacggtttatagctcaatatcatctttttactaatcaaagaatatttcgatcaaaacaatttgccacctttcaacatttaatatataaattaggcttctgcccaactatgctgaatcgtgaaacaatattaatctacaattattaacgtgctttagttgtcgcatgtcaccagtcatctaaaatggtctatatatatatagcatatactcccttcattccaaattgatctacatatagttttttttaaggttattcctaaataatctatatatttgtgttcattcattaagtctattcgttatttgtgcactgaagtaaatagacattgatgcatgtatccatgcacacaaatt

SEQ ID NO: 276 - DNA, 3895 bp, Oryza sativa
gaggtcgtggccgggcgggcgcgagggaggagctcgccgggaggtcgcagccgaccgggagccgaaaccaagatcgaatgttgttggctgactagcaggggaggagctcgccgggaggccgcggccggccgggcgccgggaggccttggccagccgggcacgggggaggagctcgccgggaggccgcggccggccgggcgccgggaggcctcggccagccgggcacaggggaggagctcgccgagaagccacggctagtcacgtgtgttggaggagctcgccgggaggctgcggccggccgggcgcgaaggagaagctcgccgggatgagaagggcgccgccgcgcggccgaatcggcctccgcgcgtgcggctgcgagaaagagagaggagggaggaagaagatatgaaaaaatggggctgacaagtgggccccaccatttgttttattttagcatttgtcacttacatgtgggacccacttctatttttaacctggctgccacatcagcacatttgaatcaagtcaacctgccacatcagcctaaaccacttacaaaaccactcaaagagtcgatttgcaccggttttggaagatgggggagacgttatatccaattttgcgtttgagggatatttgtcgaccaagggcgatagatgagggaggaaaatagactttgcagatgttcattcggcctaggccttaatttattattcgtttgagataatgggccgggcctagtgtgaaagcaagcttaaaatcaccttctcaatgggcccaataataatattatggtgctctaactcttccacccagtgacccaattaaagtacagtaatttagctgagatttatcgcatcaatttatggacgccaatcaggagacgacccggtggccgatggatcagcagttcacgacttctcggccacacaaagtcagagaaagagccaaaaatgaagaggaaaaaaaattctgggaaatcagccaaaatgtcgtgagccatagacatcagttcaagccgccggcgtgtgtggcccagaagaacatcgctgcgctgtacggcgaggcgaagccatggcgcccctttcggtgtcggccatcctcgcgccgtcgccgccgccagcccaggcggccgcaagggcctcgccgcgccgcgcgccagcgagcgccgcgcctgtcgccgccgccatttcgacggcattgcttgctttgactcctgccgcgcacgccgcggcgttctccaaggaggacgtcgccggctccgtgaccaaggtacgcgaatggcgaatgccactacggtgctcgctctcgtcggaactctgaactcgtttcgcggcattgtggccagagtgcttgattttctcgatgcgtaggtggtggacacggtggaccaggtcatcggcgtcggcggcaaggtggccgagcagtccgccggcgtgctcaaggcgctgggcgaggccgcgaagccggccctgcctgcgctgaagagcgccggcgagcaggcgctgaagctcgcctcgccggtggtctccggcgcctccaagcaagccacggaggcgctccagggcgccggcgtcgaccccgcccccgttctgtccgccgctaaggtaatacacccgacgtctcagccgctccgagcaaagcttctttgatcagctccgtttcgattcggtgacgatgctccgtttcggtagaccgtcgcggacgcggcgcagcagggcacgaaggtcatcgacgccgcgaagcccatcgcgtcggcgacggtggagaccatcgggtcgctgggctccgcggactacgtcgtggtcgccggagcggcgttcctcgcgtacctgctcctgccgccggcatggtccctgctttctttcactctccgcggctacaaaggtagcagcacagcacattgcgaattggctattgaattgcgcctcttgcacgctttgcttcgttggatgattgctcacttcttttttttttggttaaggtgacctgaccgctgcacaagctctggacatggtgacctcgcaagattacgtgctgatcgatgtgaggaccgagaaggacaaggccaaaaccggcgtgccacagctcccctcgaacgcgaagaacaagctcatctctatcccgtatgcatttctttccattcctcaagtggcacatagccattgtttttttccatggcaaaatccaaaacacctttgcactgatgtgatctcaggctggaagagcttccaagcaagacgaagagcatggtgcgcaacgcgaaacaagccgaggcggagatcgccgcgctgaagatctcctacctcaagaggatcggcaagggctccaacgtcatcatcatggactcgtcggtgcactgaaaccaagcgatcgatcgtttgaattgccctgtgatcgatgaacgacaattctgaacttacattgatcggcgcctgcaggtattgcgacagctcgaagatcgtggcgaagacgctcaacagcgtcggattcaagaactgctgggtcatggccggcggcttctccggcaggaaagggtgggcgcagagccggctcgggacggactcgtacaacctgtcggtcgtcgaagtcgtcacgccgtcgcgggtaattcctgcggccgctgatcggctcgtgacggcttcgtcgtcggcttcacggacgaccacgagtcgtaagcttcttcccggcagcgtggacggctgaaagaggctggaatagtcactgtaaatcccatattcacctcatgttctagttgcaactctcgttttttttttggggtttttcagtaattgaaaagggagaatccgtataaacaatagttgtgccatgtgtgatattccaaatcggtttgaatcctgtgaaaaaaaaagattggccccagctttccattcatgcatatgcttatatgaatcgcttatctattatattattaaaggaatagaaaaaggagcctccacgttcgctctcatggtctagaaattctcacattaattggagaaaaagaaaatgcagagtctatatagaaatacaatttagaaatttttaaaattctgaattaaaaaataagaaatattagaagaggagactagagtccatatagaaatataatttagaaatagctgaaattcagaattaaaaaaataaggaatattagaagaggagactagagtccatatagaaatataatttagaaatagctgaaattcggaattaaaaaataaggaatattagaagaggagaatagagtccatatagaaatacaattaggaaagaactaaacttcggaattaaaaataaggaatattaggagtagagtatagagtccatatagaaatacaattaggaaataatagaaattcggaattaaaaaaaaggaatattaaaagtagagtatagagtccatatagaaatacaattaagaaaaaaaatagaaattcggaattaaaaaataaggaatattagaagaggggactagagtccatatagaaatacaattaggaaataatagaaattcggaattaaaaataagaaaaattagaagtagagtatatagtccatatagaaatacaattaaggaaaaaaaatagaaattcggaattaaaaaataacaaatattagaagtagagtatagagtccatatatgaatttaaaactaactaaaattcagaataaacataataaaatgaaaagtagtgtttagagtccgtaaaaaaatacaatttacaaataactaaaattcgaaattaagaaaaacatggaaagaaaagtttaaagtctatataggaatacaatttagaagtaactgaaatttgaaattaaaaattaaagaatattgaaagatgagtttagagtccacatagaaatgcaattataaataataaaaattcagaat

SEQ ID NO: 277 - DNA, 5206 bp, Oryza sativa
atgtgaaaattaaaagttttgcaactcactgtatttcggtaaatactgccatccagggtacaacccttctttttctgaatcttaagcgtaaaaataagaggaaaactcctttgttctgtcagaaatgtatagccaaataaaagatcaaaacgtttcttgatacctcatcccattttcttggtatattaccaagaagccggcttgctgccaaccgttggcctcgtcagctgatgtcttctccatgcgtctctgacgttgtgttcgtccgtaatgctgcatacttccttcagataattaaattgctaagtttttccccttctatcaactactccttccgtccagaatataaggatttttggggttaaacataagtattaagaaaataggtagaattaaatgggagaaggttgtaattggttaagaagtggaggtatgtgagaaaatttagtgatggaggattgtgattaattgagaaggagaatgctggtgacggaattattatatttttgggacaaaccttgagaactatatgttattattatgtctacgagtatcatctagccgcatcatgcatcacctttggattcagacatccagtccatctataaacaaaccatttgatgtgtacaagatgacgtttgacacttttttttacatcaagcacaaactcgtagacatcttaacctaatcggcgtcacttgacattaacataaagaatcctcgagcatatggctcattagttaattcgtatatttctccatataggccaagagcccaagacacaattgtaaactatactagaatagccttggttaatttaatctcagcatttttaactcttcagaaacagtgacagatcgatgatgaaatgaacaataaaacattacattgatgttgcaaggagcctgtagggtcaactcttgttacgacagattgatgtgcagatgaattatatatatgcacatatagtagcatcttcctcctcttcttctaccctctgtccattgtatctgcaattctgcattaagcttgaaagacagtaggtacagagctgtctctgtagctactagatagtcatcctcttgttgaacttcagtactgaaaacaagatctgaatttgtatttgtttcccaggttagattcttctgtgtttctgaagctgttttgtttttgcatgtggcttcactttttcttgtgttgatgccagcaatgcctttctccattttgttttaggttccatctatcactttatgcagtgaaagtttgtaactacaggaaattaagggcgtggtttgtataaaatgggctgtgtatcatcaaagcagttcaaaagagctgcacaacatgaggatcctgctattctggccaaagagactacatgtaggatttgattcactggatacaccatggaaaaatatttacaggttctcttttggaaaaaccctgaataataataattgtaatttattgctattcttcttgcagtttcagtgagtgaagtggaggccctctttgagctgttcaagaagataagccattccatattcagagatggtctcattcacaaggtacttgcttaaaaaatctgctcaaacttgtgagattgaccatgtagctctgaaattctgatgaaaaatatgtcaattgcaaacggccctttccatgtacaggaggagttccagctagctctcttcaggaacagcaacaagaagaaccttttcgccaatcgggtcagtagcagtgatacccagtccatttcatcagtggattttatttcaacatatagaccatgatgtattggtgcaaaaaggcattatctgaagaagcacagttctacatatgtttggctgaattgtagaacctgttcttatgtgaaaatgctgacagtgtttcaccacaagtgcagatatttgatctctttgatctgaagcgcaacggtgttatcgatttcggggagttcgttcgatccctcagcatttttcacccggaaacgcctttgggagacaagattgcctgtaaggagttccagctctttctcattatatatggtcaatttaaccatcttgattttgttttctttaataactaccttctgtttatgccattttggtatttgacagtattcttttttgtagttgcatttaggttgtatgacctgagaggaactggatgcattgaacgtgaagaggtatgcattttagaaattagaattacttatcatctttttagttccataaatcaaacatgctacccatatactgtgtagaaatgattcaacatatagtaatttccatgcattaatagtctacagaactgatggtgacggtacacatctataccatcaaagaaacataaatggtgtgtttccaaatatttgttgaatccagttgatatttaatttaaataaatccttacatatccataagaagcctcaattcaaactggctgagtgtgaaaaactggaaatttgtatgtgtaccgttggaaaataatatgcataccgtcttaccgttttaactgacagtcctggagttactgaaactatttttctttcttatgaatcaagcagttgcacgaaatggtgcttgctcttctgaatgaatcagatctattcctatctgaagaagctgtagaacaaatcgtggatcaggttaagtgcattcagattaaatactaccttcagtttttctatttcccaggcattttttagcagatttcagttcatttctttcacaaagttgccactgctttcatgaataaatcatatcattaacctttatgctaacttgagcttttacagacgttcaagcaagcagacttaaacgatgacgggaagatcgaccccgatgaatggaaaacgtttgcgagtaaaaacccggctttgctgaagaacatgactcttccatacctaaagtaagtctgtctacaagtttcaggtttcactccaattacgttttactgttttacatcactttatcactaaatataggggctgttcagtttgttaccattttcaaccatatcaaatttagcattgtcaaattttggcaaggtagcagtctaagtacatcccaaatactccaccataccttaccatgccaaaattttggtgattttctagaaacctctcgacataacactatacaagaatatttagcatagtaacaaaccaaacaacacccacacacttttctaccctaccaaacttggccaaattttggtattgccaaaatttggaagggttaattttggcatcaaagtgaacaaacccataaaatttgtaattctgatgcctaaattgttcactttgtgttcagggacataaccatggtattccccagctttattctgaactctgaagtttgtgaggaagagttgtaacatccatggtaccctctgtgctccatttatatttctcacaaaggggcatgactacatggggaaaccatgggaacagagctagatgaatcacaatcatcagacatgggcacacagtatgcagcaatagtgaagacctcagcactgaagaacagtatgcaggctaaggataaaatggttcacctgtacatgactgatcttcaggtcacgatgatatctctgatggatcgcagaagttgagatgcattgtgtttgggagagtttctggcagggcttgtttggcacagctccagctccagctccacccctcctagagctcagccaaacagtttcagctccaccaaaactgggagtggagctgggtggaactctctcacaaaatgaactagagttgtggagctgggtttacgcagctccacaactccactccagacccaactcctggagctaaatttaggagttggagttgtaccaaacaggcccatgacttctcctggaatttccagttgctagaagccccccaaaacagtccaaatttttatccagattctgagaagttatagttgtagaatccagaaattgaactagaagccagaagctgagtttcccaaattctccagattcttaccaactgtttctcaaaatcttaagctccccaaacatggtaggataccatcatggtgcgtcgcaatcttgagacagtagtcatacacatgcgcatttgttgtgcatggatggaaattttgtagtaggatttgtgcaaacttattccgaactgatcttgtgacgattttcaagctatgtttgatgtcgcattttcttcatttagcaatgttgtgttacagttacataataagtaatgtccaaatgcatatttaatgtagaagttgaaactatttccattattatgaaatgttctattccaccgttgctagaacgatgacaataggtgacatattatattccacttgttgaatctttatgtggttaaaaaatgattatagcattggatcagaagctggttggccagagatagcactcaacccaatagggtttaattctagactagcgctatagaaacacgtgtcattacttcgaggagcaaaacattttttttaaaaaaaaggagaaaaaccgtactcctaggggtggtatttattgatgatttgacattagtatccaccaattttaggactacgtgtgtactgcatgtgtttggtttgagaatgagctgagatgggttggacttatccctgtttttgagatgaaatggtcttatctattcgtttggcatatgggatagggtgatcgtactttttaagagatggcccgcatgtcagcaagagaaaaaaaaggtttggattggtttgccggttttgaggaacaagatgaactcagatcttagtggaatattcccttttagcaatcatcatgttccatctgtcctccaaccaaacacactgaaaaataggttcaacacaatccgatccatcccaacccttaaaccaaacacatgctaagagatggtcaacatgtcagcaagaaaaaataatgggttggattggttcaccagaggaatattccctatcagagaccatcccatcccacatgttctctagtcaaatatgctgaaacataagttcaacccaatccgatccatctcaacccttaaaccaaatacatgctaagtggatatgcatatgcctgagctctacaagattttgatgcctccgatgatacttcaagcttatgtaaagaacatgcatatgcttacgcagtgttgggtgtgcactaaattgtagtactctaaaaacggatggtttggtga

SEQ ID NO: 278 - DNA, 6076 bp, Oryza sativa
tataggtgcacccctggtactttcttcgtttcaaagtaggagtaaaataatttaaaatatgatgaaactttacattcgttttactatgctactcactccgtactcgtaaagaaagtcgttttggataacgacacggtcttcaaaacacaattttgacttcttgtttctataaaaatatttattgaaaagtgatatatgtatatttttatgaaagcatttttcaagacaaatctattcatataatttttatatttttaaactcaacaatttgagagttattcattatttatattcctaaagtttacttaagcattgtcctaaacgattttcttaatgattagggggagtatgtcataagataggagtatattttagattgatttattttaccctcgtgctagcagctcggtttgtgtgtacgtacgtgcggcatcggcgaatcgatttgagtttctttttctactgtgcacgagcttagcgagggtggtcggtgatctgctcgggctgtgcctacgtgagaagttgtgaagtatattgcctgaaacgtgaggcccgcacgctggaatgtttcttgtgtttcaaaactgtgcatatggtacgagatggtggtctgtgttgactgctcgtgtgctcacttgctggataatactactattatctgccttcttttcaagaggatgacattctaaaattcgtgccaacaactttggtaaattttgaccagtaacaatatatttaagactctcaatctttgtcatgtgaaaatcacatcatcaataagactacaaacagtaaaaacacggttattcttacacccttcgttttaaaatagattttttttgtttatatttttgttactgggatgccttccctctctacagtaccactactggagtactagtccacttgactacttgtccatatccaccttgattttcgctgaaaactcgtgatttttctccctaatctgcactgaaattgaagtaagaaatcttctgagaaaaagagcagacaggggctgagcggataagaccggaggcacatgacttcaccgcaccgcgccagagaggggaggtgtcactttaattagagctcatcaccacgcctctcgcctcacatcataccaagtgtcctccttcctcctcatcctccccaaccactgcatccgggtcggcgtcctcctcctcctcctcctcctcgcaggtaaagcagcatccaagcatcctttccaatccatgctcagagttggaagtagagctgctgctgatgatggtgtgtggatcggtgctggttggtttctcgttcttgcttgagtgtgagatgtgatgttgatgtgcgtgtgtgtggagtctggactggaaggtttcttgagttcagagtgcagatcagagaatcgtacttttgctttttacagtgtgttcttggtttgcccacacgatctgttcatcttttgtttcttttgttttgcctttcatgaacaaacgaccacagctctgcttgcctgctactgtccttctcagtttggcaaatgaaaggatattttttttagggaaagaaagcgaaaattactagtgctagaaagcagtggcaagtgagaataacacttctgcttgattgattaggttaggagtttatagatagttcttccctcttggtactgtcagtctgtcactggtgtgtaagtagagtgacagtgttgatgttcttccttgagataaacggcgatatccttttatcacttcctgagagagcacggcacgctttactcccttttattctggaaatattgttctcttccatgggttacagtttgtgtttcgatacagctttgcttgccatgattttttttctggccacttttttagttagagaagctaaagaacttacttttggtttcgggttaggcgtgccgtagattcatatgcaattcatggtccgcttgtttcttttgattattgagcttgagtgattcggtaacatcacaacagtacacccacatatcatggacacatcaagtgcgtgtagtttatttagtatttagtgttttgagtggagacggcaatagctggattctgtatttggtggtgactccttattggttgattgtgacctaaataaatattattgatttgctaacgaatgctggcaaacctttgcccgttttttcgccttgcactttcatgaactaaatgattcttggaatctaggagtattaattggacagactcttggattctactctagatcaataaggttgactacattgataggggattccctgtagaatactgtgcatcaaaatgaataccgattaatagtcaatatgtagacatgaccatttcgctggtcattcaacacattttggtgcgtacattgctttgttctagcagtatttttgctgaccagtgtacaaaatggtaggctagagctataatgctttacatccttttcattgcatcagcgcagtggaaattaacttccacttgacataatgctcccaggccccatcaggattggtgtggggttgtttatttatgtggaatagtttgagaactatattgttttttaagtaattccacttgtacagactttcttgttgctttcttaccagtcctttatactgaaactgattgtccggtcattctagcagtcacctgcattacaacggaaattgatttgcaacaactctgtttcggacaagcaaaaaaaaaaatccatgggaagaggagcccttttttcgtttgaattattccaaataccaacttatttacttgaaatccaaaaaatcaggaagaaaaaagagagagtagcaaacagtttattacacgaatgtccagtcttttcttgctgctttttctggtgcttttttattgatcaactgccatgatataattagtaactagtctctttgccttcaacaacagcatccggacttccagagttctagccaggcacatgactttgttggagtcaagtaattggtcataccttaatttagattgatgaactttcggttgcttttggttcttctctgtgttgtatttgagataattttgcagtattgttcaaattttaaactcttaagtcatccaagacatctttattctcacgagttctttgctatctgtagttctatatactcttttatcattagccaaaaaagaagtgaaataataagaagttataagtcagatattttctttgttcaaaatggagtaatcatgtcttttgatatgtttgatctgacacagaatgcaacgggcaattcaagctatcgggtcacatggcagtctcctcaagtctgctgttctgcgacacatcagtgctccaaaaccatctattttacctgctgtatattcacgctccatgtcagtttcatctgctcaaatagaggagagtggatttgagactgccactgtggcagatattttgaagtctaaggggaagagtgctgatggatcttggctctggtgcactactgatgactctgtctatgatgctgtcaaatctgtatgtgtcttctccttctcatattacctcttaagtgaacagttatgcttcaacatgataaagtttcttctatcagatgacgcaacacaatgttggagctctggtggttgttaaacctggacaggataaatcaattgctggtattgttactgagagaggtaacaagccaccatgtgtatttattttgtctctagccactgggtctgtaattcaaaaacacaatcatatgctagaagacagactattgcttaattcagttgtaaaaaagagatactagtgcatgaagctggctttagaaaagaaagagtttaaacagtacatgcaaagttacattgaaatgtttggactaataaagaagataaaaaacaatcaatacatggtcagacagacagacacagtgttcatgtgaatggtaccaacccttacggtcaaaaacacaacagaaaacctttacttgtttataaacatgattggcttagaaagtacttgtgttgcgtaactaacacctgaatcatgctctatgtttccagattacctcaggaaaatcatagtgcagggacgatcttccaagtcaactaaagttggagacatcatgactgaagaggtacaccccttgttatgctaattttcttttaggctgtatccgtcggtcatggtggtggaaatacaccctgaatctgattagtacagaggctaagtcgtaagcatgaaaaagttagtcagttgacaaacttggttgccaaaactactaacattctatactatggttttagttttaacaaaatattaaaatgcgaccagagtattgactgttctaaaacgaacgttcattgacaaaacatcatttcgacagaaccagctgatcacggtgaagcctgataccagagtcctgcaagcaatgcagctgatgacaggtaaaacatctttgatctttctccgattcagtacctgaaacagaaagttcagatagcaattgctaacaccggtgttgccgatctccgtgtgcagagaagcgcatcaggcacatcccggtgatcgacggcacgggcatggttgggatggtctccattggagacattgtccgcgccgtggtcagcgagcaccgggaagagctgaaccggctcaacgcctacatccagggtggctactaggacgccgacgtcgacgttggtcactcgctcctgccattgaggctgtgcctgtctgaaaaagactccctcttccaaataacgctcgctcgggatgatgacgaaataggccgcgattttcctggagaaattgttgccgaatgtttctgcttgttcgcgtgtattatatcaatctgatggtggaaacgaacacccaaataaaatgaaccgtgtacaccgtcttgtgcagcagcctgctgtttgtgaattgtggcaggttgttgttgagacgagtcttgatgtttaattagatggatttgccgctgtagtttgggaatcctgggcgttttcacaagtcagacgctgaacataagcaaagcctctggccatgtttggggattgtttgtggagtttttaacggctgatgcttcttttagaatctccagctcttctagttcctaaatagtcgaggttcttgctcagatttaaaattgatcttgaaaatgaactagcatcctgaagctggaaaatctagcctatttatagtctcaccagtcaccagctagttactcacgacctgtttccttctatttctcagcaccttgagctctcaaacagagccagcaggctagctgaacgatcaagttatgaagatcaaatgatggcgcgtaaaaaagtcattaacgtatgatcaattaagttttttttatctcaagttgatcaattaagtttttttatctcaagttgaagaattgaatctatcttatattttaaagcaatttctatataaccgtttggcagtttgataaagtgaaaatcaatgtaaaatctgcattttattcaagttagaaccgaggtaaaatccgtgcttctcaccgttggtagttgtgctgatactcacgcgctcacggtccaagctgaagagttgaaacctctactcgtctggtcgtctttagccaacaggcgaaagaagattcagcgtgctgcgttgtgcaccggttctagtcgtcaaaccgcctcccatttttcccggtgcttccggcgctcgagcaagagcaacacacggagacgctgtcaacgcgtctcgagagaagtaaatttcattagactggtctctcgtaaatttcattagactggtctctcggagaacattgagcacacacaatggtaaaagtaaggtactttctataaaacatatacatcccagcaatagactaaattaatagtaaatcgtctcaatagtatgtctacatgggtatctatagctctctaatatattgtctcttttttctctatatattatctctaggttagtagataactttgctctctctattcatttaatctatttcaagtaaaacatatacatcccagcaatagactagattaatagtaaaccgtctcaatagtatatctatatgggtatttatagctctcta

SEQ ID NO: 279 - DNA, 6645 bp, Oryza sativa
caacagcggtttcttcagaaacctagcctcatgagaaattcagcatgacatgtgtgccccctgcaatggtagggcgtccctgtctgtgtctgggctggcttccaatggggctccatttcccttttgtttcttggtcttattaggtaaggccttgctactgtatttgcattgctgggaagctgagaggatatgtttccatgttacaccttagggttagtgctaattagaatctaatcctgaagagatatgataattgcgtcgcaaccttactcgatattctggtcgacgacatctgtaattccagtacatattaatatttttttagtataaatggggaacattatcttcaaagctaatgattcttttaccaaattttctgaactttatccttttttctggaagtaccatattcgaatttgcagaagagaatatgcttgcagctcttggctctccccatgtttacgaaatttatatttcaaaacgttccacagaatttcatacacattacacaaccagctgaactctgaccaatcagacaacacctaaaattaacccaactaatcccctgccgaggaaagacagtctaacttcgatttgtacaggataaacaaaccgaaatcatttactagtagtattacaaaactagtatctgtagctgtcagtgaattagtctgaactgaatttggatcggactcggagtatatgtacccatccgtcccaaaatataagtatttttagcatagtgacaaatcaaatatttttaactttaactattaatagcaaaaatataaaaaagattaatcatataaaattaatgttattagatttatcattaaacaaactattataatatgcaactatttttatttaaaatattttacttttatagatattattactcaaagtagtattttggagactagccgaagtctaaaaatgtttatattttggaacgtagggagtatatataaacagcagctccagctagaagccaagccaatgcaaatcgtttttgactgaataaatccatcgtctctcaatccccaaaccgcttctgctgcgagacaccaccaaccaagaaaccaggggtggttttctgtcggtgtgtaatactccaggaatccgggggcccagccgcaaaaaaactgtccgagtcgcacctaaccagaggcgtccccgtgctataaaaggcgcgcttccccctcctgctcttctcttctctccgctctatttttttcatcctatcgattttgcagtttagccctcgaagaagcaaggatttcgagcccggtccctaggctcgatccggccgtgtcctttgctccgatcgagcgcgcgaggtctcgtaaggtccatcctgagcttgttgctgtggagtgcgcgattccgcgctcgatttcgtttcttccggcgcagatttcgtgttttttggcctagatttggcttgtgggtgaccgcctaggcgtttctcgcgtgtttcggctttttgtctgggatcgatttgtggctggatttgcttgttcctggctgcggagcttggatcttagcattagaaaccctcagattggggatttcctgccggaggaagctttttggaggagctgcctttgggaggaactcttccagttctgagggtttcggtgtttgttgctcgcctggctcgagaagaagctgggaaatctcgtattttagggcgggttctagtagatttcgtgtagtggagagcaaaaagtttgtgtggttttggtggtcaagtctggtggtggaagcccctcaggccggagatttcctccttccggtggacgaccaaaggagccgcccttggaaggaatttcttgccatcccagaggtttccacttcctcaccttggctaagtttaaaactttccgctgttttcccttgccgtgtagtaacaagtatgggttgctgatcaagtctttgttgtgaaaaatgtcaggttggggatttcctcacgcccaggaagccaagcaagggctgccttagcgaggaactcttccaattggacgggtttgcgcgtagcggtgcggctatataagtggaaatctgcatccctgggaaggatacaattgttttgaggctgggaactttggaattggtttgcataaggagttcttggaatggggaatcagtgccagaacgggactcttgggagtgattaccacaatcggttcccaagggagcatgccgttgggtacgttcagggggatagctacttggacttgaagaagttcgatgatacttggcctgaggtgaacaacttcaagcctactgctgctagtattctcaggcgggggttggatcctacatctatcaatgtccttgggcggaagacagcggacctaagggagcattatatcattggtcggaagcttggtcagggccagtttggcacaacttacctctgtaccgagatcaatacagggtgtgagtatgcttgcaagaccatcccaaagcgcaagctcatcaccaaggaggatgtagaagatgtgcgccgtgagattcagataatgcaccatttgtcgggccacaagaatgttgttgcaatcaaggatgtctatgaggatgggcaagcggtgcacattgtgatggagctctgcgctggtggggagctctttgacaggattcaggagaaggggcattacagcgagcggaaggctgcagagcttataagaataattgtcagcattgtggctatgtgccattcgctcggggtgatgcaccgtgatcttaagccagaaaatttcctccttttggataaagatgatgatctgtcaataaaggcaatagattttggtctatccgtgttcttcaaaccaggtatatgtcgcattttaatgcacttgtagtggtttatttttatttttagagagtaacatatcaacacataacgtgtatatgtctgctttgctgtatattctgtggatattatttgcatgccaccagaatcaagaccatcctaactatattctgttgtttatccatcttattcatcttccttaatagttcttgcaatttacatgtgtgaagtgttgtggatttacaaaatagtttttgacttctatctttacttaaatttggtgttttaaaatttgcaggtcaggttttcactgagctggttgggagtccatattatgttgctcctgaggtattgcacaaacgttatggaccagaatctgatgtgtggtcagctggagtgatactttacgttttgctgagtggagtgccaccattttgggcaggtgggttatctaaattctcaggtgttaaatttgaatctaatatcattctggaattgcaaagctgatcacatcctatccttttccagagacacaacaaggaatatttgatgcagttctgaagggtcacattgattttcaatctgatccatggccaaagatatctgacagtgcaaaggatcttataagaaaaatgctctctcattgcccttcggagcgtttgaaggcccatgaagtgctaagtaagtatatttgacctatttcttcacataaattagttgcccttttgtttcatcgcgaatagctctgcattttgttcataacatagtttgacgcatggttttagttttcactaattatctaagagctacaaaccttttgatatgttgactgatatatatatcttattgtcagggcatccttggatctgtgaaaatggagttgccactgatcaagctctggatcccagtgttatctctcggctcaaacaattctctgcaatgaacaagttaaagaagttggctctgagagtgagtgcttcatattcttgcatgcttccatattgctgctatgatatttgctatcatatcatcttaatcgagtatccccaattggccttcagcccttcactatatccattcgcatgccatgccatattgtcattctttggatccctatgatagtaaaataagttatttttttggtaaatgtcaactttgggagctgctctaggctgatcatctgattttgtggcaatatggaaaacaagtttttaggttgcgatattcaattatgtggtatgcacattaacatgccgcaattcagcctgtagcactatttcgttgcatgtcctactgctggctacatctgtgaaccatatgccatttcttttttctgacacttacgtgcttccaggtgatagctgagcgtctttcagaggaggagattgctgggttaagagaaatgttcaaggcagtggacacaaaaaatagaggtgtaatcactttcggtgagcttagagaaggtttaagaagatttggcgctgaatttaaggatacagagattggtgatataatggaagcggtaagtaggtgcaagaccacaaattgttggttagatggtgctctctttctttgagatcttgatttaaactctgaaacttcttcaggcacacaacgacaataatgtaacaatccattatgaagaatttattgctgcaactctacctcttaacaagatagaacgtgaggagcacctgctggcagcttttacatattttgacaaagatgggagtggttatatcacagttgacaagcttcaacgagcttgtggagaacataacatggaggattcactccttgaagagattatttcagaggttgatcaaaacaatgtaagttgatttcactatacaatatccaagatttattttttagtgactattgacttgtaaccaccgtattgagaataatttcagcataacactctgcgctttaaacgaaagcatacactcttggacatgttaggatttttttagacttctagtgtctctgctggtcagctggtacatcggtagtttgcgttgtagtctttaatcctaatgacattccctgtaaaattatttatttgattttactggcatctgtcagcgtcacatctaacaccaaacttgttcaacaacagaacgataacatgtacacggttgagggcagtctcttctacagatccatttgtcctgggtcctcatgctttagaacttagcattagcatgtttttttttccagggatagtatttcaaaagaaaaaagaaggcgatgattttgattcgtcaaccctgaaaatctttctcgagttgaatctaatgaactggtcttgtcattctttttcaggacggccaaattgactacgccgaatttgtagccatgatgcaaggcagcaacgttggactagggtggcaaacaatggaaagcagtttgaatgtagcattaagagacgcacctcaagtacattgatgcacgaatgtatagattttgttctcttctcttgtccattcattcttcactacccaattcgggtctgtgacttgtatgagaagagatcaagtcaattcatttagttggtatttattccaagcaagtgtgagttgataagtagcgtagtctctatggagacaatagcatgagcatatagtggtggtatattggttgatgtagttgcaaggccgcctagcaattaaaaaagaacccaaaagaggtgcattcgctttgttggttgttctttcaacgacctgtattacgcaatgaaagtcgtcatgtttgcgtaactctaatctcaatgcttgcgttcctataatatctttaaagattataatattacatttccatgtcatatgagattgagttgcactaccagccacctcttgtactggttggacgtttgtattctgattgttggacgtttgtgttcgttgacagtcacaaactgtggtcgttgttctgttggcccatgaacaaaactagacgctactctgctgttgcaactctgctctgctttgttctgcagtgtcaggcagctgaagcaacagatgaaccggtacattaagatccagctgcctccgatggatgaatcgaattacaattcggctaccaaaaaaaaccgtgggcgaaggtgaaggtgaaggtgaaggtgaagtgctcaaaccagattaggaggcggcgacgtcaagtttgagccaaagttgcaatttgcaaaacctggagaaaaactattcactccgttttttaatagatgacgcagttaactttttctcacatgtttgaccattcgtcttatttaaaatttttatgcaaatatataagatataaatcacacttaaagtactatgagtgataaaacaactcataacaaaataaattataattacttaaattttttaaataagacaatggtcaaacatgtaaaaaaaagtcaacggcgtcctctattaaaatacattaaaatacggaggtagtataccgtagtgtccctataaattcagaaagcggcgtgctgtattacttttagctagatcatgcagacaacagcgtcagtatatgtactcatgtatactcctttcgggaggccaatttgattagtatacacccgggcgtgtaagacatttgtgtatggctataattctattctacataaaaatcatcgaacctgacaattttgatatcctgatcaggttccctccgacacacgcgactcgcgcgaaacgactatctcctgcaaacaaaaccaaactctgctttcagtgtatttcatttcttggctgtgtactctgttgaaagcctgaaaccagaggagaatcaggaagaaagaaaaagataagagagagagaaatact

SEQ ID NO: 280 - DNA, 6472 bp, Oryza sativa
gatccgttcgtaggtctgatgatcggatgacagatacttgtgggttatctatccagttccaaactaaaattcgtccagtcccacgcatgcctaagaactcagaagcttcctcgcagttggagtgatgtcaatagaaaacgtgcgcgagaaagagttttttctttcctgtggtgtgcgtgacatcggtttttctttcttgtggtgtgcgttgtgacatcctctctgctcgctcgctttcctcagtcacacactctagtagtactctacagtctacactcacacttgccttttctcctctagtcttctcaattctcatatctagctgtacgcagctctcaccaacaaaagcgatgcagacgccgcaaacggcagccatatggggcagttgggcaccgagccaccgaatggtaagcaggtgtgcagcacgctactccgttcctcggacccgcgagacagcgagaggctccgggtgaaggcggatgtggggtgagaagcatccgcgcagccgcgcgcgtacgttgcccctcgcgacaaaaatgccgcgccgagccgcgccgcgaaccgcggttggcagttacaacaggcgagcggagctacccaactccgcgcggctcgcgcgcgggcgcacggcgggttggttgccccggtgcgtcccctcctcaccggctcggcgggtccacccccaacccacgcctgccctgcacggcagagttcagtgtacccatccgcttcgcagaaacagatgcgggggcaacgagacgaaacccgctgccgacttcgcctcaccttccccgctccacccccccgtccttacgtgcaaaaatccaaaatcacgccaagtactccccacaagcccatcaacgagacgggggagcctctctttcacccgcagccgcacggctctcgcctcggcgagtcggcgtctcgcgtcgtttgatggtatcgcactgaccggcacgatacgaagcataaaataggtcgtagcgtccaataatttctagcctatctactcatcaaccgcacacgaaagaacaagggccgccaagttgcagttagctagctgttgcgctcgctttcccccaaacgtgacccggccgggagggagaagtcgccatgaagcagcctcccgctgctgctttctctctctcgcctcgttaaaatctctcttccaccccgaaccccatccagttcagttccctctcgatcgcttcccgtgctctcgctctctcgcttgctagatcagagattcccctctgcggcggttgtgaggtttccgcttcggctcgctagctagctctgctgtttctgtgagagccgggagcaccaaccgcgcgtggggtgggtgcccggagctttgatgcgcgtggccgccggtttctccccgtcgtttgatgggcaacgcatgcggcggttcccttagatccaagtacctgagcttcaagcagaccgcgtcgcagcgccacgacaccgacgacaacaacaacgccgccgcggccgactcgccgaagaagccctcccgccctccagcagccgccaagacggacgaccacccagtctccgcgtcggcgccggccgccgccatgaggcgcggccaggcgcccgccgacctcggctcggtgctcggccaccccacccccaacctccgcgacctctacgccatgggcaggaagctcgggcaggggcagttcggcaccacctacctctgcaccgagctgtccactggggtggactacgcctgcaagtccatttccaagcgcaagctcatcaccaaggaggacatcgaagacgttcgccgcgagatccagatcatgcaccatctctcgggccacaagaacgtcgtcgccatcaagggcgcctacgaggaccagctatacgtgcacatcgtcatggagctctgcgccggcggcgagctcttcgatcgcatcatacagcgcggccactacagcgagcggaaggccgccgagctcacgcggatcatcgttggggtcgtcgaggcctgccactcgctcggggtcatgcaccgggacctcaagccagaaaacttcctgcttgccaacaaggacgatgacctctcgctcaaggccatagattttggtctctcagtcttcttcaagcccggtaagctacttatgcagaacacaaaggctttaaactgtgttttaatccactattccgatgcaaaattggtgttgcgattcgcaaatattgtagcgtcacattagagttaacatgcatcggttaatccattgtctgaagaaaaaaaaatggaggcaacatgcaactgcaattctcagtttctgaataattagttgggcatatagtggaacattcaagggtagcactacagcagtgggaacattgttaatgagttcattgcatcctgcaaggtctgaaatacacgttcgttggggagcagctgaatggcagagtaaactgatggaagctagttcactgggaggatttctgagttaaatgtagtggaaaacgatggaagctgaacgacatcttgttctaataaacatctgtaatgctgtattctgtattgtggggaatttgatgtttccataagctaaattaggttactgtaggcatatttatatgagcttgtgcctccttttattcttcgtcttcttttccatctcaggtcaaacttttaccgatgttgtcggaagcccatattacgtagctccagaagtgttgttgaaacactatggaccagaagctgatgtatggactgcaggtgtcattctctacattttactaagtggtgtacccccattctgggcaggtaaattttgatttcccccttcaattaacctgggaagcttgttttctgatgattgtagcttgacatttttcgtatgtatacaatgcagagacacaacaaggaatatttgatgctgtactaaaaggtttcattgattttgattctgatccttggcctgtgatctctgagagcgcaaaggatcttataacaaaaatgctcaatcctcgcccaaaggaacgcttaacagcacatgaagttctatgtatgtttcttttactatattttttttgacaaaattcttttactatgttgtactcgtggtcttatttttctctctaatgcctatccaatcacttgacacatttgcaactgccgggagaaaatgtaacacttcaactcttgctcaggccatccatggattcgtgatcacggagttgctccagatcggcctcttgatccagctgtcctatctcgcatcaagcagttctctgcaatgaataagttgaagaagatggctttgcgggtacgcatgataactttaagcttaagttttaaattaccagctttgtgatacattggcttttttttttctctacaatagactgtttattttgctctatgataagcttttcgcctaatctttcaacttgaactgaatgcatagaaggtgaccttttcactgccagctgttgacaagtttttgtagtgacttttattcactaaaaaatagtactatactcaaagtggtttcttttgggggcaatactatgtctttttgttgtttctgttgaacggtcacccacccaccatatttattaaatgtgaccggatttgttataacactagggaggtatgatggtttgatcatttcttttcagtctccccttaatactagggagctattgaagcaaaccatgttgaattttggaacctgtactgttggtgaagcataattagtgggttttgcatttatgaacaatttgtgtttatcctaccaggtaatagctgagagtctctcagaggaggaaatcgctgggttgaaggaaatgtttcagactatggatgctgataacagtggtgcgatcacatatgatgagcttaaagaaggcttgagaaaatatggctcaacacttaaggacaccgagattcgtgatcttatggatgcagtaagttaacttcaacctatttgaatgctgctttcgatttcttctgtgttagtgacttatattttgaagatacttaaggaccttgaacttaaagttaccttaaaacattctgaataaaatgccttttggtgtcatattacttataagtcggtcgagacttgagaaactcttggttaaaaaaagaaagatatgagaaactcaagctgcttcctgcctcacaagattacttgacttcatggagaagcttgagcgcttaagagagaagtcattacccatacattttcctttttgttggctgttttctttagagtatctatgattagaaaacatgcagcaggcagatcttgccttcttaaatttctttgtaggctgataacttcagcctcatgattgtctttctactgcaaacatttcaaaaacaggttaacatggtaaatcaagaagcttacattgtcccttttgttctgttgtttcatcaggcagatatagacaacagcggaacaattgattatatcgaattcattgctgcaacattgcatctcaataaactggagcgagaggaacatcttgtggcagctttttcatattttgacaaagatggaagtggttacatcacagtggatgaactgcagcaagcttgcaaagagcataacatgcccgatgcttttcttgatgatgtcatcaatgaagctgatcaggacaatgtaagtatagtgttgatacctcctgatgtgctatataactatgttatatattattctggtatagctgggatgtgtacaaaaatgaatgtgcaagcagcggatgcaataaagtttgttcaattagttaagacaattaaaggctttgcattggattgtttagtattgaggtggaaaaccaaccatagtacctgaactacctaggtcttgaaactctttcaatccattattgggatcacatatgctctagtaggtggttagctgtccagtcatgtgctttacttaacaaaggcctagggacttctcttcaataaccagcagaattcattttgttacttcattaatgaatgtttatggttatgttagtagcaaaaagaagttagtgccatgacttgtttgcctaatgttgctcccttttgtcaggatgggcgcattgactatggagaatttgttgccatgatgaccaagggcaatatgggagtcggacgaagaacaatgagaaacagcttgaatatcagcatgagggacgcacctggtgcactctagacttccacgatgtacagcttacggattttagcttcttcctgtcttcctgcccaacgaactcctgcgattttttagcgttgtcagatgtccgcggatgtgtttttctggtggttctgatttaacttgtcaattgattccatggaatgcataacaagatgtccatgccacgctcaaacgaagctgggttgtaaatctctcgtacgccattgctcaactctgaaggtgttcggtgaactagctcgtattctttgtgttgcaatggatgaacttatactggctgtgttgggtgtaattgcattgccaacatttacaggggcatgtgagatcccgctttatccaccgagtattctttgcgcatagatagcttcacagacttcacactataaatattttttctgggttccaaatgaggcggagtataataatcaaaggtagagataaataacacgagaaaatgaaatttccagagttgcagattatgttacttctctcaatcaatttctgggctacaaaaatgtattccggagaaaagttccgtgatcaccaatagtccccgcaagaacaagaaccacttttgaagtggtgaaaccgaacaccatctcggatcacaaactcccgatcagtcacagaagatatcagcttgatcaccgtgtggcagtccccgcaaatgcgcaggttcttcatgatgtgaataggcatccaagcaggcaagctcatgatcccaaacgccacagccagcttctcgctgtgatgaatctcagaccgtggcgactcggtcctcacataaccgagatgtgcaatcttttccatgagttcatccatcttgttacgaattgcaatcacttgtgggtggctcacatcatctgctttgaagacgtgaaccttgttttcgacttccatccagctatagcccgggtttttctttatccctttgtccctcattagcttcctaacttgtgcagaatcatctgacttcccagcatccgaatatatcttggctagaagcatgtagcttccagaatcaggtgagtccagctcgaacacgtgcttcgctgccaattctgcaagttcatcgttgccatgtatcttacaggcactaagaagagctccccaaacctcagcagttggtttcatgggcattttatcaatgagatccttggcttcagtcaaatgccctgcacggccaagaaggtccaccatgcaggagaaatgctccaaccctggagatatgccatggactcttgtcatcatatcaaagtagagtttcccttcctgcacaagtccagagtggc

SEQ ID NO: 281 - DNA, 4256 bp, Oryza sativa
acaatggtggaaggcttcccccgccacgcgcgcgccgctcctcccccggcgcccgcacccactgcccgtgcccggctgctcccccatcggccgccgcccgcacccaactgctccaccttgacgccacggctcgctcgaccccgccgcggtgcggtgcgctgctgcctcgtctccgctgccgcgtcgcccgtcaccggccgccgacgttctcctcatgtcccgcctcgcactgccagcctcctctccactcgttgaagtcaccggcctcctcctccttcgccgcttgctcctacccctcggcggctagaggggcggagacttcgccgctgtcgccaacgggggcgcagtacagccgccgccgtgccgaggccgctccccgtcgagggaggagggagactcgggtggcggagcggcgttgggccttggcttcgtggcgcaacctgcacaagagaggagctgacatggacaagctgacatgtgggggccacgtggatcccgcgctgactcagcagcaacgtcggacaaaaccggtttcaaaaccaccgagggaccattggtattggttttgtaagtctggggacgtgttatatccggttttgggacgattttgtaactcgatgacaagttgagggaccttcggtgtactttttccaaagtgtaaacggcctggaaatgggaggatgggctggagcccatgggagctcagttccaaatggcgctagggctagtaggctctgatcggtaggccgagttgggctagtaggctgtgatcggtcggccgagttgggcaaaaacagcatagtccggcctgtttgctgagaacgggctgtcatgaacaaaaagggccaagcccatgcgaatatatctcgaagtaccaaagagacaagggctttgtgtactgcacgactgtttacacagctgcaacggcgcgctcactgccgcctggggcccgcaaggggagccgagaggtgccgcaccgtcgtcatcctcgcaaaccgtgcggccgcgggcgagcggagatgccccggacccaacaagataggggggagccaaaatggcgctgctctcaccaccctccccgcctcctccgctcccgccacttcgccgccgccccgcctctcccacactcctcgccgtcgcgacgagacctagctctctcctctccctgccccactgccactgcggcctccccctcccttctacagccaacgcacgggcgtattcccgtagcagccgccgccgccgccgcgtagctgcctcgctcggccaggacgaacctggagtgtcagacacagctgtcgctcctgagggagaaggggattccgaaccgccggcttcctccgatggagccgcaggcgacatcgcggcttccgccgagcagccggaggcgagccccgaggacttggaggatatccgccaggtcaaaagggtacgcgccttctagttacggcccctttcgcttggtttatgtttttgggatgagttcgtgcttacttggtgtttggttcggcacttcggctgcggttgcaggtgcttgagcttcttcagaagaacagggatatgacctttggcgaggtaagcagtctttggacagtcaagataatcctggtcgagttattgccgatgcccgatgataacttactatggtgttctgcttcgttgctgcatcacaggttaagctaactatcatgattgaggatcctagagatatagaaaggaagagattactcggcatagaggatcctgatgaaatcaccagggatgatttggctgatgctttggttgaggtacactatcaatgaacgtgaatcttctgtcactttcattttgtgaatatcgttcttggtaactactagcatcttcattcacttgaggagccgacatacattttagtgtatactaaccagtcacatgctatgctctagtatttgaaataaccagtaaaaaacactgcctctgtactgtagcactattgttgacatttgaatgataaaggaaatctgaaagatttgttgtgcctttgctggtgtcacgcaagaactgctgcctccctgttgtgaattacttgtttttagaacctataattatcaaacagtcgtttaaaatttattcattctaacttttttttttccaaatgaatttgcctggattccattactcatgtaacaaaataaagtgaagtgagtacctttttacatgatcttcataccatccttcttcattccatacttagtttggccccaacatattgcttcagcggtcagttaataatatgccttgcaggttaatgaaggccggattccagaaaaccgtgttgcccttcagttgcttgcgaaggagatgactgaatggccagatcttgaggtaatactgacaattcagtttatcgacttcttagaaatgcatataagttttctccagctaccataccaccataacaatagttttgcctaccagcgtcttcaaactgcttgactcatactgattatttgtatggttttgtcagccttcatcactttcaaaagtacaagtgtaccactgagcattgctcgtcactttcctatgcatatgttttcattgtctttttgtaacaacctgtttagtcaaactgtgtttaaattcatttttaattttttgtacagatggaagctccaaaaaagaagagtaaacctgggaaatctgtctatgcaaaggctacagatacaggcattgatcctgagacagctgctaaaagacttaacattgattgggattctgctgctgatttggatgatgaagaggaggaagatgatgaaactgaagtgccctccgcagtggtaagatgttgattttgacatatgccaacaatattggttttaggtgcaaacatttgatcaaaattgaacagatctcttgtacctttttttttttgccatatccttttaacaacacacctttttttaattatttttttgcagggatattctgctctatatctgttaactgcctttcctgtcattattggaatatcagtcgtgttgattcttttctacaattctctacagtagttcagccctgctcatctttgcttcccgaggcagatatcctcctccttttattttcttttgtaaatctgagtcagcttaatcttcattattgtgaagaaatgaagatgtgaaatagtttctgtggtgatatgacaactgacaagatagtaaatccgtgaaatgcatattaccaaaatagaaggcttgaaaatagttttttccctgagatattttggcctttactcttttttttttttttgaaaggagggcaagagcttttgcctcatatattaatagagaggggaaaaatgtacaaagtattttggcctttactctcaattcaaccttgctttttccccatatcctgcatcaagctcaagcggttatactatatccatagatatccacaagccagaaaatgccagcactttacacatagtcgacatcctttcgttgtgtcatcttcaccatttccttttaagaaacatagtcgtgccagaatgccgcttagtagcaagcacgaacaatgataacaaggcagcagctgaccacagctgtgtagagaaagaacagcgggtgcagtgcagcggtctaagcctgaagatttgatgaagtggaaggtcaaccagctcaccgacacagcacggcatgacaaagaggcagacagccctccatccgaatgtgctctccaccattccatggtagccaattccatcatcctgttttagttgtcaggaagcagtcggaacatctcgtgcatgcagttcacttctggtacggtgatgccatgagtttttctcaagaagacgattcatttcgagagaagcatgcgtccttcaagaaagaagctggagctgcaggtatcgatgatgaggaggaccaggaccggaggtcccatgcctctgcggacggatcaaatgcagccagaggcgccgccaccggccggcgatcccgcgtcgcctcgtcggtcaccgacatctcgagcaactcgtcgatcaactaccggagggcgaggcaggataggttcgccggcgacggcttctggtgcggcgctctctgccttcccctgccggggctgtcgaggaggcggccgatgcagcagcagcaatccatgagcctgagcgagccgggcgcccgggcgagcacggccgagacgcgggccagcgtggcgtccaagggggcatccatggagaggttcaagtacagctcgtcgtcgtcgtccagcatcgt

SEQ ID NO: 282 - DNA, 4516 bp, Oryza sativa
gttattatcagaagattgatttggaggatttgttggaacaaatattgacacttgatattataggctagctaccagttccaactccccagtactaaggtcaatacaatatgactccaatcagattcagcagtggaaacacaaaaggctcacagctgagcagtgaggaattaataatataaaatgtgacagttaactcctaatcattataattccaaactaagttcgctttgcccacaagttttagcaaagacgcaattgacatgaaaaggcacaagtattactccctactcagctattgataacggcagactaactgatacgacagagatggtcaacaaacagtctctagctataggtttcgtctgaaatcagacaaggttcaaaaggatgaatagaactaaatcacaaagcaaatcagtagctagactgcaaaacaccaatccacccttaattatcgtttgcatgagatagttttgcttctcaaaccatggggtaaaaatggattaaccgcaacgactttgtcccattcaattgacggattaacggattggtagcggtacgaaatggaatgtctgtctttcaaactcgaagcaaaagctaagtaaagtaacaacctaatcagatgacacagcacacaaaaatctcagaaccattgtccaaacacaacttgacgcgttggcgcgtgcgaagaaagtgcttaagctttgttctgtgaaaccagggcgccaacgggggcagccgctgctggcctgggcaggccagtgggtgcaccaaactatctgcatagttgaaccttggtgacacgaactcgacctcgaggcatgcatgcgtgaatgagcatgtgtttgcgaaagttttccctctaccacgcaagaatcaaaacctaaccaaccaaccagagaagcaacatgcatgacgaaacacaacgagaaatcgatcgtagaaccatgtcctttttgaaacgctatatataccgcgccatcactgtgggaagtttctcatcgccacacagaaaccttcagggcaagagctatagctaagctactgtgtcacccgttcgatcggtgagccgacgccagcacacgcgccgcaacgtttgcgcttagccggcatggcgtcgtcctcgtcgtcccggctgctcttcctcctctcgtgcagcgtgctcgcgctgctcgccggcgccgaagtgcaccatcatgaattcattgtacgtgccatatattttcctcttgtgtcatcttactagctacgagcacactattattgcctgtatatctcgatgcaccgttttctgtacgtgtaattaatgtactggtactgctttttgtgtatggattattgaaggttcaagagacgccggtgaagaggctgtgcaagacacacaacgtgatcacggtgaacgggcagctgccggggccgacgctggaggtccgggagggcgacaccgtggtgatcaacgtcgtcaaccacgcgcagtacaacgtcaccatccattggtacgtgtcgtcgacccaactacgtacaccaatcaaacagctaacgacttccgctcctggtcgtcaacggcgacgattgttgttttctgcgccgccggtcgagatctagctagctaacacatggtgatcaacgcgcgcgtgcaggcacggcatccggcagttcaggacggggtgggcggacgggccggagttcgtgacacagtgcccgatcaagccgggcggcagctacaagtaccggttcaccatcgaggggcaggagggcacgctgtggtggcacgcgcacagctcctggctcagggccaccgtctacggcgcgctcatcatccgccccagggagaacaagacctaccccttcgagaagcccgcgcgagaagtcccccttattctcggtcagtcttgatccttcctacttttgtacacagatctgcatattaactatcagatcagtcgtctgaactgacactgaaaatgttggcacttggcacgatggacaggggaatggtgggacgcggacccgatccaagtcatcagggaggctcagaggaccggcgccgcgccgaacatctccgacgcgtacaccatcaacggtcagcctggtgatctgtacaactgctccaaggaaggtagaaaatcactcactctagtatgcgtgttctaccagccagtgtgtgtgcgtcagtgcgtggcaaatttacagagacatgataacatgcatgcagagaccacggctgtcccggtgaagcccggcgagacggcgctgctgcggttcatcaacgcggcactcaaccaggagctgttcgtctcgatcgcgcagcacaagatgaccgtggtcggcgtcgacgcgtcctacaccaagccgttcaccacctcggtgctcatgatcgcgccgggccagaccaccgacgtcctcgtcaccatggaccaggcgcccacccggtactacctcgccgcgcgcgcctacgactccgcgcagggcgtggcctttgacaacaccaccaccacggccgtcatcgagtacgactgcggctgcgccaccgacttcggcccctccatcccgccggcgttcccggtcctcccggcgttcaacgacaccaacaccgccaccgccttcgccgcgggcatcaggagcccccacgaggtcaagatccccggccccgtcgacgagaacctcttcttcaccgtcggtgtcggcctgttcaactgcgagcccgggcagcagtgcggtggcccgaacaacactcgcttcacggccagcatgaacaacatctccttcgtcttcccgcagaccacctcgctcctccacgcgcactactacggcatccccggcgtgttcaccaccgacttcccggcgtacccgccggtgcagttcgactacacggcgcagaacgtcccccgctacctgtggcagcccgtcccggcgacgaagctgtacaagctcaagttcggctccgtggtgcagatcgtcctgcaggacaccagcatcgtctcgccggagaaccaccccatccacatccacggctacgacttctacatcctcgccgagggcttcggcaacttcgaccccaagaaggacgccaagaagttcaactacgtcgacccgccacagaggaacaccgtcgcggtgccgacaaacggctgggccgtcatccggttcgtcgccgacaaccctggggtgtggctcatgcattgccatcttgacgtgcacataacctggggcctggcaatggcgttcctggtggaggatgggtatggcaaactggagactctggaggcgcctcctgttgatcttccaatgtgctagtgatcagcattcggcagatgatgatactgcgttaagaatacaaaatcccgttcatgtcgtattccaaattgatgctttttgggggtttattttgtgatctccagtactaggggttgatttttcatcttgatttgagctttcccctgtaaagttaagagtttttatgtgatttctatgcattattttggaataaatcctttttgtagcaagtgttactcagatcaccattgcaaatatgcaacatagtactgaaatgcgtccatcgaaggaggaaagaaatgtcaaaggatagtcaagtagtcatcatttcatttctgctggagtaggaagtactaccagttactatggggcttagagtagtcagctataaacatattttaatgaaataaacgatgagagagaagagcagcgggctacagatttgtagccagctgcagcacagactccaagacgcaatgtgtgtatgacaggtgggaccatatattaatagtatagtaagcaactattgtatgaattgattattagatttgctatagatgaattagagctagtagtgggctatactattgaacttgctcttattcctaggcaagttttggcactaccaagattttggtagtatagcacagtaattatgagtgtttggattagtgccaatgaagtgccaaatttttatgggtcaatttccatttggattggtaccaatgaagggttaccaattttttttgtggtgtaatagatttggtactatttgctgtagaataagcacaaataagcagagcggtgaggcggccagccgaggagacgagtagtggctgggtatttattgaagtagagaaaagatgaagccctagcctttttttttgaacggaagtgcgtgaactagtttgtgaactagtttgggctgtgtgacctgcttctgggcgcttccggcgggcgacggatggctaccaattccagccaatgccttgctaccaaattaagtctaggcactaccagtgatttggtcacaatccaaactcttagtgttactgttctgataaccaaaatattggtatggctcagttttggtagcaaaccaaaacggcccaaactttccatatcgcattctgttgtccgcttttgcacttctgtatggtactactagtgttattgacaaagcttatccttagctttcttctgtcaggagtcatatttcacaacccataattccttcccc

SEQ ID NO: 283 - DNA, 7734 bp, Oryza sativa
tataagtaattagaaaattgtccacgctagcaaacttatgagccggaagatagctaagaccatgtttagattccaacttttttcttcaaactttcaacttttccgtcacatagctccaatttattcaaatttttagttttggtatggaacaacacagactaagtagaaagaggttgtgacttgtgagccgacactattttgccactgactatacacatgctccaagggaagttctatactggtgcatgtatttatggactccacatcaataattctactagtttgcgaaggagaaaacgatactagaatatgttaaatccacataaaatctcttatattataggacagagggagtagtagataaaagaatgcgataaaatagcttgggttcattaaacaataaaataactatatagccaattgtgcacaagtaaaagatcataaacacgtgtacaattttggagctaacaattaactacactattaaccttgcccttagaatgaaaaactgtccacgcatgcgacttgaaactcgtactggttctaaatagatatctgaagattttgagcttttgccgtaacaattgaaacggcatgcagtaaggattcgaaagactgttaactgaacgaagtttaaggtagtaattaattaactttactagcgaaggccattgtaaactgtcagagttcttcgtggcttcccgctgtgagagaagtggctgcctctcggttctcaccaagcagtcgaaaatgccagaacagcgaccagataggatcatcgtgccatgcaggcatgcagcctttgagaactgaaagagccggtgaaagtcctgcaaagcgaaaagcaaatgaacaaacatctgcctgtgctgctgcctcgcctcgctgtccttttccggtgggttgccgctgctaacctctgcctccgcgatacgtgacacgtcatcctccccccaccccaccccatgcttgcacccccccccccccccctccctcccttattaccaccacccccctcctccatcctcctctgctcctccaacctggctcagtttcctcctgttcttgagagaactgaatctgctgtccagctgctgctccggctggtctctgagttgaaggtaaggttaatcggtgtctctcagcctgaatgaatttgtctatctcctatggctttgtggtggttgaattttgcgttctggggatgttaggaccttcttgttgggacaatttctgagattctggcttgctttggatgggttgggggaagagttaggtgcttgctggtgtgtatttcttttgcatttcggttgtcctgtgaaggatgcgtgttctcggcatttccagctcattgtgtctttgcccttcagataacagttatcctcgtgcttttcctttttctttcagcaaaacatatctggacttctgtacaagtgctttttttttcttctttggacgatattttgttttgcattctagtgattctgtacaagtgccatctgatagcatatcatcattcggcaactggtgatttcccctatgcggtctttcatgtacttgcatgattgaacatatggcagtgcttctgtcggatgctatcgatgttttacttgcgaaaggccggggaactttttgcagatcttgaggtttttagtagtgatgcagtcattcaaaaagataaccttgtgctggtccttttgcctttcggctgcacttgcatgtgcgttttctcagagatgctgcatctccagctcagcttctgtcatcagtcattagtcattgccatcttttatgtggataaagtcaaagttaatttagcaccgctgttttggagttgtttggtcattttatatattttcatcaggtgttgtttactgttcctggtactaaaatttcgaatttacaaatgactacctcattctcctttctttttttcctttttccttgtggcagaccggttcctgaaagaatattcttttcatgaaatgtacttccggttttttaaatagaatgattaaattacagtaggatgaataactaaatttgtcgatatgccttgtaccggtactccttgttagttcttagtgaatctatgtatactattgcttgtcaaattgtgaattttactatcagctgtatgtatgtctattgaagaactctcaacagttctaacttcctaagatgttttaatcaattcttgctaccaacctggatacagtattctccgtagttttttcttcattttttttttaaagagatctattgagagtccttggtacccatcttctgtagaattgtccatgtgaacagttgcttcaagatttctgctgcatctgtgatacggtatcactgatactgtagtgatcagatccaaaacacatatatagttcgccaccattctaaaacacatgtttgtgtgatcagatctagctcgccaccatatatagttcaggttttcaagttgtaatatcacttgccttttgcgatagatatgacaacacactttgtgtcaggctgtcccaattttctctgaattttctctcatatatcatgatttagttatggcttttgttccttgacatttcaatgtctaattgtccaatgttaagtaaatccttttcatagcctgatttattgaatacttgcaggtacttgaataacttgaaggttcctaggaaccttcatttgttggaagatgtatagggctaagagggctgcattatctccaaaggtgaagcgccgtgtagggaagtatgagctcgggcgcaccattggagaaggaacctttgcaaaggtccggtttgcgaagaacactgaaaatgacgaaccagttgctatcaaaatccttgacaaggagaaggttcagaagcacagattggttgaacaggtcattctcaggcatttattttttggagcaattctcaatcaattcccttataaggcattgcatcagtttttttatcaatcactgtgttcgtccaatatctttaattcatatatcagactaacctctgtgattcagtccactaggaatatccttttttgaggtaaacagtccactaggaataaagtggtcaaaaatcgaagtttcctatatcgctttcagtaaaccatacagccaatcttaccatcatttgtaatagtcaacaaagtttacctcccaaaaaaatgtatgtttcttacgtaattgaccacatgtgtaattgaaatatgtgattttctttcatcaacatttactacaatcaacttgcatctttgtatcaaggaacaaaactgaagaaaaaattttcttccttggatgttgccgtgccagcatgggagcataggaagatgtaacttcaattaagaatgattccgtgtccacatgactacgtacatatttgcatgacatcgagatatacccaaatggtgatcttccagttgaagtcatattaccaactcagtatgttctcctggtgccttgtgctgtttctaattgctgtcaactttatgaaaagttgaagtaaaaagaaaggacctcattttgtacaattcaagatatgttttgcccatgccacatggatgttcatgttctcaattccattgaataggctttgctcttcattatactgttctaaccatagagattttagacacagaataacattagatgcaaaagttgtggttagaactcataacacaaatgtatagttttacatatgtgcaattccaaggaacaaatcacatatacatttttgaaaggaagaaattatttatttgatatttttatgctcatgccattctaaattcaatgcagattaggcgtgaaatttgtactatgaagttagtaaagcatcctaatgttgttcggctgttcgaggtaaagtcacaaagtggcctgcacttcatgatttatcaaacctcttaaaaatatgtttattcatgccaacagtaataaccttaggctgaaaaatatgtctacctcaggtcatgggaagtaaagcaagaattttcattgttctggaatatgttactggaggagagctctttgaaatcattgtaagtgccaatttgagatctaaaacttatgaaaggattgcccgatgtcagaatattgattcatggtatattatcatgttatgttgattttaactgacattatataccaattacaaaggcaactaatggaaggttgaaggaggaggaagcacgaaaatactttcaacaacttatcaatgcagttgactactgccacagtaggggtgtgtaccacagagacttgaaggtaaaggcttaacgtcctgatcatgaacaagtgagcaacaactgttatgagcatatgctgatctttaacatgcgttttcagttagaaaatttgctgcttgatgcttctggaaacctgaaagtatctgactttggtttgagtgctttaaccgagcaagtgaaggtatcataatgttctcaataatagttgcgttgttgttcttgtttggccttttaaattatcactggtctgatattattgaattcacctatacaggctgacggtttgctgcacacgacatgtggaactcctaattatgttgctccagaggtaatcttttttttcttgtcatagtagattagtattacacatgttgattgcacattggcactacattaacatttctaacatagtgtttgatctgttcctgtaggtgattgaggacagaggctatgatggggcagctgcagatatctggtcttgtggggtaatcctttatgttctgcttgctgggtttttaccatttgaggatgacaacatcattgctctttataaaaaggtaatacatacaaaaactatacaaaacacccaggttttgtgaatgccaattattttttcttactctcttctcgatcacagatctctgaagctcagtttacctgtccctcttggttttctactggagctaagaagctgatcaccagaattctggatcccaaccctacaactgtaagcttcgtataaattttgagatcttattgctcaaaggactcagatatacagtaggctaaaacatatctaaacagaactacaagcattttgagcaagcaataatcagtcgtggaacgaatgtggttttatgcgtctatgactaggtggatctttcacattgaaatgaaatttgtttacaaccttgcatcttttattgtttaaccgagtcgttctgttaaccttttcaattccaaaaagtagtcattgaaccccaatttacctgatttctgccattgttgaattttgtgcagaggatcaccatttctcaaatactggaagatccttggttcaaaaagggttacaaaccgcctgtatttgacgagaaatatgaaactagttttgacgatgtcgatgctgcttttggagactccgaagtgagtcaattggactatttatttcaaaacattcagcctcttgtggtaggaataagaggattaacttttttttatacatttaccgattaacaggaccggcatgtcaaagaagaaactgaagatcagcctacctctatgaacgcgtttgaactcatttcactgaatcaggcactgaatctggacaatttgttcgaggcaaaaaaggtcagataattctgctccaattagtaaagtatattataaccctttcaatattatagttccccatttttcagaaccagtttgtttttgtgaagtattttaaaaactatcattgcagtggactaattagtgcaaatattgttacaggagtataaaagagagacaagattcacatcacaatgtcctccaaaagaaattatcaccaagattgaagaagctgcaaagccacttggatttgatattcaaaagaaaaattacaaggtattcatatagcctactatgtgcacagagaaacttctcttactactcccacatacatcaaaagttatcaggaaataaagttcttacaaccgacttccatacctcgagtcctactaagtttgtttgttcactccagatgcgcatggagaacctgaaagcaggtagaaaaggcaatctcaatgttgcaactgaggtaagttgaaaccccattctaacaaaatactgaaaacatcaaggaaccactgttcactgagatttatgaccaataataggttttccaagtagctccatccttacatgtggttgagctcaagaaggcaaagggggacactctggagttccaaaaggtgccattctttgacaccggaaatttcgctatttccaacttgctatttactgccaagtttaaccaaaatcaattctgctgtgaaacaacagttctacagaaccctgtcgacccagctcaaggacgtggtctggaagtgcgacggcgaggtcgaaggcaacggcgccgcggcgtgaacgtggtttttgccatggctttcggggcaccggttcttcgtgtacatagctgctctgccatcatcaatggggtgttcgccgtagagtagctttttgtaacaagagaaaaaggaaagaaaaaaagagagggaaagattcgttggttcgttgataggtaggctgctccgatgaaacaacgggcgcgatgcctgctgtggatgagcttgtcgccgtgttagttcatttattctgtggcctcggaaggttgtaacgggacacaatcagatgccgcaatgcaacgggctgacagtttgtgagtttcaaacaacatttgaataagtctagcctcctccgtcaactataggcggagtttgattcacgttcttctacggttcaaccgtaaaactaggtatatagactttctcaacatttaaagtgccatgaagaataaaaccacttaagaaggtaaattgattatgtttaaacagtaaacggttttgcagttgattgaaggatgtaatcaaactcggccaggcctatagttgagggacgtagaacggacttattccaacaacgtttgcttggctccgtcgtctcggtagctcgattcttgttctcttttagctctgcgatgagttcgagctgagcagtgtgctcgaaatggaataagtttactttaggtctctcaattagttgtcaagtctaaaattcattcctgaatcgcaatactagatatgatgcatccctcaacttccaaaaccagtacaaataaaagtcttaaggcggtttggacaatggttttggctgacgtgatgcctacgtggtgttgtcgtgacaattaaagttagaaaaaaactatagggcccacatgtcaatgagtgtttgactaaaaattaaataaatgcagtgaaacccacctcatcacccatctctttccccttctcttccttccagtgccgaccctaggcctaggccgattgtgcgacctcctaggacccagagtggagggaggtccgccaccaccaccccaaacagcccagccacctagcattcaaagccgcaagccaggaaggcatggagagggccacggtgggtgatgacgacatgaaggcgtcatcgtcctcgtcatcagagaggaaggatggcggagcgcgcagggagggcgcaacgggatgccgctattgtgcattaagacgcgcaccctgaacaggtccgagcgctgctcaagggttttgctcccgccgcccccatcgctgttgctcctccaccgtcgccgctggttgccgtcgtcgttcccgccctcgcactgacctcgtcacagttgccctcgcaccaccctccatactcactgcgtctagtgaggagggaggagaggatgggatg

SEQ ID NO: 284 - DNA, 7092 bp, Oryza sativa
atctgcatcgcacggtatggcttgaatggaacatcacaagttatgaacttacaaaatttgactactctcgaatcaaaaccgcaacaaatgtatgaaaatcagaaagatccgcattaaagaggaaatcattatgatatttaatactagctgagtaatccctacacgacacacaatccctacactctacctggctaaccaacaaattccagtaccaaagtaatcaagccaagccagctagtattgcacctcggtgtagcgtgagccgtggccagtccctcagcaacaaatggaagccaccttggatgtttgcttataatggccactaatttactggacagctgttatacttcaatacctccccgcactttctgtttaagcttagcttgataatttgtactcacaccgagtaccagcaaagaaaaacgtaactcactggcgcgcccggagttaaaacacgaagatcactcgcaacagccggtcgagatgaggcctcatccccacaaagtattttctacacctagatgctatgcatgtaatttaaatagatatataaaaattttataaaatttaataaaatagtacatgataatataagacactatgcaaacatgcaagtctaaattcaatcgatatatgaagaaacaaaaataacaaattttgtctgtacggtacgggtactattcactgtctgattttattatttttgtttctctagttgtagatccaatttagtcctatatgtttgtgtatagacttatatcatcacaaacaatgttactaaatttttttaattttttttataactatttgagtcgtatgcaaatgataggtgccatagcacctaggtgtgaaaaaaattttccgcctcatcccaattcccaccaatacagggaacggcgagggcttgatcccataaaacaacacgataaaaaaggcgaaaaatctcccccctaaaacgcgacctgtgcggccctgggcggagaataacccggcggcggcctacggcgatataaaccgtatattgagggagcaagccgtggtacagagcagaggaggggggagagagagagagagagagagagagagagagtcgtgtgtgcgtgtgtccccggggttctagctttgggatgctgatggcgaccgtctcgccggcgcggagggagccgacgccgcaggcggtgcgggcgtccccgatgccatcggcggcggcggcgttggtgaggagaggcggtggtggtagcggggggacggtgctggggaagtacgagctggggcgcgtcctgggacagggctcgttcgcgaaggtgtaccaggcgaggcacctggagaccgacgagtgcgtggcaatcaaggtgctcgacaaggagaaggccgtgaagggcgggatggtccacctcgtcaagcgcgagatcaacgtgctccgccgggtgcgccacccgaacatcgtgcagctgttcgaggtaatggccagcaagaccaagatctacttcgtcatggagtatgtccgcggcggcgagctcttctcccgcgtctccaagggacgcctcagggaggacaccgcgcggcgctacttccagcagcttgtctccgccgtcgacttctgccacgcccgcggcgtgttccaccgtgacctcaagcccgagaacctcctcgtggatgagaacggggacttgaaggtctcggacttcggcctcgccgccggccccgaccagttcgaccccgacggtctgctccacacgttctgcggcacgccggcctacgtcgcccccgaggtgctcaggcgccgcggatacgacggcgccaaggcggacatatggtcatgcggtgtcatcctctttgcgctcatggccgggtacctccctttccatgaccacaacatcatggttctgtaccggaagatctacaatggggagttcaggtgtccaaggtggttctccaaggattttactagattgataacgcgccttcttgacgcaaaccccaaaactaggatcaccgtgccagagatcattgagagcgattggttcaagaaaggatacaagccagtcaagttttacattgaggatgacaagctctacaacctgtctgatgacgtgctgaacttggagcctgctgatcctgttcccccaccattgggtttggcacctcctgttcctccacctccacaaggggatgatcctgatggttcagggtctgagtcagattcatcagtcgtatcctgcccggccacattgtcaactggggagagccagagagtccgtgggtcactaccacgcccagcaagccttaatgcatttgatatcatatcattctcaaaaggattcaacttgtctgggctgtttgaggagagggggaacgagatcaggtttgtatctggtgagcccatgtctgacattgtaaaaaagctggaggagattgcaaaggtcaagagcttcacagtgcggaggaaggactggcgggtgagcatagagggtacacgcgaaggagttaaggggcctctaaccataggcgcggagatatttgagcttacaccctcccttgtagtagtggaagtaaaaagaaaggcaggtgataatgaagagtatgaggatttctgcaacatggagttgaagccaggaatgcagcaccttgtgcaccagatgctcccagctccaaatggaactcctgtgagtgagaaggttgaaaggtaatgattctctcctgattttacttatatgcattgtagctaaatagggaagcaaggattttgtgttgtttaacatgcgcaaccgggcagaaagttaaattgattgatgcttcagttccaataattacataacaatgtttcacttcttgactatacatcctgtatttcaaattgagcgttcaagagtttgtttgctaaaagttaattgatttttattcatgctatttgtttttgttaacgtatgtttaattcacaatcatgcctattgcctaataccagtatgtagaaggaattagatttccttgcacggacacaatttaaagtaggaaagccttgcaattgaaaacctcgaacaactggaacttttattatttctagagtggtgaaagaatgctataggttttgctgttagattttgccaaccattaactagcttgcctcctgcaatccaatttcacagcgcttggataatgcgtatgtctggaaatttgctgccacttgaccattgcaagtgtgcttcgtgaaaagaagcaaatttgaatggttctaatcatcctagtttgtggctgttaaactgattatagattgttttgtttcattctagagcatgatttggtttatctaacatctgtgctcttttaatctatgctacgaactcaatttttcgtaaaatctttcccgcaccctattcttatggactttttagcttgtgatagattgtataagataaatgtcttttctagtcatcagttaatgaaaacattttcgcttgtcttatctatcttttggagttactttaaaaagtgattatgcactgttctactgcaccttagcttgtaaacttcctgctcttatttatttttctttatgtttccattttttttggataatggaattcaatccagtattgatgatgattccatgttaccccagcatttattggtgttgaatgtttacatgtgtcataattcatattgaaaaaacttttgaaaacaaatatagaaaggaaccgccaatatcatgtccttctggtttccccattgttgttatcaccaacttccatggattggcattgtgctgcacatcagcatatgggatagaatgggagcttgaagggaatgcttggcagtacctccgagtaccgaaatgtcatttttacaaagaacatgtgcttcactagattttcagcatgctaggtaaatgttgaaagtgctgtataggtttattatctggtgtagctccctctgacatagtaataacaggttgctttatgggaaacctggtagattttatctatttaatttggtgaaaccatgaaaatgcaaacatcatggctgagacattgaaaattacaaaacagaaagggcgcatagcaacaccatatactattcatgcaaaccatttctactattttaacctgtgagtttttgatggtttctagtttctttttacattcaaatgggctctaattcctgattttaggaggttcctttcttttcagtttcattgctgttattgataaattatcttttttttcattaatgataactttatactttgatggatctttgttgaacacttaatctggtgcacatgttagccacccaccattataggagaacacatgggacacatttaccttcagaggtaaggagggttatgtgcgtaagctgtgcctcggaggtagataggtgtgtttccagaagactttttgttacatttgtcaacctaattttcctccatcggagtagtacattctgtactgcgcaatactagcatcagttaggaaagttggttcaaatatgctccatggtacgtgggtgtacctggagctgttctgtagtcttgttttgaatcttcaatttaccttgaagaattttgcttttgccagtgaactgttatagtccatttgaattgtttgaaatgctactacaaccggaaactattgctttggttctcatagttcagaactcaataggaaatagaagtctattgctgttattacatacaagtgtgataagactaacagactgacatttgattatttccttcttgtcctgcaggtcttcaagcttacaggctcccctcaccctgaagttgataggaacagaaggcagcatgagctagagacaggagcttccatgcagttgacagggagatctcttttaccggaccaaacctgaccggtctggttcccgttgatgagctcgtggttttgataactagcaagagttctctttctctggatggcctaagatcgtttttaggcaatggatcgagacagtggatgtagatactccggttgtggatggtgcccaggtgggcgtttaaagtggatgtagataccctggttgtggtggtgcccaggtgggcgtttaaagtggattgtactggccagttttctctcgacttagcggctgtgtgcatctgcggtttggtttctttggcagcatcgaataattttgtggtaaccatgattctggtcgggggacagttgattgaggtatgggagggatatgcatgagccgggcatgtgccgaccgattggattccgaatcttccattcctgatgccattagcccattattggatgcgaggtgacagatttgggcactgcagtgcggttggttggttggggcctgtggggactgggggtcgagattacttggacctgctgtgctgcagcggctttggctgaggtcaccgagcacgtgagagcatcggtgggtggcatggttggcctaccccggcagtggtggcggccggctcgggccacgagagcgccgcgccgtttgtggtggcgcacggctctgcagtcggcggcgggcccgttgttgcgcatttccgtgataaagatcaccgtggtatgtcgtattctgttatacaatgctctttttgtggattcgaacttcgaatatggagttatggacacgggtggtcatcgatggagacaacagtggcgaaccggcgatttcatatggctcagtgagatgctttaaggtacataacaatttgaggtatgcattcatttaatcatgacatggcatgattaaccttggatttgtgtgaaagctatcactataacgacctgtactcttggtgatattccccaccgtgccaatttcctggtatctacactcctcaacggatatgtcgtggaaatgcagcatttctaacccaacagatacagggatcatatttcatcctacaaagattatgtgaaagagatcagcataataatggaaatacgcttaaaaagtaaaatcatgaaaattccatgtgatagttaggatcgacaatgacaatgattataatcatatcacaatataagatatagcctattgtaatataagaatttgatgctctgttttataatgttactacctctttacttcttgtttttgaattattctgcctccacttttctttctaagagtaaattgtattttatactagctaaagcgtagcatgtttcgctttgcactgggtcgtttagcatatactttcactttacaccatgttgtattgaaataaggttcacttaacactacgatacatcatgaaaaacaatttcatgaactttacaaaatatggaagaaacgtttgtgtaacatggtttcataaattttattcatactttacagaatttcctcgtaaatatatgacgcaacctagtgtaacgaaacttgttcagatgtactctggtataaagagaaaatatgtttacccattacaaagtgaaataaggtacaatctaccaagtgcaatttattcttcttttaacagtcaggttaataaaaaaagagagcatatatcacttatatgcttggggtgaataaacataatggtcctgtcatttcattttgtcgaattttgggctcgtttggttctctgccattggtaaccttgccaattttttctgcaacggcaagaattggcatagccaaaaaaaaggtagtgaactaagccaaataatttggcaatgttaatttctttttgctacaaatcaaacagtagataatagtagtttttttttgtttggttgggtttggccacaagccaaaagagcctactactatttattatcatttagttcaaacaatactttccccctcttgtagcaacacccttgtgatttatgagggtcgtgcctcacataaaaaactctcggctcacacacacacaagaaaaaaaataacatggccttttaatgaactacactcaattttttggttcgtacttcatcacataagatttacgggttgcaaaaggctcgaaaagccaaacgagaaacactaaatattttcaataccaacggtaactccagcttaagcaattgtagtagctcaggcacttttgttaatagcatttgaaatgacttaggcatggaaggcacagtgacgcca

SEQ ID NO: 285 - DNA, 5107 bp, Oryza sativa
ctatctgtacattatctgtacagctgccaagtttgtattgatcggttttctttgaggttaatttgtaagtatgtttttcttctagtaacttaagtaattatttttaaatctaaggtcaatatgcataacaacatattctgaaaaacttatggataagctgattattcattggtaaaatatagacaggccgatgtcaataaaaaccaatgatgcctgaccgaaacaaatactacatgtctacatccatgctaaaattaaataagttcagttctatacatgaatttgactatattcatatttatgtaaaaaataaatttatttttgaatggaggaaataagtatatacggtgataattgaataccgctcaccaaagatccagctagtagcacacggataaatggctgcaagtcaccaaccatttccggtggtccaatacctgaagaacagccaacccattgatgagtcagcaaaggatcagatcatgagagatgagccaatgccatgcatttgagtaactccaaaccaaattaaacacaacatcacatggaaaactactctaacaaatgcctcaattaacattggttcctcagaaaataaaagttgcagttaacggaatcagattaaagaaggaaacaagtgctcattttctgtaagacagcatcacagccttcagatctataaataggattaggcaaggtgattagtggtacattatgtgctgtacctgtttcaagaacacaatgatgagctgtaccatcatcaattgtgaaataattaattaaattatcattaagccccaagccaagccaaaccaatccaagccaagccaaatgaatgattgctgtggtgaagggcgactagtcaggggtgagtcggatggatatgctctttatgcgatgcggtgcccaggaaacgcggcgcagccaaatcagggtcattaacgtcaaatcaatctctgctaataatgcaaggcaccactgtttcttctccaactggcggctgcctcctctcctcttcttgatcggttccccctgtataaaagagaaccccgtcttctcgctgtcctcgcatccactcctgatactaccactcaaaaactctctctctctacccaaacaggtgttgagaaagaagtgagggacagatccaaaaagttcaccttttgttacctgaatctcctcttcttcctgtcaccggaaggtatgcagttcctctctccatatcatcttctagcgtttctttctactgattcttgattgctcgcttttttccattattctcttttgctccaaggtaggggtaggggcacatcagttggacaagtagaaattgatggcacatcaattgagtagatgcggaaatttatggtttttagttaaagtttagaccaagccgatgacaaagtgctgccgtttaatcgaatacgacgatatgtactcttgcaatggcatgtgtcatgaggtgtttgggtttggcgaggctcagttttcattaatttcccctccttcccatggccgtatcaaacctaatctttgaaaaatattcaattcatgtgggtgcggaatcactagatgcagcttaactccatgcaaatcctaactcctgccatgtgcccatgtgcctgtcccttatcctgatttgcatctgaattcatttgctgagtaatttgcttgttcagtgcctaatctgctagacgtccaaacaaagttttaattatgagcaaaagatctagtaatgtcattttttctaaattcgtaatgttttggtctctgaattcgtaattgactagttttattaatcacctttctgaacttgaacgaaagatgtagaataattcacatcggttgcaaattttaattcgtaattgactagttttattttgttagcttctgatttactgtcctagatttctgataagtacttagttgaagttccttattatattaattatctattacataacacgttgaactcatgtaagttctgattgattctagggaacacttatattatataagtagtaggtacaaaaatgcatttagtattacaataagccttcaaaattcttcgcattaacttttgtttggttaaagttcttacagactttcagattattatacgtaccttgttagcacttgagtgcatatcctaggacattcaattactaaatctgatgcctggttttgtttatacaggggaatcaataaaaaaaacaagcagtgaaagcctcaaggaatgctgaaagatgtgcttgcatagaagaaattttccgtgtgagataaaacagattgctggttcaccagtgctactgatctactcaagtcttgatgtgagtgatcaactttcctgcactaattctacaccatttagactccgaaacgacgatgatataagaatgttgttctccatccacgatcatgaccttggggaggatggctaaagaattgcagtccatctgattggtggtcaaaacatagtgctgagatttatatctttgtgggcatggagagtagagggaagattctaatggagaggtatgagttggggagattgttggggaaaggaacatttggcaaggtgcactatgcaaggaatctggagtcaaaccagagtgtggccataaagatgatggacaaacagcagatattgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtatttccagcaactcattagtgcagtggattactgccacagtcgaggtgtgtatcaccgggacttgaagcctgagaacctactgttggatgagaatgagaacctgaaagtctcagactttggattgagtgcgctttcagagtcgaagaggcaagatggcttactccataccacctgtggaacacctgcatatgtagctccagaggtgattagcaagataggctatgatggtgcaaagtcagatatttggtcttgtggtgttatcctgtttgttcttgttgctggttaccttcctttccagggcccaaacttgatggaaatgtatcggaagatacaacacggtgaattcaggtgccccggttggttttcacgcaaactccagaagttgttgtacaagatcatggaccccaacccaagcacaaggatttcaatccagaagataaaggagtctacctggttccggaaaggtcctgaggagaaccgtattttgaaggaaagaactttgaatgaaaacaccaccaaaaatgttgctccggtgcttggtgtgagacgcaagaaaaatgctcatgaagatgtgaagcccatgtcagtgacaaacttaaatgcttttgaaattatctctttctccaagggatttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctagcatggagatgaatagcagcagtcgcaagagtagattttgatgtctcaagcatttagtttccgctcctcaaattcattaggttttagctcaaatgaatttatttgtcttgcctgtgttctttttagcatctatgtttttgtatctggagagttcatgttgagacaatgtatgcaattgtatttggagagttgatgtttaggcaatttatgcacaatttagatggagtctgtcgagagtaattttatgagaaattgagctgcaatataaaaattggctttgagcctttcaagctttcttcagatattcgtcctgatactgtcataaagctatgtttgggtgcaatgttgtgacaccattagcaaggtttctgcagcatgaagtatgcaattcttggtattcaccaggcactcaagaatttctagagtttttaactttttattatcatcttgttgatgaaaattctcatatcaatagtgctacagaggtataccttatcagatattgaacataagtttttatcaaacaaataaaagaaaaaccgaagcgacttctcattcttcggacgaacaagataacacgagtgcacagtcctacaagatagtagcaggtaggcaacgaaataccaaaaagttgcagtttcattggaagacaaaaaaaagattttttttttaagaataaggatatccttgtatttgccaaatagccacagagagcgaagttattggtaaacaaaagaaaatataatacacatgttgaaaagtctgaacaaaagctatttaaacaccagttgtgagttgtgaggaaaataaattgtccctgtcactgaggatagatccaacatccaagagctcatttttcacggtcctaattgatcacccaacaactttccaagatgttaataatactgctaatcagactgtccaaatgtcgactggatttggttaatctcaacaacccaattgtagctgtgacaagttgtacatatgacaaaggctatactcttcagattgcaacttgcgaatttcccacctagatgcttttgtcctttgtaagatttgagaatttttttttgctttgagaaataatactgagatatcaatgatagattcctgataagatcgctgtaaattagagagagagagaaaaaaaacgttttaagataagtcatgtggtcatgcaaaattcagttctactactatacatttatatatctttcagctgttgccagtttatatacagtagtgtttgtcttgataggatatgctaaaaaaaagccttggccgacaatatgtgatgatg

SEQ ID NO: 286 - DNA, 7379 bp, Oryza sativa
gaagctataggtaatggcacactatgcagcatagacgtgcaatctctctataccactcatcctcttatgggattctctatggccggatcgattgcatggtagggatgcaagggctaacgacgactattgcatccgtctcaaaaaggatgtgtttctactatttaaaatttatcctaaaaatattatacctagaacctaataactaattaatttgagaaagctaattaggtgaactaattggctgaacatacctagcgttctatgcgggggatgtgaaatttctttatcttccattttaagtttactggttcacttatatatttgtccttgtaaaattaacgggttgtttgtctaatgctctttcatctcaatgtgttaatagtatagggtttatatgctgaatttgtctcaacttttttaatttatttttggatgtgtggtctagctagtttggactgaatataaaaaaaaatggagaaggaaggaatcaaacctagggtggctatactaaccgtgctgctagccattaggcccaagttagttttttttttgactaaattttgtcgagtggtaaattcttttgagaatttttcatgaatggttttcgaatacataataggatatccctcgagggttcaaatgtgttaccggccgaactgcctgcatacaactcccttgtggagtacaaattaatggccgcccagaattctggattccggtagtgtatgtatatatgtgacctattatattcccacttgtattaattcttttacgtgtttaattatatcgactttaattacctctcacaaaccatggtatgcatgcaacaccatgtaatctagattctagaaggatatatatcacccttaattagcctttaaaaagactctcccctaatctccaaaacgacaaaccaaaccaaaccaaatctttcagtccttgtcacacagatctcagagagcctcaagtctcggtcaccacagctctactgtctatctagctatctatcagctgccttccatcgtcagcacacaaactacacaagaatctgcttatttataggccaccttgtcccttctacaatggtgcaagaacacacaaattcacacacacactgacacacacaaaccgatcgattgattgattgataatgaagcaagagcaggtcaggatggcagtgctcctcatgctcaactgcttcgtcaaggccacggcgccgccgccatggccgccgtcggcttcgtccgcctccttcctcgacgacctcggcgacctcggcatcgcgccgctcatccgcgccgacgaggcgggcaccgcgcgcgcctccgccgactttggcaacctctccgtcgccggcgtcggggcgcctcggctcgccgccgccgccgccgtgctctacccgtcgcgccccgccgacatcgccgcgctgctgcgcgcgtcgtgcgcacgcccggcgccgttcgcggtgtccgcgcgggggtgtggccactcggtgcacggccaggcctccgcgcccgacggcgtcgtcgtcgacatggcgtcgctcggccgcctgcagggcggcggcgcgcggcgcctcgccgtgtcagtggaggggcggtacgtcgacgccggcggcgagcagctgtgggtggacgtgctgcgcgcgtccatggcgcacgggctcacgccggtgtcgtggacagactacctccacctcaccgtcggcggcacgctgtccaacgccggcatcagcggccaggccttccgccatggcccccagatttccaacgtgctagagctcgacgtcatcaccggtacgtagatccatcacatctactaagacacgcgccgccatgatcgaggtaattaaggtataggtgttttgacgtatacatgtatctgcaggtgtcggggagatggtgacgtgctcgaaggagaaggcgccggacctgttcgacgcggtgctgggcgggctggggcagttcggcgtcatcacgcgggcgcgcatcccgctcgcgccggcgccggcgagggcgcggtgggtgcggttcgtgtacacgacggcggcggcgatgacggccgaccaggagcgcctcatcgccgtcgatcgcgccggcggcgccggcgcggtgggcgggctgatggactacgtcgagggctcggtccacctgaaccagggcctggtcgagacctggcgcacgcagccgcagccgccttcgccgtcctcctcctcctcctcatccttcttctccgacgccgacgaggcccgcgtcgccgcgctcgccaaggaggccggcggcgtgctgtatttcctcgagggcgccatctacttcggcggcgccgccgggccgtccgccgccgacgttgacaaggtatactagctagctactagcttgctctgcgctgagccgaccagagcgggtcccacctcgtgatgatggcgggaacaactaagctgcaaaaacttttggcgccacctggggcttacgcttacgcacgcatgcaattaaggggtgttctagatggggctaaaactttttagcccatgtcacatcggatgtttggacgctaatttggagtattaaatatagactaataaaaaaactaatttcataaatgagagctaatccgcgagacgaattttttaagcctaattaatctataattataaaagtttattgtagcatcacattgtcaaaatcatgacataattagactcaaaagattcgtctcgtgaattagtccaagatatggaatatgttttataattagtgtatgtttaatactccaaattagtattcaaacatctggtgtgacatggacttggaataagtccgtggaaaccaaacagaccctaacggtgcatgaaattgaagtctcttgcgccgtcgacatcgtcgtacttggcctaccacttttgtctgccacgcgatgcacctctcgctatcacacacctaactggaagtaattaaataattattcgattctgtgttaatttttttttatcttccttagttcccggagagacaaagattagatactatagtagcaacttagtaagctagtatatggagtattaggttagtcgctctcactaagcttaaacaggtgtataaaatatatgcatcgtctgatcgtgacatattcttttagctacttatggtgaaaactttttcgtccaaaacagtgaaaagcatgcgtgctagtgtaggtagtagctaccaggacgaattatatcattaacagtatttgtagcacatcaaggaaaaacttgtctttttaaacactgttacagtcttcagaacgcacaactttaacaggtatttttgtattatatttttttaaaaaaaaataaaggtaataaaattatggtattgtaaaagtatatttttaaggaaaatcatataaccaatcaaaagtttatgaagatatacatattgatgttcaaagttactaaaagttgacttaaacatcacattttcatcttgaccaaagagggttcatatatatactccctcaattttaaaatataagcatttctaattatatgcatctagacaaatgcatataaaaatactttattttttaaagtgagggagtatcaattttgagcatgtagctagactagattagtgtatgtctacgcacatatctgttgttctgcacaaaactactactcatcggtcctaaaatataagaatttaaaattggatgggacataccctaatacaatgaatttagacatggacatatactagtaataccatgtactacctccatcccaaaataagttcacttttcatccatctcacacataccaatagaaagtactacaaatttcggttattctctattttcacaaactccgatgcaatgattattttaaaaataaacttattttagaataaatggaatgagcaaaatataaactggtgtgtttgaggagaaggggattgaggagattgggaagatacgcaaaacgaggtgagccattagctcatgattaattgagtattaactattttaaatttcaaaaatggattaatatgattttttaaagcaactttcctatataaaatttttacaaaaaacacaccgtttaatagtttggaaagcgtacttgcggaaaacgaggtgctttctccctcaatgtcgtccaaacgaacgctgccttattacgggactgaggaattagagctttgccagaaagaaatcagcatcgccagcttggacctaccatccatgcatgcatcatgtggccattgacacatcacatagtatgtgctagctagctagcttttgatcatagttacatgtatctagctaggctagaagctggaaaccgatggatatgatggatctctcatggatgacaggccagccaaagatctgtgcgccactagatacagtgcatgcatcagcttgtatggttataaccctagctagccagctttagcacacacatgcatatgcatgcatgagcccccatcttttgcaacacgaccgaccaactatgttggctctatatagatagctagctagttattccatgcatatacagtttgcatttcctagctatagcttttgctatgtgatccgagaagatcctgcatgcccacacgtgacacgtcacacacacatgtggacaaagtactgcctcactttatccttgcatgacgtcacgtcgccacctgtccatccacgctgctagtgctggcaaaattaataactcgatcaaatttcggtgatctctctgcaaagaatttgatgaattttaccaacatatatgctttaatttctttgcttgattttatttgcagaggatggatgtgctgcgtcgcgagctgcggcacgagcgcgggttcgtgttcgcgcaggacgtggcgtacgccgggttcctggaccgcgtccacgacggcgagctcaagctccgcgccgcggggctctgggacgtgccgcacccatggctgaacctgttcctcccccgctccggcgtcctcgccttcgccgacggcgtcttccacggcatcctcagccgcacccccgccatgggccccgtcctcatctaccccatgaaccgcaacaagtaataataataataaaaagctttactacatatacacatgtatataatttttacggggtggattttttcgttcaaaatgacgacccctcatattgtgcgtgtcgtctgaaaacttattaaaatgtttaaataaaaaattaatatgatacataaatatattatatatcactatataaacattgtaatcttaaactcaacttgcacaagtagtaaaaaaacaaatttgactgcaaatagtgtgtactaagttatttatttacttatgctagtatgctacttgaatttaaacgtacatatttatgaagtggtatattatatatttccagagtatttttatggttcttttacgacatgaaaaacaatgtccgttctcttgaaggatgaatagactttccttaattttaacatatatggtggtaactaaacatacacacacctggatatgtttcaggtgggacagtaacatgtcggcagtgatcaccgacgacgacggtgacgaggtgttctacacggtggggatcctgcggtcggcggcggcggccggcgacgtggggaggctggaggagcagaacgacgagatcttgggtttctgcgaggtggccgggatagcctacaagcagtacctgccttactacggcagccaggcagagtggcagaagcggcacttcggtgccaatctctggccaagattcgtgcagcggaagagcaagtatgatccaaaggccatcctgtcccgtggccaggggattttcacgtcaccactcgcatgaaatgacacatgtatgcaaatgcatatctacatgcgtatatatacacgtatatatacgtatgtatgcatacacatatgggtgtactgtgcatacgttatagcacactgcagctaattaagcttgacagggagatcgatcaatggacaatgctctagtcaagctaatataaataatggagtagtagtatatatgtagtgcgagataattaagtagtgtgtttgcctactaaaaggagaggcaaagtagtactgtgatgcatgcatgccaactaataggtgataagtacgtgtgtgtggccgcatgtatgattagaagaagttggtttttaattaattaattaggtcatgtatgtaaatatatagtacagtactacgtactactagtgtactaccagccaatttgcatgcatgcatggatgccttcatatgcatgtcgatctcaaacgtacggcatgcttgaatgcatcatgatgcatatctatcgtcgtcttgtgggtgtaaactaaattaatcttagttatatgtattataagtttgcaatatttttccatgcatatgaatgctagtaagatatccctccttacgtccaagaaaaaaaaatttacttctagaatacttgtatatctaaattcattcatatatatatatatatgtatatatgtgtgtgtgtatatgtatatgtatatgtatatgtatatgtatatgtatatgtgtgtgtgagagagttttgttttgggggagagagatctagatgctccaaagtccattctcatacagtatttctcacgaaaagggaagtcagcttatactaataattatcacatactcgatcagtccaaaagaaattcaatcttgaatcgaatgtggcacctcctaatataacgaatctagacaaccatatgtttaaatttataccgggagaagatgtaggggttacatttttctcttagattaagtttttttttacggagggagtacgtgacaacggggcccgtacgtctacgtgcacgtacgtacagcgctgtacgtagtacagatggaaaatccaacgttgaaaatctcttcacgtcatgaagacgtggagagatttgtgacgtgaagagattttgtgcgacatgcagcagcagtagcaatctgtactgtgagagtgacgacttgtcacctatcctgaattattagtgctcgatgttgggtgtacaagctagatccgagccagatctccgatggtactaccgctgaaaggaacagtactgcatgcataactgtgtaggagtatatatatatggacaaaagttactttattttatacctaagatatttacaggagacttaaataagtatgttaaaaaaatataaaattagttattatcgattaagatgataaaataagtccataaactaaattcggtttacaactaggaaaaaaaagttaaatcagctagccgtagtacatcgctaaacatctgcagtgcaattagcatttgttatttttggtcgaatttagatttacgtgtttatgtaagagcttgtatcatcgtactc

SEQ ID NO: 287 - DNA, 6780 bp, Oryza sativa
cgccttctctagctcccggtgccagacaaacacggtggaaaactggaactgtatgtggttttcacacccgtgacacgtgtagcgtaggtgtagccggccggtgaagaaacttccggtctgtgcacacacgcgcgcggctagcaggcaggccgggttccgttcggttcgcgatgcgtcggccggccacgtcgcgcggcgcggaagcgccgtgacacatgcgccgacgtgagcgatcgatcggcgggtagtacgtcgcactggggaagctgctcacgtggacggaatgggcgcagctgctgacctgacaccaccacggggccccgcgcccgcgaaacgttgccgatatatactagaagagaagtcccccgcgcgacgtcgacaagtcgacaagtgcgaggagctagccatgtgggtcgtgcccgcgcgcgccacggcacggcaaccccggaaacggccgaaacagcggccaacgccaaaagtccaaacctcccccgcgccgcggccgccgatcatcagagcccgccgacggccgcgatcgcgcagaccgcgcacggcgtggcggggggaatcgtcgcagtcggacggagcgccacgccttttgaccgcgcggtgtgggggggtgggtggtggcgtacggcggtagccggcgcggtagaaccgatcgatcgatcgatccccccacgcagataaaaccaaacccccgatccctttctaccgtcccaaactccccatttccaacgtgaattcctcaccctccttccttccttgcgtgtttccttcgccttccgcccggtatttcttataccccccctcgtccaacccggcgctattcaattcaccgatttcgttcgttcacccaccacaactcctccagcgagtcggggactcggggtagatcgtagaaatacggagtatacatacgtacaccgctacatttctagattacagtatttacagatacgtgggcaacgtgatcacgcagcttattagcatttgttaagtgcgtagttcgttcgttcgttgattgattgtgttgaattaattgagaggggctaaagatagtagtagtggttggttggtgcggttgcggcgggtgatcgaacgatggaggtgtgctgctgctcgacgtcatcggccgtgcccgggaggaggttcgcggcggccggggcggcggcggcggcggtggcggcgaggtggggcgccgtgggggtcgggagggcggtggtgctggcgcacccgctgcgcccggcgccgcgcggcgggcacgcgcacgcgcagcaggcgggcgcgcggcgggcgcggcgcgcggtcgtcagggcggtgttcgagcggttcacggagcgggcggtgaaggcggtggtgctgtcgcagcgggaggccaaggggctcggggagggcgccgtggcgccgcgccacctgctgctggggctcatcgccgaggaccggtcggcgggcgggttcctctcgtcggggatcaacatcgagcgcgcgcgcgaggagtgccgcggcatcggcgccagggacttgacccccggcgcgccgtcgccgtccggctccgggctggaaatggacatacccttctccggcagctgcaagcgggtgttcgaggtcgccgtggagttctcccggaacatgggctgcagcttcatctccccggagcacctcgccctcgcgctcttcaccctcgacgatcccaccaccaacagcctcctcaggaggtaggtagctgttaaactgcttagcttactattatatccgctttgattctgttaggaaatttttattgctgctgttcattatcacctcaatttctcatccgatccactctgatgccacttgtctcttgtaagcacaacgacaatcactccaattgtttgtttgttcctcataagaaacacacaccattttgtcatctgatagtaatataaccttttagctagtttagaaaaagtccatggataatccatcaccaatcagtgttttaatgctataccgaaagtttaagttggtacagagaggatctaatgaatgtaactcactgtacttatggaaacaatatgatggaatcattttaccatgataatttgttaccctgtccttttcaccgtctgtgccaacataaatagatcttgttatttgttgcagcttgggagcggatccgagtcaactagcatcagtagcgcttacccgactccaagcggagcttgcgaaagattgcagagaacctgcaggagcatcatctttcaaagtacccaagaaatctcctgctggagctggaagatctgccttctcgaaatctttaaattcaaagaaaggtcaggaagctgctgtttattgaagctcatatgcatgattgttgatggtattggctaaggaagttgaatgcaactttgtcatgtttgccatttcagaaaagggtgcgcttgatcaattttgtttagatctgaccacacaagctagtggcgggtttattgatcctatcattggccgtgaggaggagattgaaagagtagttcagataatatgccgacggacaaagaacaatcctattcttttgggtgaggcaggtgttggcaaaactgcaatcgctgaagggttggctcttcgaattgcaaatggagatgtccccatttaccttgtggtaagcttgaattgcaaatgatggatgatacaagaaaattcgttttgtaaaattcagctttacaacaatagtattctcagttctcacatttaaaattaccacacaggcaaagcgtataatgtcattggacgttggtctacttattgctggtgcaaaagaaagaggtgaactggagtccagggttactagtttaattcgtgaagtccgggaagcaggtcagctagtaatgctatctgaatgttaaatcatacataaggctttctggatttgatcttgacattcaaggttgcctccaaatttggtgcaggggatgttattcttttcattgatgaggttcacaatcttattggatctggcactgttggaaagggtaagggtgctggccttgacattggcaacttgctgaagcccccacttgctagaggtgaattgcaggtattacatttatcatgtttcttactacacgctcttgttctatgtaggaaagaaagaacatctttcttaacaaccatatttcttatcttataggcaatatttctttttatttttagtgcattgcagctacaactctagatgaacacagaatgcattttgagaaggataaggctttggctcgccgcttccagccagtattagtagaggagcctagtcaggtattgcagatattttcataatgaagttaggtgattttacttgtacatttgtttctcaaccacaattagaacacattgcaggatgatgctgtgaagatattacttggtcttcgtgaaaaatatgaaacatatcacaaatgcaaatttaccttagaagccatcaatgcagcagtttatctgtcagcaagatatattcctgacaggcagctccctgacaaggccatcgatctgattgatgaagctggcagtagagctcgaatggaatcatttaataggaagaaagaagggcagtcttcaatcctcttaaagtcgccagatgaatactggcaagagataagagctgctcaaaacatgcatgaagtggtaatggggcatttcctacttgttatatgatgattttgtttggtccatcatcaggtgttaaatatataacctgttctgtcctaaattactcaggtgtcatcaaaccagatgaagtattcccctcgtcaagagaatggcagtgctgccattaaagcaccaagcgaggacatgaatgagttgacatctgaactccaagttgaggagtaagttttctcatgacaacatgtgcactataatctccattatctgtcctctcacaatggaactttattggaataatgcagaccaattgtagttggaacagaggaaattgcaagagttgcctcattgtggtcagggataccagtccagcagttaactgctgatgatagaaagcttctcgtaggactagatggtgaactcagaaagcgtgtgattggtcaagatgatgctgttatggcaatatctagagcggtgaagagatcacgtgttggcctcaatgatcctgacagacctattgccactctacttttctgtggtccgacaggagttggtaaaactgagcttactaaagctctagcagctagttattttggatcggtaagtcattctatccatgttgtgatctggttattttgacacatttgcatatgattcatagaatgtggcttgacaagggttttttctggtaaacaggaatctgctatgcttagattagacatgagcgagtatatggagaggcacactgtgagcaagctcataggctctcctccagggtacatcggatatggtgaaactggtactctgacagaagctgtcaggagaaagccatttactgtagtattacttgatgagatagagaaagctcaccctgatattttcaacattcttctccaaatttttgaagatgggcatctgtcggactcacaggtactacatcagtagattctgatatgcaactgctttgttacatgtccattagtaagtttcaaatagtagagttacatggacaattttttgcaatgttctatccctagaaagtaaactaaaaaatggttctgcatttatatttctcattgttttcggatgaaatttaaagtagttcataatcatatgccgaatatgttttatttacgttagagctttgtgtggactacagggccgcagagtgtccttcaagaacacattgattgtcatgacatcaaatattggttctacatcaatttcaaagggaagacgaagcatgggtttcatgacagaagatactgaatcaagctcatatgttgcaatgaaatctctagtaatggaagagttgaaggcatttttccgtccagaattgctcaacagaatcgatgagatggttgtattccgtcccttagagaaaactcaggttagtttcttactcttggccctgaatttcttaaaaaaatcttacatatgcttagtcaacttatataataataactccgttagtcagttactataaatacctgataaaatattttatttagctatgcaactagttagacacacaactaaagtgacataattgtcaatgctaattcctattctgcagcttctgatcagatgagaaactaatgccccatttacatgattgcagatgctagcaattcttgatatcatcctacaagaagtgaagggtaggctgttagcccttggaataggcctcgaggtgtccgatgcaatgaaggacctgatttgcgaagaaggctatgacaagagctacggtgcgcggccactgaggagagccgtcacccacctgattgaggatgtgatcagcgaagcaattctatttggcgaatacaagcctggggacacgatactgatggatattgatgccggggggaaactttgcatgagccacctgaatgagaaggttgtccagttgtctgatccgacacggacattctgaagttctgcatactgcttagtacattagagatctaatttttcattctttcgagattactaattctttttttaggtagacacggaatatatttcattatgtacataacagttaagggattcgttcgggcatataaatgtcttaaaacttgtacccaactgtatattgttgttcaattgatcaaatatattattttgaaaccatagttgcggaatgttatcgttgattcgtcattaattttctgttctgtgtattcacgaaacaagacttattttaatggagtaggttacaaggatacttcctccgttcctaaatataagagattttggttagatgtgatgtattctagtacaacgaatctagatatgagaccatccgtgtggtgaaattatacaaaccacaacctaagttatatgtgaaaactgaaaagaacatacgcggaggtgctattgaaatccttgaatatacgtacatataaaacttcactatctagctcaaattcatttcgaagatatgaaatctacgaccattagaacgtatagtataaatactacatattgaagtttcaccgtttcactctgttcatttctgtgtttctgaatttcgttccttcaaactaaatcaagttttaacatctctgtttgtgaatttcattccttgcagactaaatcaagtttgatcaaatttttgcatggttagaattggtggtctccacacaacacattcccaatctgctagatgttgctcatcctatttactaatttctcaacatcgtagaatgacacgtacaacatcccaagtttttccttgtcagttgacacaacagaatcaccgatgcctttactagacacaaaaacattttattcgccttgcaaatgatctgcctcttgaacaggatgtatacaatgtatcacaagcatgtgactaatagttgcacaaaattcaataggaagataaaaactaattaccatccaacagtaactagccccccccccccccttctctcaaaaaaaaaaaacctttatgatgaatacgttgcctaggaagcatatcataaaaaaaacaaagatggcatagcttcagataatacagtcctacgcaatccaaggagccatgagccaagggctgagaggcttcaccgtgcttttccaaactcaggatccctggaaaaaaatatataaatgacatcagacagaaatttggcctaccttgca

SEQ ID NO: 288 - DNA, 5436 bp, Oryza sativa
aaatttgtaacaaatagtgaacaattttataattgagtgcccaaaattgaaccaagttaacggagcaaatttaatctttccttgaaagaataactcaaaaggaaaaaaaacatagtaacaacctcattttttggcttaagcttatggttatcagccaaaatttaaattttcaaccttaaatttgagttgattttggggaattttcatcgaagtttattttccagcctttgcttttagatcgctaagaacacgtatataaaagtcttattcacaaattatttttcgtttacaaatatgccgtttagcttatttttttgaacttcggctaattaatccctctatcttatatggatgtggagacttgggtcatatgtttcttttctattttcttgaaatttttaaataaaaattcaccctcttttaatttatttatgcataacagtacagttagtgccattacaatctatgtcgtggtgcggtaaaaagtttgaaattttgtaacttgttgtagatttgtagggtttattttttaaaacgttaaaaatgaaatattaaaaagccaataaatatttctaatgaaataatcctttttctttttatatactcctatatacatattcgacgattttagcgttcttttttcgggtcgtgagcacagcgtggtggtactggcactcctatatcggagtagtagttcttttttccttccgagatcttccatagtcacagccggttgaagcccccatccgacgtggcgtcccctctggcccaggcgtcaccagtcccacgtggcgccaccccattggccgccaccacgtcgcgcaccttctcattggccggaacaagtcacgccacgcccgtttcctcggtcgcccccccgccccgacggcccgatcgacggatccccgccgtccgctaccccctccccctcatcctggccgtccatccgctccagttccgcctcttcttataccctctccccccctctcttcatcccccaagccgcggagagagagagagagagagagagagagagagagacgcagctctgttcttcttctcctctctggaaatttctggatctcgcgagagatcgggaggacgatggtgggtgggcgcgcgctcctgccgctgcttctgctctccgcgctgctcgtccagatccgcgcctccgatccggtaagcggcgagttcttttttggtttccttggtggagaatttgcttggagtggtggtttggggggtgagatttgtgatgctttttttttgtgttggatttctgtgtgtgcttgcagctgttctatgagccgttcgacgagagcttcgaggggaggtgggttctctccgggaaggacgactacaaaggtatgcttaccgccgcatcgagatctgtgggtttagcgggtgtgcttggggggttgcaggggatgctgatctgttcatgggattcttgctctgctttgcttgcttgtaacatgagacggtttgggtttgtgcgcatccttgcgagaatgatagtgtgtcaatcgcatagttcgcatcgagatccacagatgcacacatggtcgagatccagcagatgcatttcatcttttggtagatcggatctaaccagctagctaatcagtagtagtaacatctgtagtgtaggggactgtgattccgtgaattggctcatgcgattgcggcgtcacgatatgctggtctgtgtcgtggaccctgtgagcgtctgttttttttcccttaggtagtactagtacacacaacgctaataatcaactagccgttgcgatgtggcttactttaattttgttcctgctcttataggattatcgtaaatatgctttaactaaattgcatttaaagtttgtagtatatgttgatcctgtggacgttgccagcttatttatatatgagtagcctcactacctgttcctcgtgtgaacatatcgtaatggcatccgcgtgctcccctggacagcattttgtgtaattccttctgtattgacctgatggtacatgaggttatttgaattttgaaatgaagaaagctgtcatgtatgctgttgccacttgtggcgttttgttctttcatctttacttcaaaaattctccatatgctaagtcgtgaaattgaaaggcatgtctagcttgtacagtttgcagtaaacatatctacttttcattttatctgccagtgtaagattacgctaattttctacctcaattaaaaatttatgttttttcaatcggttctttatagcgcacataagatggcttaaatggtgatgtacttactgtggtttgcaggtgtatggaagcacgaaaagagtgatggacatgaagactatggcctgcttgttagtgagaaggccaagaaatatgccataatcaaggagcttgatgagcctgttactttgaaggatgggactgttgtcctgcagtttgaagtgaggcttcagaatggccttgagtgtggaggtgcatatcttaagtacattcgtcctcaggatgctgcatgggatgccaaggagtttgataatgagactccttacactattatgtttggtcctgacaaatgtggatcaactaacaaggtgcatttcatccttaagcacaagaaccccaagactggcaagtatgttgaacaccacctcaagttcccaccttctgtcccatatgataagctctctcatgtctacacggctatcttgaagcctgataatgaggtgagaattttggttgatggggaagagaagaagaaggcaaacttcctttctgctgatgattttgagccatcacttatcccatccaagaccattcctgatcctgatgacaaaaagccagaagactgggatgagagagctaaaatccctgatccagatgctgtgaagcctgatgactgggatgaggatgcccccatggaaattgaggacgaagaggccacaaagccagaggggtggctggatgatgagccagaggaaattgatgatccggaggctaacaagcctgaagactgggatgatgaggaggatggagaatgggaagcaccaaagattgacaaccccaagtgtgaagaggctcctggttgtggtgagtggaagaggccgatgaagcagaaccctgcttacaagggcaagtggcatgcgcctcttatcgacaaccccaactacaaaggaatctggaagccccaagagatccccaaccctgagtacttcgagcttgacaagcctgactctgatccgattgccgctattgggattgagatctggacgatgcaagatggcatcctgtttgacaacattttgatcgctgatgatgagaaggttgccacttctatcctggagaagtcttggaagcccaagtacgaagtagagaaggagaaggagaaggctgaggaggcagcagcggcagcaggtgatggtctttctgagttccaggtaatatattcttccaatattcctctgctgtatgtttgttagtttatccatcaacatgtagaatatactggcttcatgttgtgagtaactgagttgccatgcacattgcagaagaagatctttgacgttctgtacaaactcgctgacattccattcttggaaccctacaagactaagatcattgtaagaatttctatcctctgtgacttcttttgtgttcaaagctcttacggtggattactagctgttaggtttatccttctggaaggtgacatcttaccttcgtcttcccttcacaggatgtaattgagaagggagagaagcagcccaacatcaccattggaattctggtctccatcgttgtcgtctttgtgactgtgctcttcaggatcctgttcggcggcaagaagccagcggtaagttactctcacaacatacatatgcttccgctctcctcgtttggtagttaaacaacaatggctgatcgtaagatttgcattccctaggctcctgtgaagcccgtagccgaggtcaaaaaaccaaagtctaccgagtccgaagcagctggaagcagcggtggcaaggaggacgagaaggaagaggaagagaaggatggagctgctgccccacgccggaggtcccgaagggagacatgagacacaacataagcctttgattttgacgtcttatcgcggccattttggcggctgcttttttcctttttcgagaacttgggcttttatgttttttgagtgtataataggagattcatgtcgcctatgctccctgcagatgatgatttggtacccctgcttaaatggttagaacttcacggacagtagaagttagtcatgttgggtttatttgtgtgctgtgcctgacatataatcactttcttgatcacctagtgattattttctcgtagatagttgaaacatcaagagtctctttcagaagtgtgaggttcagtgcaagctagttattatctttgctgcatttcctattcttttgctgtgtaagttactaccacttgcaatttccaatcatcattgcagcaatagaagttgcgggcatattaagcatcgcagcaatagaaatcgctagtctccgatagcgtcttaaagcgttggttttcgactagcgtcagaatagagagaaaagcgggcaactagaaagcggaagcgggctaagaacagacttcaatatcatgaaagcgggctatagatttatagtcagctacaacacggacgttaatgtgttgtgtatatatatagatttatagccagctacagcacggacgttaatgtgttgtgtatatatgagaagtaggatcatatattaataccataaataatataatatatgcttataaataacgacttatgttgcagcacggacgttaatatgttgtgtgtatataaaaagtaggactatatattaatggtgtaatatatgcttataaataactattgtataaatgattggataacgagttgttggatatactattaaacttgctcaaatggattggtggctataaattaattggagcgagttgttggatatactattaaatatactattaaatattaaataagctctaatggattggtggttcgttgcctctattttaaatagggtatgacatacctgaatcggttcgttgcctctattttaaataggatacgacatatttatccgaatcttctgtctcgtttacttagcggagtgatctctctcttaaatttccattagagcaggtacaataataagctataagttgactacaaacttatacggagaagataagagaggagagagaaaagaagcaggctacagatttgtagccagctgcagcacgaactttaaaacgttgtgtgtgtatgatatgtgggaccaattagtaacgtgtatgtatattttgtagctaattattatatgaattagctattaaattgactataaataatttagagctagtagctggctatactat

SEQ ID NO: 289 - DNA, 6762 bp, Oryza sativa
gcggcatgggtattggtaaccaaagtgcatgcatcattggtggtagcaagagcacacccagtagtgctgcagttggcgcgcaatgggtcagcagggaaggcagtatcattccaagaagatgaatcatcggaccatttccaagcaaaagccgaggcagtgttgttgcgatgacctccgacccagcatccagagggggaaggtccacagagagactttgcaagattgaggtcttgaagtgatgatagggcagccaaatgagcggtgaagttgttgcggcagagagcctcggatctgtcccaagaaaggggtgtaggtatgtagatgaaacacttgtcgagagcaggagtgatttgccaaccatcagggcatgatgctgcagagaaatgggtggcagttaataataataataataataataataaggtagtaagtatgaataatgagaaccctggcatctgatacaaggacgacagtagagtatagtgaagttaaagaagaaggtgtgacagacatgaggatgaacacaacacaggtcgtaaattaattattaataatatactaatggtatccccattacatttacatggtcgtgcggagaaagtgtagccgaagaaagggtgtaggtggcggggaaaaaaaaagaaatcttgttttatatataaatttgtgtgcgagtgtagaagaagaagaagaagatgtaagagaggaattcgttgcttgtttgtgacagacagattgatgtggaagagtagttattaggagggaggaagcaagggcaaaaggagagtagaaagaagaaatagaagagagatgcatgcaggttgaggttggcgagagagatagggaaagaagtgatggatgcagcgcccctagtactaactggagtagtagggatctagtcaagtgtagtagaagcagtagagaaagaaagtagtactcctatgaggcaggcgaggcgaggagggaatacatacaggtggaggtggaggcggtggcggtgagggaggcgggcaggatgaagaagaagaagaagaagaagaagcggaggatggccgccgccatggccgccgatccgtgtcttcccttgcggccttgcccttccttccttgatgatgaacaaagaaagaggaatggagtagaggtgggaggaagcggtggtgtggtggggtggggactaccaccattaatgcaaatgggctatcggcccaacatactccattatgggcttctgtgggcctactcctcgattcgtttgcgttgcggtgcgtcgcgtcttcctcctcctcccgtcttcgttgtagtagcttgtggttggcaaatcaatcgaatcgatcccctctcatccgctcgcggacacagaatctctcctctccctctcggcgcccaggttctcgccgccgcccgccccttccttctcttctcctcctacgtacgtaagtatcgattccatgcccccctcccccatcccccatcatcatacgatttctagggtttcatgcatcggggatgaatcgtccatgcgatttaattctattccctattactatattataatcgtatatagagattgatagatagatagatagatagattcttcttacaacaagaagaataaaccaaccccaattttttcccaacctctatctaataatcaagctgctccctactttaacaatctctctcattcttctcaattcaattctactactgtactgcatttagtctcatgcttcattgaattttcactcaactgcttgccaccaatctttctttcatgcaggtaaataatccacctacgatagatacgaccaaccccattatgagctctctatgcccctttgccaaactcgcctccgctggcgccacatgccccgtaaaatcatcatcagacaacaaaaccaccatcaatcacaccgacgacgacgacgacgacaatgaaaaaactggcaatgctaacaccgatcctcgtgtggtgccaccaaagtgcccctttggctatgactccaacaccttcaagcttggcccactcagctgcatggtctgccacgctctgctacatcaaagcagcaaatgcaccccgtgctcccacaagttctgcaagtgcgtagtatcatatttcaatactagctttctactagtaattccttccgtccgtcaatagtatataccttctgaacactggatttccttgtcagggcatgcatattgcgctttaaggactgtccattgtgtggtgctgacatccaagggatcgagcccgatgatgagcttcaaggccttgtcgaccgcttcattgatggccatgcccgaatcaagagatcacatgctgcaggcgatggggaagccgcaagtgacaacaagaccaaggtcatttacgaggatgtctccatggagagaggggcttttctggtccagcaagcgatgagggtcagttacgctcagcttcttttacctttgaaatttgcatatatccttcatcctctgctctgtattaatttattaatgctctctatatatattttgataatacctctgacttttacatatccaggcctttcgcgcacagaacattgaaagtgcaaagtcaaggctcagtatgtgtgcacaagacatcagggaagaattgaaatctaaacaagacaaccaagaactgtgttctcaacttggagctgtgttaggaatgcttggggactgctggtacgacaattttctcttggggactggaggatatatgtgaacctgctattgatacgtttatagcctactcctactccctccgtgtctaaataatttacatgtttgactttcccatttaaactttgaccattatttgctcttaagttgttagacctaattgaacaaaagtttgattcttatatttaggacataacacactttaatagcatggcatcatttcttgtgtttgtaaatatataacaaaaatactagtggtcaaagttcaaaagtgaatcgtgcctgctatcagtcatttaaaaacgaagggagtattgagctaaattcttgcatgctttttttttcttctaattgagagaacagttcttaactttgaaatgtctgtagctttcctcaaaagaagagagatgctcaatgctttgtatctgttgtgcacgagggcccattctagccttggcccgttcatctttctgctcattcagggcctagttatctttcatgtgttctaatacctgaattttctatgttttgactaggcatagaacttgccttccgaacaagggaaaggtgaatcttgttgtaataacgtttgttctccattaaaatattaaactgttatgtgcctcagcgtgttctacaatactgatgcacagaccacagaggttgtctagcaggttgtagactgatagtgatgccaattatgactggtcgcaattcgtctgaatagaagtatattcacagctcggaaaacgtgggaaacctttaaccatgccctacaccagccagcatactgatgccaatagcaagctgatagcttgtgtaatagccagctaccagctaccaagagcctagttctagtcaggatgtctggtacctgctcatataaaagcctcagggtctgtcataagttgttgctgaactcattgtgtttccatgtcactggacggtgttttgtttttatccctatgttataatatctggctgaactttttccatgaatttcattgtgctctattatttttcataatatttgtgacacataaccatggcagtatttagcttattttttctttgtttgttcacaattgacctcattccatgccacagtcggaccttgggagatgctccttcagcaatcacttactatgaagaaagtgctgaattcctctcgaaattgcccaaaaaagatctggaggttgtattttgttgttaatatgatcataatagcatgatagtaagttctcatgttgatttaacttttgcatacatctacagttggtccatactctctcagtttcactaaataaaattggagatcttcgctattatgatggggacctccactcagcaagaagctattatgcgcgttcgttggatgttcgcagaagtgcagcaaaagaacactcagctgtggcttcccaggtaattactgtgttactgattaagattagctataaatacaaaatgggctgcagttatcatcttagaaacagaaggaaccttattcatcactctcttttgtccctgctcttttgtgctagctcttccatatcattacgctagtagatgtatcttatatgttccatgaaaatgatatcaacagatattgatcaaaagttcttccttatcttagatttttattatacaggcataattagaaatgttaagtgtttaaatgtgtattagataccatatcaatgagcgctccaattgcacatggaccagtagctattttatcccataattcatggtcctggtactgattgacattgcacataatacatactagtaggcagagaaaaatggatgtaaaaaaggggttcctacacagaatttttgtattcctttctctgaagcaaattgttgtctgaagtctgtggtagcaagtgccagaccatactaggaagtttggcaatttgccataaatgatggctacagatcttttaacctatatttatgcttgttcccaattcaaccgtgccaataaaattgtcaataccattgagatgatggctttatttcattacttagtctgtggccaaaaaattggcactgccaaaattttggtaatgaaaaccaattaaaacgcgtacacataaaaagtattggctacaaaccaaatgaacaacttcacagaaatttgtacaacacacaaaatggttgcaaaccaaacaagccctttatcttctctaaattttaatgtcagtagaaccaaaagaagataacaaagcattttgtaagattgtggtaggctttagctgctacatggaacagacatattcttgagtgttttttcttttgctgttcatgatctgtctacttgtggatataggtcattgatgtagcaacttctcttgccaaagttgcggatgtcgatagaaatcttgggaacgaaagcatggcagttgagggttttgaggaagcaattaaatgccttgagaatttgaagctggaatctggagaggccagtcttgagcagcgggtagctactacttatccttgtgtactgcctttcatccatgcgctcctatttgtggtgctctcgacgactgacttttatcatgtactgtaatacttttgcagcgtctctcggttctcgactttctacaaaaacaattggatgacaagtgatatgcacggttctaatttgaagagcacactcacaggatatatgcactatccataatgaggatcagctccagtacgtagtctctgtgatgcatatggaagggagttgctccagatcgaatgaatggtaactggtgtgtatttgaggtttgctgcgacacagaataaatactttcgagttgtatatgtttcttgtgtctgccacgggtggagacctctttgagtccctgaggcaccacggagacgaaacttctcggaagtactgattccttgttgcctctgccgtgttatgtgaatgttatcccactgtatatttattgatgatataatataagaaaagaacagcacagatgttttgtatcgccctatcaaatttaagttgttttgcatattctagcggcaattgagataatctggatgaggaatctcaaaagtcaaaagaaatcaggtttctttgctcttgccttgtgagagacggatctttgacaagaaggcaagcaagtcttgcttggcaaagtccgcaactgatgcaaatttgacttgtgcagaatacagctagctagtttattagtctagaagattgggaagacacgtaaaatgagatgagccattagtatatgattaattgagtataaactattttaaattttaaaaatggattaatatgattttttaaagcaactttcctatagaaattttttacaaaaaacgcatcgtttagtagtttgggaagcgtgcgcgcgaaaaacgaggtgttttttttaagcaacttttctatagaaaatttttataaaaaacgcatcgtttagtggtttgggaagcgtgcgcgcggaaaacgaggtgttttctcaccctatctcacacaaacgaacacagcctaattgatgtttctgcaggaatttagccacataattttggaaatgttgcatggtctgcaggttttgcatagccgattagccgatggtggtgtagctcaattcatttgatttgattttattttattgaattttgtgatatgatagatcaaactgatgagccaattaagagaggcctgatttgctggcccaggtagatagagtaggaataattcgatttacgcgcggcgatggtgattgaaccgaaccgaacagtataaattactaagagattgcgtgtcattccatgcatcttaatttagtcacgtttggaggtcgattccggttgagtgaccgatcgaatcgaatcagtcacgttacatatatatgtactctgccggtatatatacgtatgtatatccggcgcggtgggtgcgcgtcggaagaaatacttgtgtttctgtcaaagatataatatactcctacttatgttcctgcgaatttgggctaccatgcatgcaacataacaattatttagcttgtagatcgaatatactcctacatgggtgctggccggaactgtact

SEQ ID NO: 290 - DNA, 6639 bp, Oryza sativa
ctacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcgacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctcgcgcaagctgcgcggccgcatcagcaagatctccctcgtcatccccgacccggtccccgacgccgaggccgcctcgccgcgcaaggacggcgtcgatggcgacggcgacgacgtgaggggtggtggtggtggctgtgacgatggcggtgacgtcgtcgccatcgcgacgacgacggcggacgagttcgcgcggcggtacgtgctggggaaggagctggggcgcggggagttcggggtgacgcggcggtgcagcgacgcggcgaccggggaggcgctggcgtgcaagacgatccggaagcacaggcgcctggcgccgccgcgggtgaccgcggcgaaggcggcggccgcgcacggggaggacgtgaagagggaggtggccatcatgcggcgcatgtcgtcggcgtcgtcgtcgcgcgggggcggcgccgcgtcgtccgccgccgtggtgcggctccgcgaggcatgcgaggacgccgccgacggctccgtccacctcgtcatggagctctgcgagggcggcgagctgttcgaccgcatcgtggcgcgcggacactactccgagcgcgccgccgccaacatcttccgcaccatcgtcgacgtcgtccaggtaataatcaagaacgaacactacacatcatcttcttcttctcccattgatgcatcaaatcaaacgagtaatcactaattaatcaccaacaatctgtgatcgatcggtcgatggatgcagctgtgccactcgaacggggtgatacaccgcgatctgaagccggagaacttcctgttcgcgaacaaatcggaggactcgccgctcaaggtcatcgacttcggcctctcggtgttcttcaagccaggcacgtcgatcttcagcaaaatttccacctctcatcgtccatgatttctgtcaaatcctccatggtttctgaaaccaatcaaatgttgatgcaggcgaccggttcacggaggtggtggggagcgcgtactacatggcgccggaggtattgcggcggagctacgggccggaggtggacgtgtggagcgccggcgtcatcctctacatcctcctctgcggcgtccctccattctggggaggtatatactcaccttaattacctttttttttaatatacaatgtcattgatttttaaagatatgtttgataatttttttgaaaaaaagattatgtgattaccgcttattttattgtgagtttattgttaattattctataagtatgacttaaacttttttttatagtttgcaaaagttttgaataatacgaatagtcaaatatttataaaaaaaataacgggatcatatcttaacttccttttttactatatatatgatactatttaactttttagtcatgttcaatcattttaccttataaaaatattaaatatttttcgtttgatttatcactaagaaactttaaacattatttatgttttaaagatttacatattttttttaataaaacgaattgtcaaatattaaaaaaaaagttaacggtatcatttattaaaaaaatacattaccaattcaccatgatgatgcaaatcatctcccctgtcaattcttgtcatgaaaaaaaactataactgtaatcttgtctgaacttgcaaatgtgcagacaacgacgagaagatcgcgcaggcgatcctccgcggcgccatcgacttcaacagggagccattgccgagggtctccgccaacgccaaggacctcgtcaggaggatgcttgatcctaacccatccacccgcctgacggccaaacaagttcttggtaagtaaacaacttaatcaaaccttctcaatgattcagatatacacatgattactggaaatcaaacatcattttgtttgtttcgtcgattggttttgaaacaaaaacagagcatccatggctgaagaacgcggacacggcgccgaacgtgtcgctgggcgacgccgtgcgggcgaggctgcagcagttctccgccatgaacaagttcaagaagaaggctctcggagtaagtcgtcgagttgtctcattgcttctgtgttgcgatgatcttgatgggtcgccggagctaacaacggcggtgtccggtgaaggtggtggcgcggaacctgccgggggaggaggtggacaagtacgtgcagatgttccaccacatggacaaggacaagaacgggcacctgtcgctcgacgaactcttggaaggcctccacatcaacggccagcccgtccccgagcccgagatcaggatgctactcgaagccgtaagctttctgctcatctcctcgatctcgatctcagaatcattttctttattaagataatggaagatttttatcgagctcattcaattacatggagaagatctcaaaaatcatttttcttgagtcttgatctcagaatcattttcttttaagataatggaagatttttatcgagctcattcaattacaccgaggagatctcaaaatcattatttttctgaagattttgttgagatcatccaattatatcgagaagatattactgtaaaccgttgaattgtgatggatgatcatactctcattttctcgatctcaaaatcgttttttaaaaaagataataaaatattttatcgagctcatccaattacatcgtgaagatataactgtaccgttgaattggggtggtcagaccctcgtattctcactctcaaaatcgcttttcaaagataatgcaagatttttatcgattgaacttattagctaatttattgattacttgtcgttttagacaagtaaacggtcttaaataaacaattatagccaccattttctattacaatatatatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgccccatatgagtgtcctatatatatatatatatatatatatatatatatatatatatatatatatatatatatatatatatatatatatatattagaaaaaatattttattgtagtatttttaagactaatttctacatatggtctctacatttctacgatttaagaaagtttgaccaaattattatccaaaacaataaatatcatcaactcggaggtattacatcgaggatatagtaagaagatgagatgatgaatttgcaggcggacacggacgggaacgggacgctggactgcgacgagttcgtgacggtgtcggtgcacctgaagaagatgagcaacgacgagtacctggcggcggcgttcaactacttcgacaaggacggcagcgggttcatcgagctggacgagctgcgggaggaggtgggcccaaacgagcaggccatcctggagatcctccgcgacgtcgacaccgacaaggacggccgcatcagctaccaggagttcgagctcatgatgaagtccggcgccgactggaggaacgcctccaggcacttctccagggccaacttcagcaccctcagcaggaggctctgcaaggatactcttactccctgatgatcgatgatgcccaacaatctcatcaactttgtttcatcaaggcttataaactgcacatctttcaccttcaccagacagggataactagagagagatacaagaccaacttagagaaatgtattggagtggcaacacgatgcgatgctgcgcttggattgtgaaatgagaaatggaactgaaatggggatcgtaccggttttgctactctttcggtaaatgggtatttttgtttgctataatatgcacacaacatcaaaaattccatccatcaaaatatgcagctcgaacgacgaatctataagaaatcaggtactgctgagtaaacaccagtttcccacatgatttatcaaccatagattatgacgagctttggtaatttacatgaccgctcaatagataagagctacatctaccattctccagcttcacaggttggtcagtacagggggtggaactttacccaccacatcatctcatgtcatttaaacaaaaacagaacattgcccaccacattaacacaactacagaccataactaatatgtacataatataggctagaaagtaaaaaaaaaaaagactaccacatgtttgtaccccatccaccttcgctccatagtcggtcctgcattgttgctgcaatctagatacaaccagggaccttcactcacacatgtacgccattgctgccattggaagctcttcttcaacgccacataatttaggaacagaactacaatcaacaatcttctcatgagctttgagtaagcacccaccttctcaacagcttcgagatttatggggggcactggctttcagccagtttttcatctagtatctatgcttatcgcagacgctgcatgcatccaccgatgaagggttaataaacgtgcagcgctcacaaggccagccttcatctgagttgtccgaagatgttctaggaagctgcttctttgttttgcctttagtgactgctttcttggaggggatgttggtggcattgcttgatgtggtaccctgggcagtagagtgtacatcctccaagccagcctccagtgcttgaacaaggttctcaaaataattccgagtcacactgcagtggagacgaagcaaagtcaacatatcgtaaacaaagctcatatgacaataaagaataggcaaggaagctgctatccatgagcatagacagcatctcaagaccttgtaaaatgctagcaagtaaaaacatttgcgacaacaactaccaaaatcaaagaagcaagtctagggtcaacaagtaaagagcatagctgaaatgtccacctctttgactgtttgactactttacatgatggattaatactaaatcattaccaagagaaaggtgggcacaaacaaagttcatgtcctttattagaattataaaatctcaggcttctaaaattctcaaatggcatttaaattatggcataattagttacattcatgtgaacctacccaaggattgttaagaacaatgtaagaacgttcaaggataatttggaaggagcgcaacgccaaaatctttcagcacaagcaacacaccg

SEQ ID NO: 291 - DNA, 8499 bp, Oryza sativa
gattattgaacggagtatttttaaaacttttcatatgtgatatttttttaaaaaaaatcaaataaatttatttttaaagtttgcgatggctaatattaaattaatacgatggttatttctcttgttttgcatgtggcttataaggttaaacgaacccctatatcaaatggggcctagtatagaattgtacattgaagagttcatcaagtgatctgtactatgtaataccttttacaatattattgctttcagtttttatatcattctaattgattctgatagtgcagcgcaaacatcaaaaataacactaaccatagaagctaaacttagctaagtagctaactaatacaataacaacccccttgatatagacacaagaccaaatcctaaaaaaaatattggtgccttagaaaccaaatactattactcaattatctcgatataattgaccacaccaagtaatttatattatatcaacataaatgacataacgtagtaatgtaaaacaccgtatgaaaacaacttcacgttgtaataatttattagtactagtatattgcatctatcctatataaaaaaaatcaaaaacaagacacacctcataccaaaaaaagttaaacctataaataataaaaagaaaaattgctacacgtactaattttttcttactaacactgatgatttttatcaagataattatcatctcaagataatacgtacggaattttataacttctgtttatctaaatcaaacggttaagataattattagtaaaaatatagtaagaaaaatttagcatgggtagcagtgctaaaaaagcacaagaggtataaaaataaagaaaaaaaaccaacagcaagagaagagaggagaggaggtgtgtgtgtgacagtgtgtgagtgtgttgacaatagacagtgttgaccgggggccccatgttgaccgccacctcacctcctccccttcccttccccttccctctcccctctccctcaccttcctctccaccttcctcttcctcccgaccaaacaacctccctcctcctcctccacctcgtcgtcgtctccgccgcgctgtctcctcctctatataccctcacccacactcgcacgcgcaaacccaacccccgcatatgcttaactccccaacccaaaccctcctcctcccccatgggcgcgtgcttctcatcccacactgcgaccgccgccgccgatggcgggagcgggaagcggcagcagcggaagggggatcacaaggggaagctccccgatggcggcggcggcgagaaggagaaggaggcggcgcgggtggagttcgggtacgagagggacttcgaggggaggtaccaggtcgggaggctgctcggccacggccagttcggctacaccttcgccgccaccgaccgggcctccggtgaccgcgtcgccgtcaagcgcatcgacaaggccaaggtactactaatactattactactggactttgacgcttggtctgtgtgattcgctgcggtttcgcgggaattcgggagttccatttcggattgagctagtgcgaattggttttgtttagattgttttctcgaattttgggcgtttagctcaagtaaaattctgattcatcaacgatatttttggttgttttgggtagtttagctgtcggtgaggccctacactacactcctcctaatcatatcatttatcgtttagttggggatttcacctcgttcaattaccccctgaaatggcaaaaggtggctctctttgaaacggttacgatgttttcaattttggctatttgcgcactactcgccaaatctggtgcattgtcatactaatttcagctgattgttgcttcttccttggcgcttgcttttttttagtaaacctgccaacttcgatccattttatgtacttaacatgtaaatagttcacatagagcactagtatttgtggctcttgttggtgtctccagattcatctgatttttttttcatggagatatttctcatcttgacagatacctcctctaggtgttcatagtgtaactagattttctcttgataagaccagtcaggaaagccaactggtaatggaaaacgtgtcattgtattcttctacggtatatttgtattggtggatggcattttcttcattccacacaacttgaccttgtaatacatataccaatcaacacggcgttgattttgtcaaaaatactttggacctttggttgaaatttaagcatttccttattaatgcttttattaaaatgtaaatttatggaagaaaaggccacttactaatcccagataatttttgtagtaaattagtatcatagttaaaactagaatcagatctaaatgctcaattttgcctgtggcaggttaagtgactgtgttaacctgtgtgatttttttttgggtgggaatatgcaaaaaggtttgtgcatctttgcattaagaaagagagtttgatacaatccgccatgctaggtagcaggccacaacattaaacagattccttgccacatcagctacgacctaggagagacagcagcatgctgctcaaactcagcctcggcatcctgacccctgcagttacccacagctgcacttccttgacgatagcttggatgagctgcgcccaatccctatgtgtatgattgaaaactcggttgttgcactctttccatatcacccaagccaccaggatgacaattgaatcgaagcctcctttttgggttttgttgagtcctcgatacgtgttaaaccaccatgaagcaaagtctgtttgccggactggtaggtgttgcggtatctgcaaagcagtcaggatcacccaccagacctgacaggacttggggcattgcaccagaatgtggtcaatggtctccacttcttgatcgcagaagaggcaattccacctgtgagaaaatcaaacatctttgttaaggagtgtaactggagcaccggctattatgtttcaaactataccaatgataatagaacaggctagttggactgtgtttaaattctagtttcacataataacctttgtagacaatttggtataactaattcactcgttttcttgattgtgcacagccttgggcacaggcagctctaggctgtatgatgtgcagcttgagttgatctactacttctgttgcacacatgatcacaattttataacatttgtgtccttaccaccggcttgcttcttgatgtttgtgggatgtggataaaataatcataatgcatgaatgagcttgcataattaagtgaagataatctgttatatttaaattagagtagcacatgcaatcacctgtctgtacagtagatattgcgatgttcatccatggttggagccttggatgcatgctctgtatagatgcttttatgtttgtctactctacattatctttaggatatgtgattgaaggcgatttgaattttgatattttatggcagatggttcgccctgttgctgtggaggatgtaaagagagaagtgaagattcttaaagaacttaaaggccatgagaatattgttcacttctacaatgcgtttgaagatgactcatatgtatatattgtgatggagtaagtagttatatactagcttctcttacatttcgtgcacaatgttatttgctatatacactccttgcacttacattttatttctacctaaatcctaatacgtctttactgccagttgcattctctatcatttgtttacagtatatgaatatatacacagttcttccaaaatcacatctcgaattcatgtcttcatggcaataaccatttatatggtcagaactcttagtatgctttaccatttccccttgctatgccccaatagtttccaagattatctaaagagagtatgcacgaccacatatgatttccatcagtcatacggtaccaacccttgcttcctttctatttttgcagactatgtgagggtggtgaactattggaccggattttggcaaagtaagattagatatatcctccatttcttcttctgtagttgatacattttcttctatctttttgtgtcatcattctttagtttccattcccgtacagcttctagggccataaggccattacttactggcaccttccattttgtcagaaagaacagccgttatagtgagaaagatgctgcagtggtggtgcggcagatgctcaaagtggcagctgagtgccatctgcatgggctagttcaccgagatatgaagcccgaggtagaaattgaacgctttcaatgtcttggcaattagtgtacattttggtgatatttcattacttctcaggtcatgtaagaatgtacctattttccttcccagaacttccttttcaaatcaaccaaggaggactcacctttaaaggcaacagattttggtctgtcagacttcataaaaccaggtatttatttcaagagcttttgcttatgtgcatctttgctatgtgcttccaattgttgcttctgatttgagtaggacatacaagtctgcagttcattcattgttttctttcattactgtagggaaaaagtttcacgatatagttggcagtgcctattatgtagcaccagaagttttaaaacgacggtctggccctgagtcagatgtttggagcataggagtcataacttatattttgctctgtgggagacgccctttttggaataagacagaggatggcatattcagagaggtaagtgatgaactgttcccaagcttttgcttcaagcaaaatgtgtttggtgagagtgccaaccttttactctgttgtcggtgtgcttatgtgatggaggaccagtgttatctacatttcttcaagttatgcggcattgttaccctgttaacgatgtgtcagtttttataagcatagcttgtattatttttcacacggtagggcacttggctacttggtcaggctgtccttgagtgatgtctgaactagctgtctaaaatacagcctcatcatattttgtgaatgctactccctccgtcccaaaatataagcatttttagctatgaatctggacaactgtgtgtccagattcatagccaaaagttgttatattttaggacggaggtagtaatgttatgactattagagtgagtagcaaaattgaacttcacttctagtttcaattagtatgaatgggcaacctgtggttccaacagccttagcaaccaatgttccagtgcttagttctagacagctggcaccatttgagtatagaatcctcttaggaccattattcccatcagactatgctagatttttttttttgaattacgtgtatttacagaaggagaacattttcagtcttatccgtcatcttgccgtatgtcttctgccagcatatgccacgtcagagaacatttccactttatttgttgaattagaaaataacgatacagagaaaataggcattcaactcaacctgtgaatgcagttacgtacttaggtagtatggtttccctcttcaatgaaccagcattttgttgtaatgctgattatctttgtgcatttaaatcaacatagacatcttgtggtgtacataatcttctgcatccccttgccttctaataatcaggtactaagaaacaagcctgattttcgtaagaagccttggccaggcatcagttcaggtgctaaagatttcgttaaaaagttacttgtaaagaacccaagggcaagattaaccgctgctcaagctctctgtaagttcctacatctaatctaagatagtcttaatacaatagtagtgaatcttcgtcagctgtcaatccttactgtcctgtttatgctttgatatgtttagcgcatccatgggtaagagaaggaggagaagcatctgagatccctgttgatatatctgtattgtccaacatgcgtcagtttgtcaagtacagccgttttaagcaatttgctctgagggtaaattttgtgtgcaactaatcttacatatcttttctcactatatgttcctaatgatgttggtttctttcatgctcaggctttagcaagtacactaaaagaggaagaactagcagatctgaaggaccagttcgatgcaattgatgttgataaaagtggatcaattagtattgaggaaatgcggcatgtaagttcttactggatattcttaatgaaaatgcactttggcacataattgaagtctctgattgtcttttttatgtttcaataggcccttgcaaaggatcttccttggagattgaagggcccccgtgttctcgagattatccaagcagtaagtgtcaggccttctttattattttcccccttattttcggagcaactagcttaccatctatcagagtcgtacttcaactgtgatattattctgtggcagatcgacagcaacactgatggtcttgtggactttgaagagtttgtagcagcaaccctccatatacatcaaatggctgagcttgactctgaaaggtggggcctacgctgccaggctgctttcagcaaatttgatctggatggtgacggatacatcactccagatgaactcagaatggtaagtttcaattcctgttctgtgttcatgttggtttatgtagctacctcatatttagtgaatgaagtgattttgtccacagaagatattatttcttacaccaagaaagaaaatcccagattttcacatatgttagtcgatgctccacatagtaggggcctgtctcatacgtataggaggcctgtttgataaattgaaaagcatttttctttgtgcaacatcgaagaccagtttgttgcagtgtgctatttcagcaattagatgcgagattaattttgactaattaatcctgtataaatgtttggactgtgacagaaacaaaactagtagtatttctcattgaggtttactttcaaggtgcagcacactggcttgaagggttccatcgagccattgctggaggaggccgacatcgacaaagacgggagaataagcttgtcggagttccgcaagctcctgcggacagcgagcatgagcaaccttcccagtccaagaggacctccaaatccacaacccctgtgaacgtcggtaagaaccgagatgagacgtcgtaaattagtcttgtaaaggttgtcttgttcctgtccgcgtgccatgtgatgttgagggtgtcttgagtttttagcatccaggttccgtgtgcagcatgcagataaagtttcggtgtagtacggagtacatacatatttttttcaaaaaaaaatgttacaagcagaaatgctgttctagtctcccattctcctccttgtacataattctatatatgtatgatttgattgcacgtattcatcgcaataaagttgcctgggattgcatgatcatgtgaacttgtgtactagatgtagatggtgatattgcaaggccatctagctagctagcagctgtaatactagttcagagctaagcaactttcaaatctatttgagtatttgtctatgcagtgttgatttgtttgaggttttgagaaactcggtttcccatttgctggaaatgctttttttttttttgctcactaatattcagttcaacctctgttgagtgcactgcaaaatttagccaaaaaagacttccaatttcttcagagaaactgacttcaagtgtgccttagcgtaagttctaaactgcaaacttagccgcacgcaaaacgggataactcactattccataattaattatgcaattattataaattttaaaaatatatcttttattttttaaagaaaactttatatagatttttttcacaaaatataccatttgataattaagaaattgtgctaatgaaaaacgacaaacttctaatttggagctagtataatttaggagccctatcagtatcacagtcaacatttacaaacagaaccctgactagatcaatatttacaatcagcgccctcaatattcactcgtcactccactgcaatatacaatggcgcatgcttgaatgccgccgccgccgccgcgacctcgtttggcgccaaatccggccgccatcatccacgccgcgctgctcaaatcctccccggccagcctcccgccgcgcctctccttcaactccctcctcgccgccgccgctgcctccccgcacccgcgcctccgctccctcgtcctccccgcgctcgcgctcgcgcaccgctgccccgccgccgctgggccgctcgactcctacgccctgtgctccgcgctccgccacgcctccgcgccggaggcggagccactccacgcccacgccgccaggtccggctggctcggcagcgtcttcgtgtcctgcgcgatcgccgcggcctacggtgggtccggcaggttcttggacgcacgcaggctgttcgacgaaagtcctgtcaggaatgccgtctttgggaacgctgttcttgctgggtacgtgaacgcggggaagtgggcaccgttgctggagtttgc

SEQ ID NO: 292 - DNA, 7753 bp, Oryza sativa
aacaacacacagaaaagctaaattaagcatgcacaaaccgcaggctaatagatcagctgactagctgcatactccatccgtcctaaaataaaccaatctcatatcggatatgacgggcctcatcgtttggcatattcatatgcttataagccaaaatttaaattttcaacgttaaatttggagctgattttggggttttttcattgaagtttatttttcagcctttgcttttagatcgctaagaacacatatataaaaattttattcacaaattaatttttgtttgcaaatattcaaaaaatatgccaaacgttgaggctggatatgttgtagtacaataaatgtttatatctggtacgatcgtacaagatcgatttattttgagacgtagcgagtatatacgatacgaggccaaattctgcatttgagccaaaggcacctagctatacacgcctacaccgggagaccaactcaatggaccgacgcaatgcaagaggcagcagcaactcgacacttcgacagcaacagaaaggtatgggagaaaaagaagttgaataaaaaagaacagttcgagctagaaatggttgtagctagttggagatcgagacagcaaaggtatcaggtaattttatagtaatcctgcctcttggtagagctgtccctcgtactaggaagctacgcatcctttcatccgcatcaaaacttcagattcgtacagggaaattaaagtgttttctcaaggataccatctcgtttatataaacatgttagctaaatagttacatttttaaaaggaaacttaataagatatattaatatgagataaacacctacaagcctttaaaagaaaaagaatatagctgtaaatttacgttaactagtttcggtttaatttgttctttcgctgcaacttgttcatatactactagtatgcatcatcatgcagtaggagtatgcatgatatatatggtccctttctttcttcatttctcatctctactactcactgatcccatctctcgacacgacgtagccctgaagcaaagctccctccctcactggtcgtcactgcctccctctttctaccccctgctttgatcgatcgaccatgcatggcaaagcatcatgcgtgcacactgatgcttcttaccgatcaaattaagttttttttttactcagatcagctcatatcattcatcaaaaaactatatttgattgattcctgtctcatttttttcttctctctttctctgtcgatttgatctcattgcaattgcgtagtagaccacttcaagacatcgacctcttcttatccctcctctcttcctcccgcccgtctctctccaccatttgattcacactatatatatatatatattttgcggcttaatttcccttgtttctttatgcttcttgttcatccaagctaagctgagctgagctgagatgggcgagagatgtagaagtagatagaattaagctagctagagaggtagatatatagctgtggtgaggaagtttccagaaggttctagaagatcgccatgggcaacacgtgctgcgtcgctccggctaccaccgatgaggtgggcgcgccgccgcgagatcatcatcacgcggccaagaagtcgccggcgccgtcggcgacgacgacgacggcgacgaggcagaggcatggccaagaacccaagcccaagcccaagcccagggcgagggcgaagcccaacccgtacgactgggcgccgccgcgggtgctgccggcgaggggcggcgccgccgcgtccgcggtgcgcgtgctggagggcgtggtgccgcaccacccgcggctgcgcgtcacggacaagtaccagctcggccgcgagctggggcgcggcgagttcggggtgacgcacctcgccacggaccgcgcgacgcgggagcggctggcgtgcaagtccatcccgaagcgccgcctccgcaccgccgtggacgtcgccgacgtgcggcgcgaggtggccatcatggcgtcgctcccggaccacccggcgctggtgcgcctccgcgccgcctacgaggacgccgacgcggtgcacctggtgatggagctctgcgacggcggcgagctgttcgaccggatcgtggcgaggggccggtacacggagcgcgccgcggccgccgcggcgcggacggtggcggaggtggtgcgcgcgtgccacgcccacggcgtgatgcaccgcgacctcaagccggagaacttcctctacgccggcaaggccgaggacgcgcagctcaaggccatcgatttcggcctctccgtcttcttccgacctggtcagcttcttcccttcttcttcctctgcaatgcatgcacgcttgaacaaaacttttttttttttgcctctcttccccatttaatttttttagaacatattctcaaaattttttagtggtagtagatattctcaaaaatcccattcaaagaatttttttagagattttcagtacctcaaaaaatcccattgcaagaaattttggagattttcactatatgaaaaattgatctgcaaataaatttggagcttttcacaataatttttcacaatctcaaagattgaaatgtaaataaattgggagctttttcaaaatatcaaagatgaaattgcaaaaaaaagaggatattttttccttcacaatgtcaaaagatctaattgcatgaaaacagagattttccagaaatgctcaaactagttttgcagttgtttttttgggttgcacgtggattctttgagaattataatactataagcacagttgggaatagttaattagtcccctgctacaacttttcaaaagatcccttctgttataaaaggtgaaattttatcccatttcttaaacacgttatcttttcacgggtgccaaatcataaagcacaaaacacccccaaatgatcaatgggtaggtgggagtacatataaaacctcagtagagccttttatgtttttatatatgaaaaacatatctttaagagaaattttatggtacttaaaagaggtgctctctccaatcatttgtacttgacgttggaagaaccaatcgtaattctgttaacgtcaaatataaatgaaccgcgagggagggagaatcaaattttgcagagagagataccgaaaatacgatgcctcataaaaaaccgcaaaatcactcgtattaaaaaagaatcataaacatcaataagaacacattatttctaacaaaatgtgaacccatagttggtcggctaaccaacccaaatttgaccccctcccttagtaaatttggtgtgcagtgaaaatagaacaggtcggcgtttcggtgccctcttgcgcctgaatttcactttcaccggtggaagaaattaagaacagtctgcatttgaaatggcagctgatcgtgacggtgagccgaaaaaccgagccaattctgcccgaaattttcagagaaaaagtctgtggatgctgggtcatcagatgatgctactcctctctgcagacacgcatcacgccgtcccctgtgtttagcttactcggtcagtgagttcgtcaacctaccacaaagctgaatttcttttttaattaacgatagtagaaaagaatataaaagtataacctgaatatttttattttgaaaaaaaatggattggaaaaccatgtgtttatatctagaccgaatatacgcagccacgaaaaacagtgattaaaaaagagaacaaaatcaccaccacacgccgagttttttttttccatagttgcgtccagactgttaagaggtcgtggtcggcagcagattgctgtcaagatcttaattaagataagcaagatcggtgtcaaggatcttacgataatagacgactcgctcttgttgagtcctcaggggagaaaaaaactgtcactcttgttcttaattattgttcctctttgatgttgcatggccgaatagattgagctggacagatcatttcagaatacagtcaactcgtaccgttattgcttggaatgtaagaatggtggtaaaacatatgaatagcaaataagcagagttttaatataaatacatttgcataacaaaggatccgtataataaaagaagtacaagaattggatcagagagacgggggttgttttaaccttactccaaaatattaatgcattgagcagtccaaaggaatttcatgagatttttagatctccaatcctttcctcaaataaatggaaagatttgaattctacaaaactccttgacaagtcctttgttataaacagaggctctccattttgcacattcatgttcaagcaaaaaaaaaagacattttgcacattgacatgatctttcaaacataatattgaccatcactttgcatcataatatatacagtgataaaattccagtgtattttgcttatccatcttgaacgtttaaaatggatttttatttataccttaagtctaaatgcatatctaaagcatcaaaatatggggttaagtatacatttgtggataaatttgtactaaccacagtacaatatttgtgacgagatagagcctagtgagagtgtgactctgagatgggccggcctacatgcaatctgtgcagataggcccagtagatttcatacggcccatgtttcaaatccagccttttcttcaacctcaccaaaaaactagttatacatttgttgtcaaagatgtaattatagcacaattgtgttgtaactatattataatttagtatcatgtaacttgtaagtaactttcaaaaatcaataggcgacatgttatttccatgaaatggaggtaatggaaccgaattcccttacatgcgtgtgcaatgtgattttttcttatctaccttgcatgaattttaaagcaaaatcgaacggtttaaaagtatgtgaaagttacgtacaaattacattatagttacatgtgtgattacacatatttacatttgttaaatttttatgagaaaatttgccgataaatatacagaaaaaaaagagaaaaaaaactgacttggcaagtgaaaggaaacaggggagaggttcagggagatcgtggggagcccgtactacatggcgccggaggtgctccggcgagactacggcccggaggtggacatctggtccgccggcgtcatcctctacatcctcctgtgcggcgtcccgccgttctgggccgagacggagcagggcgtggcgcgcgccatcctccgcggcgccgccgacttcgaccgggagccatggccgcgcatctcccgcgccgccaagtccctcgtccgccagatgctcgacgtggacccgcgccgccgccccacggcgcagcaggtgctcgaccacccctggctccaccacgccgcccgcgcccccaacgtccccctcggcgacgtcgtccgcgcccgcctcaagcagttctccctcatgaaccgcctcaagaagaaggccatgcgggtacgtggcgtgcgtgctctgctcttgatgtcgtctccggcgacggcgagcccgtttctgtgtctgaccgcccagcgatgcacgcaggtgatcgcggaacacctgtcggtagaggaggtggaggtgatcaaggacatgttcgcgctcatggacaccgacaacaacggcagggtcacgctccaggagctcaaggacggcctcaccaaggtcggctccaagctcgccgagcccgagatggagcttctcatggaggccgtaagcttctttacccttcttcaagatagcaatggcggcaatggcgagttcttgattttgcattggcaggcggatgtggatggcaatgggtacctggactacggcgagttcgtggcggtgaccatccacctgcagcgcctctccaacgacaaccacctccgcacggccttcctcttcttcgacaaggacggcagcggctacatcgaccgcgccgagctcgccgacgccctcgccgacgactccggccacgccgacgacgccgtgctcgaccacatccttagagaagtcgacaccgacaaggtaaacacacacgcttcccttccactactccatttgcaacaaaaatgttcttcaattcagctctatctcttttgaagcctagccagatagtttgaactccactcagaattagagtgaaattagttgaagcgctcttacaaaatgaactggagaaatgtaactgggtttagcctcctccacaactccacttcaaactcggctctcggagttaaatttaggcgttagagctctcccaaataaactctgaaactgatcaatctctgaatttgcatgcaggatgggcggatcagctacgaggagttcgtggcgatgatgaaatccgggacggattggaggaaggcgtcgcggcaatactcgagggagcggttcaagacgctcagcaacagcctcatcaaggacggctcgatcaccatggcgcgctagctagctcgacgaattcagtcgattcaggcttgagaattcattgagaatatgaggtcgatgcaatgctcgaattttttttttttgatgcatacttcattcgaatttgaatttgggttttccatttcgtccaatttttcttttgtacaatctactgtagatcgatcggtcgtctatctgaaccttctttgtgtaggatgtgttagtgaacgctgggattgtttcagcattcgttgtacgtgtttgaaattgcgtcgggtgtaattatgtggtaacggtggtaatcaagcaaatttacagcaaattcattgtgatgatctgtactaatatgcatatgaaacatcaggttattcacacaaaatctcttgtcagcttttctcgtcggcggtagggaggacacgctcttttttcatggcgccgccgaaataatctcctcgttggacagtttcactataatatcacgctgcacatagctttttttttttaacgaccacacacaagacagtgcgaagtttcatattcatcgtaggcggatatagagggtggtccggggaaaaacggcgatggacccgtatatattaagaaaaatgaaaatagcgatttttgaaaaggaaaaaaagcgatctaatcctcttcctcccgtcgttcccgagtcccgactcgcggcgcccacaggcccacacgcgatcacgcgacgcgagtcctcctcgcccttcgccgcgatctcatctgatcactccacgtcagacgtgacgcgacgcgatcagcagccagacaaccaatcacagggcagggccacggcgccagcggccagcccacgccggcacgcgcgacccagcggccagcgcccgcgcccggcgcccccacggccacgccgccacgcgcgagtcccgcactctgccgccttggccgctgctgtgctgcgtctggctggcactacattggtgctgacctgctgtgcgtgtgccgccgcgaggagccgtcgtcgagctgatcagccgcccgcgccaacaaggcaacaattttaggttttctatgtgtatacgtttttcaatttttagttttaaaatcttattaaactcttatgcattgtgatatatcatggtaatttttttacaatttggtctattctattatctatacttgcattgtatatattagtatcgttagatttactgtgtttagaaaaaaaaattaggtcggaccacccatatcctaaatgctagatccaccactaatattcttgcattgcacgtagctttgtttttgctcggcgtcctggttcaccatggcggcgagcttccatgccgctct

SEQ ID NO: 293 - DNA, 2775 bp, Oryza sativa
gggtgaaaggtttgaagtgaatgagagggaaaagatgcagaggtattttcacgtgcggtccacttaagacacccgcacgcgaaaatcaatttttgcgtgcgggcctcttaagggtccgcatgtgaaaataggcttatttttacatgcggaccgtttaggggcccgcctacgaaagtcgatttttgcgtgcgggtctcttaagggtccgcacacgaaaatgggagaccgattttcacagacgcacgcgaaaacggtctgtctggaaaaataggagctcctcgactaggaaagtcttttgtgtactagtgttccaatccctatggttgcggagctgatttgcaggtggacgctcatgccggagttgagggctatgatcttcatcacttaatcacgttgccatggatggtgtcatacaaccggctcacgctgaggttctcctggagagatttgctccagtccaacaaaaagtacctcgagataccgatacctcacggtaccaaatcattttcgattgttggatctaacaaagctcatcctgtccagctagatctaacgattgaaaatgttttggtactgtgaggtaccagtacctccatgtatttttttttttgaccagagcaaacctctctcctagaacaccacagcgaggaagaggaagtggggtggggcctcccagcgagagagctattaaagggcgttcgcggcatgggcgatctatcgtgactgcttgtcgtgccccttgtaaatcaatacatggattcaactgtttgtaccttaaggatgatagaaatgctcctcccataaagctccgtaccaatggatatgaacaaatcaactaccaatgttctttcacctactaattttgtttttcttccttgagaacgacatgttctttcgtacgtcattgtttgtatgcacacacatcgcttgctttcatctaagcttggtgctaacgaaagttatttgtaggtgcaccttccaatggggatctctcaacacactccgatagtagcaaccactcgtacaaacaaagcaactaaaccacctgacccctgaccaaaagagatcgacacccacagcgatcgatcgatcgatattattacatatccctcaactactcactggccgtagccctttgttgcagctcggtgcatgtgtttgcacaatgagctacctcctctcctacatctccaagatgctgtgcatcaagattccgtcggaggcgaggcaagccagcgaggacggcggcagcggtggcctgacggagtgctccgtctgtctctccaggatccgtgtcggcgaggcgacgaggcgtctgccctgccggcatgcgttccaccgggactgcgtcgaccggtggctcctctcatgcaggcggacgtgcccgctttgccgggtttacgtcgtcgtcgacggtaacaagccaggggtggcagcgaagcacaccggcgagccgccgctcgctgaagacatggtgatctggttctctgccatgctcgtccctggattctgacatgtatatctctgatgtctaagcgcaatgctttttatttgtttgtttcctgcctggaaaccggtttgttttttttttcttatattatgcaaattaacatgacgatttcacgcttgtagcgtttgtatgtacgcttacgctcacatcgtcagcattttttttcttttgcaagttttctattgggcgttgattacctattcaagagaactgaaaaaaaaataagtaggtatatataataaaaacggtttctttagatttcctttaacagtttttttcttttaatctgtcgaattttattttataccgtgcgatatacacacagatgatactagtctggtttatcagttcagcatttctttctggtttgcttggttgaaccatcatcactgttgagttgtctgtccatgtggagataaaacaaggggaaagtgagacaagggaaggaagctcgaagatgctagagaaggtcgtacaaatctgaacaggaggtgtttcttgccacgtcgtgagtcctcacccaacacgctgccatccactcaccgtcactaccagactttagcagctacctgtaggcatgaaacccacagaggaaaataggttttaccgtcagaaatttttaacctgtgaatggactgatatgaatcgccgacagaaaaatgaccacagagaaattccattttcctgtaggtttcatattataaatcgtttgatttttttattattataagacatttgactttttttatcaaactcctttaaatttgatcaagtttatagaaaaatatactaacatttttaatactaaacaaacatattatcaaaatatattcaatacaaaatttaatgaaactaatttggtaatgtaaatgttgttatttttttctaaaaatttgatcaaacctaaagaactttgactaagaaataagtccaataactaataatataaaacaaatagagtagttgtcaacgttctttgcatctatatttgttctttagttcaggtgttgttccctctgttcccaaccacaaccgctagtctagtgagatgttagagcatctccaacagcatctctaaattcgattctccaaatacccatacagctaactctccatctgatttgggtaatcaatctaggtgttgactccaacaggctctctatttacatctccaaaatgacaaaaggacccacatgtcagcctctattgctttcttcttcctcttctttctcttcctctttctcttctcccttctcatcgaccca

SEQ ID NO: 294 - DNA, 4586 bp, Oryza sativa
atgtgaaattgctgctccactgtagcacaagtccaatactaccagtatgttggtgcacagaatttgtgaattttatgaagctatgagcttttctttcttgtagccgttcatgtggcgctgatgtctgactggtcaggttcaatacgagtatctactgcataatacttcatactattgattattgaagtactccctctaagtcattttagcatttttcatattcatattgatgttaatgaatctagacatataaatctatctagattcattaacatcaatatgaatgtggaaaatgctagaatgacttacattgtgaaacagaggaagtactacatactgaataaggagagatcttaattaggcctagtgttttagaagtgtttaagatgctgaactgctgacagctacatcaaagagcttgtgtgtgtgtgtgtgtgggggggggggggggggcagattaggaaggccatggaagcatcaccgcagtatatcaagcacctctccatcttcaaatatggcccaaggaagaacaacaagaaccaagaaaatgcagagccggaagccaccaaagagtagtagttggaatctgcactagtcactgtatgcatcctattgctgtgtatgttgtacagtgggcactaaatctgaatgtcgtcactgtctgcatccctattgctttgttaagtactgtagtaggagactcgatctgtattagcactatctagaaatcttcgcttttgtttcttcattaacctgctatgcatgatccaagtggtatctatgtactatatctatcatgaatgaataaacaggtagccttttcactttacattctttgaaccaaaagacaaggagagcaacaagttgagttcacttgttttgtttcactttcacaaggaaaagaaaagaaaacaaaacttctcctcttcggtttcactttcacaagaaaataaggagcaattcttatatttggtgaggggctttctgtaatttatagtgtataagaattatgtagagaagccctcgtatttgtggcctcccctcctcctccgaagagagagaagggaatctctcctcttctcttctcttctcgcgccgccgccgtgtccagtgcccaagatgtggggcagcgccgacggcggcacgccggaggtcaccctggagacatccatgggcgccttcaccatcgaggtaccattggctcggctcggctcggccgtctctctcttgagctattcttttcgtcggcatacaccgagttaagttcttgctccttgatttgatttggtcgcttctctcgtcgatcgacagatgtactacaagcacgcgcccaagacctgcaggaacttcctcgagctctcgcgccgcggctactacgacaacgtcatcttccatcgcatcatcaaggtttctgcccactccttgcttgctgctttgcttaataggagtattaatcaatccggtcaggttttctttactgcttttatcttcttgcggtttaggatttcatcgtgcaaggtggggatcctactggcaccggaagaggcggcgaatccatctacgggtcagcatatttcttgctttcctcctctttcaatttgtaagattgcattgcaactgtaacactcgattttgaactgtattttgagctcacatcatcaacccatgatggatagcactgtatttctacctgttaaaaacataatagggaattagtacctattgtgtagcagcatttggtagcgattgtaccattgttgctgggctcctgtagcatcttgtttgtaaaagtagctaaatttattattccttgttattttccacgccacgccgttattgcattctatttggggctctgtttgaatccttacaaatgtttgtgttcttgctgtgtttttacagagcaaagttcgaggatgagattaggccagaactgaagcacaccggcgctggaattctgtcgatggccaacgctggtccaaatacaaatggaagccagttctttattactcttgcgccttgtcagtcacttgatggtgagtctaccgtactgtctcattgttgctccagttttacattatgctttcgcttgtttgctgtctatgaatgttctttgcattgccctggaaagctgaagttcactctgtaggagttaatcaacaatttctcagattgcaacctaaaaactttactatcaaatcactgcaagtttttttttaatattagatttggaataattacaagaaaaacttgggactagcttttgaagagcctgttgtagagtgactttgagtctagtgcaatcactaggagcgtgattcttggagacttctggtggatttctgggactcctgttcttctgtattgtgatgttggtacattggactgcattgttgttaatgtgtaatgcaattgtgaaggacttctgctagcaccatcactgttttttcttcctaattgccaaccctggaagattttgcccctcaggatgtcactgcttacatctgtttttgacattgtatttcgcactctggattgcttttacaaatatgttcttttcgaaatttccacattgaaagtcaggtacattttcatgctattaaggttatatggttttcctattccaggaaagcatacaatttttgggagagtatcaaaaggaatggaaattgtcaagcgccttggaagtgtccagacagacaaaagtgataggtaacaccaaaactatatgccatggttgtacatatcacataatagatatagcatccgatttgtcctgagggagagttgagtgagtgcaacgcctcgctattaccatgcatatgcaatggcaaagtaggtagcagggtagcagcaggagggaaatatttgggatgatgagttgcagcgttagtagatttggctaggatctactcccttcgttccacattataagatgttttggcctctccattcgttggctagattcactaacatccataagcagtttagcacatacatggatccatgcattaatctatccaaaactcaaatcgtcttataattttaacttataatgtgaaacggagaaagtattcatcatggtagagaacaatgagagctgcgggtgagtgagggcgaatggtgggagggagataaccaaatcatgtgtacaatccatgtatggtgcctgtaaaactgaaagggaaaatgatcgatatgcatttttcctgtcgaatttattcagacttgttatctttgttgattcaggcccatccatgaagtgaaaatcctgcggactgtggtcaaagattgaggcacagcgggtctactcggtgtcactcatgacttctggtatttggagttgtagctgctgtcagtttcaggaattgtttcctgcttgttccgtgcttatgcagtggtgtatcgtttcggatgggctagtttagttattaacaactcatgaatcgtgatccgtcttaattattctcacctgaacgagtagtgttcagtgattatcagtggaaataactttcgaaatatatgaagtcattttgagcgcatgatgtaattcagctgatattcagcatgttacatgctgtaccaactcagggattttttttttatgttcaaaacataaactcatgcgcttcaacagtccctgaaaaattgacgactcaagcaatcataggatcggtgtagagctccgccagtcatgcttcttagcattaggtcgttgatgcacatctaattccagatcacaaagaacagggaaaaacaacaaaacaagcacaaataaagggaaaaacaacaaaacaaaacggctgctcttgacatagtaccaccattcatggatttctataaaacctgcaaaattgcaatgctagagaaacagcattttagacgaatctgcgtatggtttacacgcaactaatctacatatttagaaaaaaagatgtttataaactggtgttccatgatttgagaatttgacttgatgcgtgtagataataacatgatttttgacaaaggggataaaagagcaccatttttctatcaagcatactatggcgactgtagaaagaaataacaggctcacagaactagaagatgtacatcatgacacagcctgttgaaatgccgccgtcaattgattctagtagtttttcagttctgttttttctgcatttacaacaagggcttcctcctctttctctgtttcttctaacatatggcaactgaagccatcatgttcataaacctacacagggggtatacctctacaaatcaaactctataagcatatcccccatcaatcttacatttgctacaaaggtcaaagtgtaaccagagaaatcaccgtcggatggcacagaagtgctcttctttcttatccattgtgggtgtcagacaaatgagacacccagtgtaggcctgcaaagcgtcgaattctgtaagaacaaatgtccaccacagcaatggtgcatctcaagctacagtgggtcagtgtttcccacatcaatggagtatgctcgactccccttggtcaccggcttatgtgcccatttgcttcaactttcccagaagagacaggtgaactcacacca

SEQ ID NO: 295 - DNA, 4598 bp, Oryza sativa
ttgggggcagtaaaaattagaaaggccctttatttgcaattgcattgggggcttgtcagagttacatccctagtaccttctgattaagtttgtacttactgcactaagattcaagagtaaatcatatgttatgagtaggagctactggccttgtcttgatatgttttctcatagtgtgatatactcccctctgttcatcaatatcggtgtcaaatattagtgatcagaggtagtatcatagccaagcacatgtaagatgatgacagtaggtgtgtcaccatgagaagacatcgctaaccaatttagatcactgacttgttgcgctacacattttcctttttcctgaaggagttgcactatacaattttttaaatgtacaatatattagcttactgaactacattaattccaatgcagaaatatggtggaaagaaaggcccgggagccagtacgtctaaagactgagacctggattgcagatccctgtgttgctcttgaggcaacatgctggcatggtggttttttggtaccagctactgacagtggatgtacacctccattcgctagtcgagaggagcttaaagagactttgcatcggttgatgaccatttgtgttgtatatcagattcttctgtgcaatgactcgttcatttatagttcttgtgctgtgcggctcttgtgtggacgagtaatgaacctattgagtcaggtgcaatgcaaatcaaaactattggggcttgacatggatttgtactggaattcaacatgctcgtttccagacggggcccttaattactcgcatgttagtaacacatttgttattctatttagagtcctatgaaggttgtctgttttgtgtatgcgcatgagccattcggtaattgttactcccttcatcctacattgagcatccaataatgtctgctataatgtttgtgcaccaagaacaagaataatttaaatcacatcgatcaagacgtcatgtataatatgcacacattctctcctaatgcatgagttggttaaaacacaatgcacaattccactctgcctttagcatgcacacattcttacatgatgtattaattgtgctctaataaaatccttatacatgtgatcaatttgaaaaattaattttagtttttattatatgataatcaatttaaaaagaagggagtactatcttaactgcactaatgattggtggccaagtgatttacaacctctgatgcccatcgtaaaatcccaagctgttttagcctgtgctaagtcaaaactgtcagcctaccaggcagtttgtaactaactgcaaatatggtaaccaacccgctggctgataggcggggccgaccgttcgctccggccccacctgtcagccagcgcatgatctctactcttttttatttattaggaggttgctgcgctgcggaggctgcatgcattagcgcggaaattctcaggctcgccgtcgacgaggaggaggaggaatcgggaggagatccgagatggcggcgagggagacgtcgcgccacgcgtcgctctgcctgtggctcgcgctcgtcgccgccaccctctctctcgcccaggtactcgattgatgatgcttgctcattctgtttatatcattcacattgcccggatttttccccttcaattcttagttgccaccctatcattagtttgccactctccctgatctgatctgattactcgtacgtcactcttctccaatgtgttcgattttctatttgttttagaacttttgctctctctgttttctcttttcaggcggtagaatcagaagccgaattgaccaaggtcaccaccaaggtcttcttcgacatcacaatcaatggcaagccggcaggtttgtgcatcctgactccctgatttcttgagttcaccaaaattttgttattgcctgcttctctggtaataatgccatttatgtatgttgaagattgttcattgtttaatgaaatcttccattatctaaaataatgcgtgtttgattgatgatatgctcattgacgtttagattgtttctacttggttgttataggtcggattgtcatggggctttttggaaacactgttcctaaaacagcaggtataacatcaacctaattacttattgttttcaacttaattgtttttgtctgagacacaaattggtaatggtctctgcatctgctctttgcagagaacttccgagcaatttgcacaggtatttcttcccaaccgtcatactacatttcttcaatgtaatgctaccgatttcatacaaattatttgaaattatacaatttggtcagctatcccaattcccaaacgtgaaaggctatatgtccttttagttttcttctctaaaagtgtcaaatgaaaaggcatattgctcgcatcctttttatgttatactatagggttaatacttattggcatattcggtgttacataagttatttcctttatcactctggggcctgttggtacttactgagcatgccccaagtcatgtactccagttgatttggctactatagttcacgagatttggagagagagatgtccctccaaacattttttttaaagaaaaaattgcaagcgtgttggcgattgaacacgggatatcaggattgaaaccacacaccccttgccactgcactatcaagtgcatctcttggctactatagtttcatgtagcaatctcaacttcacatttatacaggtgagaaaggacttggcaagagtggcaaacctctctcctacaaaggaacgccattccacaggatcatcccaggcttcatgatccaaggaggcgacaccgtgagcggcaatggaaccggctgtgattcgatctatggtggaatgttccctgatgagaacttcaagatcaaccactctgcaccaggtgaactgcttttcttgatatcccagttgtatactactatattactgcacagaaatttcattcttttgagcagcaagtcctcatgtttgatttgctggctggtcattggttcagggttgctgtccatggccaactatgcgaaagatacaaacggatcccagttcttcatcaccaccgtaaagctaacccggtaaacttcatcagctcctgagagctgagaattagttttcgtgcaaattttctttttgtttgctagaaatcttccgatcaaattgtaattttgatcatgacctactctttttgtgttgtttgctactgcaggttggatgggaagcatgttgtgtttggcaaggtgctttctggaatggacgtcgtctacaagattgaagctgaaggcagtcagagtggtactccacggtccaaagtcctcatatcagacagcggcgaactgaagtgatcttccattaacagaagcttaataacgagctgtacttacttaccgtgaattcctatcattggagtatgtgtgcacgtcattagtgccatgcattgtttggagcctgtttctgctgattataatgtgacctgctttgtgtaattgttgtaaaatgagagtgttctctcaatattttcccatggcaattcagattggatatgcaatgcaagcttatatacatgcgaacacaatgtcatattcctctttgatttagattattgagcggattattccatgaattatcaatttgattatgactataaattaaataatttataaaaataaacttaataaatagtttaaaacacgcatttttaagccttgtacaagaaaattctttttataaaaaaaatttaaagcgttgagcaaataatccgtttctataattagaataaggtttagtttgattgtgaagtttggatttttaatggcacgtaaaataagactagactaattaagtattaattatttaaaaattatttgttttttaaataaacttctaaacaaaaagtatttggaaaaaaataaacctttaacagtttagaaagctaaactatgctcacagtaaataacacccaaactaactttcaaactaagcctaagttgaaaagaacaactcgatagaatctaaaatttttatgctctcttgatcgatttatctgcatcaccactccctcatttacacaaaacaacccgcaatcgaaagttacaaaaaaaaaaagcacctcaatgagtgtgattaatgtggagttaaacacgaagatctttgcttgagacagaacccgacactgacatgtagggcccacctgtcaggcagcgcatcgctttcaccctcttggctactatttcttcgtggactcttgggcagagtgcggagaccgcagtgtggagcaacagatctatccatccatcccatcctcgatccttcattcctgcccggcggcgagcgagagagaggcggaggagatccgagatggcggggagcgggtggaggaggatcccggcggtgaggaggccgcccatgtcgcgcccggcctcggtctgcctctggatcgtgctcgtcgccgccaccctggcgctcgcccaggtgctcatccacctcgtccgtctccactctccaccacgcctcgctcctcctcctgcttccccgtatctgcgtgtgatgtgatgcgtgtgctctccgatctgatt

SEQ ID NO: 296 - DNA, 2926 bp, Oryza sativa
aaaatataaggaattttatgtggatgtgacgtatcttatactttgggtgagaggaagaggtactaataccactattatattgtactccctccatactcgtaaaagaaatcgtttaggacagcgacacggtttccaaaacacaactttgacttcttatttctataaaagtatttattgaaaagtgatatatgtatacttttataaaattatttttcaagacaaatctatatatataatttttatattttcaaactcaacaacttaaaagttatttatgatttatattcctaagatttgatttaagcattgtcctaaactactttctttataagtatggagtaatatgtattggtaacagtacagtatatacagcagtagtagtagaatatactgtactgtagggggaggtttgggccggcagaggaatgggccagtcgcacatgccgtctgcgtgcgcttcccgcgacctagaatatcgcccactcgctcaaccgcatatcccttcctaataacctctccgatccgtaaacctcgcccatgcgccacgtcccccctagtgtcctacctcccggaccacccggtcttggtagaccacgtccacctccccaactaaaatatcctccctaacccaaccaccccacggtaacccacgtacttaacgcgagttaccccccgcaaagatccaaccgcctctcgcaccgcccgcctgtccacccacgcctactgacgaacccggcccacctctccgggccccaccatgtcgtcaccacgcaggccaaaatcggggagagcgtgtcgtggtcccacctgtcattggcttcgtgggtgggagcgggtcacgtgcatctcgacatgactcgaggaggtaaccatggttatggtaaccccaccgccttgacacccgtggttaggggtgggggcgcgcgatgccgccacgtgtgacgatcggacggctgcggagggcatcggggttgggcgacccgcctatttaaccgcgggggcctcgtcttcctcaggccacgcagcgatctgaagtgaaacagcaaaaaaaatcaaacaaaaagaaaaaatattccccatctgtgaaattcgcaaaaccctagcgcggcggcgatgtcgaacacgagggtgttcttcgacatgaccgtcggcggagctccggcggggcggatcgtgatggagctgtacgcgaaggacgtgccgcggacggcggagaacttccgcgcgctctgcaccggcgagaagggcgtgggcaagagcggcaagccgctgcactacaaggggagcaccttccaccgcgtgatcccggagttcatgtgccagggcggcgacttcacccgcggcaacggcacgggaggggagtcgatctacggcgagaagttcgccgacgaggtgttcaagttcaagcacgacagccccggcatcctgtccatggcgaacgccgggcccaacactaacgggtcccagttcttcatctgcaccgtgccctgcagctggctggacgggaagcacgtcgtgttcggccgcgtcgtcgagggcatggacgtcgtcaaggccatcgagaaggtgggatcccgcggcgggagcaccgccaagccggtcgtcatcgccgactgcggccagctctcctagatctgtgctgttccccttcgcctttcgccagtatcagtcgtcttgagtcgtcgagtccctaaataaggaggaggtggtggtggtgttagtctttttatgagttcgtgtcgtgttggtgagatgagatcgcccatggtttggttggattaggcggagttcttggatcgattcggtggagttggatctgcgatccttcttggggttggttttaaatcttaattcgtgtcgctgcttctatgatatcgctatcaatcaatgagaacatttgggatccgtggattttctgtgatcttacacctgtgtggttgtttgttcttgcgacagtactaacgttcttgcgattaaagtagattaaactatcttcgtgagatgagcggtttgtcgccgcgtgatgcctgactttgatgtgatttgtgggacttcgtcttatccatttggttattattatttttttattttgcaccgaggctctctctctgatgtgatccactgtttctgatctctgatgttaccaccaccagagggtaatttgatcgcttaccagatctctgaaattatgcttaccggttagaggggtaaatgatcttacaagttgtttacaggttcaagaggtgaacataattgcgtttcaccagaggatactagaaccttttttgtgttgaaaaatctattattaagggcagcagtactaaactgaattattatgtcttgaaaattctattattaagggcaggagtactaaactgaaggtcgccgttattttagtgaaaagacaaaagttgcaacacctgtagtaggagtagtactccactttgaagaatgaccattctgaaatttgctaggtacgctgtcactgccatcatcttgctgccttgcctcccacaaggccacaacccagcgtacaattgtacaatcaattctctctgttttttttaaatcacaactttcattagccatactaataactccctccgtaaaaaaaaaagacaaaccctgatttccgtgcccaacgtttgaccgtccgtcttatctgaaaaaattatgaaaaaaattaaaaagacaagtcacgcataaaatattaatcatgttttatcatctaataacaatgaaaatataaattataaaaaaatttcatataagacggacagttaaagttggacacggaaactcagggtttgcctttttttttacggagtagtacttagtactatagtatttttttaccgcgagcacacaatatatttggatggatcttagatttttttgataaacttagaggttgttcagattgata

SEQ ID NO: 297 - DNA, 7738 bp, Oryza sativa
ctagggcggacgggcggtcggagcgcgggggccgacggtgggcaacgggcgatggcgtgctgaggcggacgggctggcgacgcgcggggagggcgcagcggacaacaggcggtgccaaggagggcgttggaggcgacgggctacggcgacaagtccatcatcccctcgagctccgcagctatggcgacgaggcgatgagtcctcggctcaggccggcaccgtcgaggtcatccttccaggcagaggtggcagtgctgctaagacgacatgaggtagcccttgtcgtcatcgtccttttggatctcaaagtctgggaggaaggaggagagaggtgtggagcctcttccccggttccgacagggagtcggcatgatccacggcctccctctctctctctttctcggctcaggcaggcggcgggcgatgaatcctcctcggggagggcgtggcaagcggcacgcgtggcggggagggcacggtgctctacgacaatgagttcgccgcccatccacatcgtccccatcgactgtcgtcgctgtcaatcggagccacacacccgcgccaacgatttcccctccctggccgtcgtgcccgccgctgctcgccttcggccggagtgacctagccatgcgcactgccactcgccacccagctccgtcctatgcctccgcgtctcgcgctgccgcgtaccgcatacccccgcgcgccaccggcacgccatgcgcgcgcgagagagaagacagaggaagaggggaagaggatgtatgacatgtgggtctcactattattttaaaataaaatgctaactggattgccacgcgtataaaacagcttagattcggtcgagaggggtaatttgtccgatattaaaaatttatggtgagcaatgtctgattttctatttaggggatagtttaagtcaaccccgatagttcggggtaattccatactttttttttcctcttttttaacgagtttactcctgtgactctcatgacgtttggccggcggccgtgccgagaaaaaacacgccggccacggtcaaatctggtgaaaagcccgacccctttccgttccttctctttgaattccaatttccaaattccaatttctacttttccaacccaacctcaaacacaaccaatccacctccgattccttcatccgccgccaccgccgccgtcgccgccgccgggatcccgcccgcaaccgcaccgcggcggctccttcccttcctccaggtaccaaccaggtgcgtgcgcccgctgcccatctctccctcgctctcccgccccccgcggaggctggcgcggggagatctccggcgtcctagggcttcggctgcagctctggctgctgcttggtgcttaattcgcgcgctgccgaatttgattgattccctcctcgatcgccacttcgtgcctgagtttttcggcccccccccccccccccccccccccgcctcgtggccgtcggtgccttgggcgtgagcgacgaaggggagacgatttgggtgggggagcagttggagcacacgctcttcgtgggtgggtttcgctgttgctccagcgcagcacatctagaggaggcgaggagaattggggaaactggtagaggaggaggaggaggggtcctcacctccctctcttttagctagcgtgatggattgttagggttagctgctaaggtctcggtaccgtccctcactttgaggtttgaggctgctgcaactggtcgttggataaattgccaccgcgaaaaaggttagagaagctaccgattctttgggtagattgcttttcagatagattgtggtatatcctactacttcagattgcttgccgacgacgccaaaacggcagcctttttagctgacctaatgttgcaaattttagttaagttttttcaaggtcttgctgctggctgcttctactgaacaattgttttttcattcctagattgtgggatcttcctagagagcgctgttgtcctgcacgagtagaatagcagatggcgaggataaagccgaagcaattgctaattcaaagcaagacgaagaaggccccaacacggatcagttactccactatcgttacttggaacctaattgttatcttggttgcgctatccctctatgctacctacaggcattggcatcacaggttagtgccctttcttgcaatatttgttgatttgctgatttagtagctagtcccaagcacaattgatctagctttacttgctttttgacttccttcactgatgagatacctcacaggccaatgctcgagactgaaatggatctccctcgtgctgaggtacgctaaacaatctagttcatgccctatatgctcttcttgtcttgctttgtctccaagtacttcctcctttatgccaatgacatgacatgtttgggtcttggaaaacaccgtgtctctgccttttctgaatcattgatcctagcattttgttttccatctattttgaaaaccttcttgttctatatttaatgtccaaatcatatgtatagttaatgaccattggaacttctgtgttagtgttgtaaaatgagccatggtaaaccttgtttgcagcaaatacatgtgtcttccttttcttatataggttcgataatatgctatgttataaatatgacattttctatggacttgcaatggcttctgtaggtgatttgtgtccttatatacatttttttagaatgacgatatctgctgatacgagccatactcaatctgacatcaaattcattgattttattctcttatgtgttctcttcctgacttccagcatgttggaagatctgaggattccacgaagactagtagaccaagctatgcggtaagttgtactattttcctttcacaggacaagatttctgaccaacttagcagcatatgatgttaataaaaattatatgcccgattgtcttttaagtgtgttgttagtatatatcgggtcaatttacaattgtacatggtacgttaattatgtcttgctcttctgttggtctggtagtgactgctataccaggttttgatctaaatcttgtggtatgttatgctttggaaatgttgcaatcaactattttcctgcttaaagtagaatcgaaaataagtacaccatgcatggatataaacaaattatccttagggtagtcctttccttatgcacaaaccctgaactcctgaaggccttaacaagataaagaaaactatccttgccattgttggattaatcatcaagttttaaataatcaaaactccataaaaagacgatgaactagtgttcatccggaatttagtaggttaagtagtaatagttttacaggcttgaaatgcttctgccaaatgtagttaatactttcatatcttaaacattgtggttttatgctgcagaactagacctgatgcacatccttttcttgttatgaacttatgatgtttggatgctaattattagcagtacaagcatacaattagtaagagaagtagattgtatgctattgcctgtaaatataggaaattaaatctgatgcatataacctttttttatgggaatttgtgcatatgaccttactgagtagacataaaatatttaatgcaacaatcttaagcattcactgaacataatgctattgtaattttcttcctccaggttattgatactgccaaaggctcaattactatagaaatttacaaagatgcttctgctgatgttgtggatagatttgttagcttgtggtgagcactggaatctttgcttaatcttgttttatacttttacatgataatgctacatggatgttgacttgtctatgatcatttttggggcattatttgtttgtgttggactctctggctatccgcagtggtgcaattccacacaaacatgtcatattcagtccctctgattatttcatgaaagatacaattagagtataagtatctagatatgtaatccatataattttaagatggattgttgataaatatataaggcttgcatgcaaatttaaaggtccttttcctatcatgctcctattgatggtaacttgcatagtccacccatacaaagcatccactctcttcttttccaaaacagttactaaaatgcatttttagttccaaactctcctactttctcaatttcgtaagctccttaattcttactcagtcaaatagacccctattgatttatgaagggagcatgagctattaaactttcttcaagattttacacaagaagttttcagcaaaagggtgtgcacttctccctctagtgtacctctttttgtggacagattcttctgtgttccctattcctttcctttgcaaaatttctttcttttcttgtgttcttggcatcagctttatttctttgaatactttgatcataatggatctttctattttattgataacacatcacacattgcagtaatgagttagacagctagtgatcgcagcatcatgatactattaatatggttgatagtctaggcacttgttttggatccaaatagatgaagttggttgcttgtatcttgcataaatgaatgataccttagagtttgcagcagaatatataaacctttatggttgcatgcaaggttcttgaatccagtttcttgtaaagatattgcttggtaggctattcctgtgtcattagtcatgcaaagaatgtaatcaaagcaacaaatgaaatctttttagaggttgatgaattgaaatctgaagacaactgtattctacaatacttccaaggcaaaaaaacactacattttatttgtgaagtgcttttatgctcaccgaaagcaagatcacatgaacttcaatgcgagtaatttgaagcaggctcatcatgctcaccgattagcaactctaaatgcttaatgctcacaatatttgttctttgaggtcaagaagccaactatgatttattaagtacagtgtgataaactggttttggttttgaatatgcgatgtatgataaactgtagtctgagatgagatgatgctttacatgtagcagcgtgtttgtagcgcaaacatatttgctactccctccgtttcgaaatgtttgacaccgttgactttttagcacatgtttgaccgttcgtcttattcaaaaacttttgtgaaatatataaaattatatgcctacataaaaatatatttaacaatgaatcaaatgatagaaaaagaattaataattacttaaattttttgaataagacgaacggtcaaacatgtgctaaaaaatcaatggcgtcaaacatttcgaaacggagggagtattatggtatttgttatttgtaccatattgcccttcaggatgtctcgtagtctaagagtaactagtacaatttctctaggcttgcattgctggaaggaatcatgtttcaaaggagaatagcacacatgttaagaatttatcaagataaattatccttttgtcctctttggattatcatctaacatttgtttcaattgccagcaagagtaaccattttaaaggaatgccgtttcgtcatgtcatcaaaaactttgtaattcaagggggtgatttcgatttcaatggtgctgcccaggaatggatactgaaagccaaagccagtggagaaaacgctctaaggtttgtccccaaatcaatgcacatatagaattctgttgaaaagtcttggttttgccagacttattttttttctttacactacgtgtatttctatgattttgcagtccaaagcacgaggcattcatgatcgggactacgaagaatcctaataataaaggatttgatctttttatcacaactgctccaattcctgacttgaatgacaagcttgttgtatttgggcaagttatcaatggacaagatattgttcaggtactttacattgaattctctctggatgcattaattcagttgcagtttccatacatcattggaacctttcatttttcatttatatttaatatcatttttctaaaaacaatatatttcatgctgagatgttcatgtccttacctcatgattagtattgttacatatttgtacattattttgagttacagtagtgctaatgccaataggaaattgaaagagttagacatgagtttaataggtgtgctaatggagaggatatgagctaattcaatgtcattatctacaaatgtatcagacgcatgtgcttcaactggttgaattagtattttctgagtatgttcattttaatgagactttttgcttgtttgatgacttaaacaggagatcgaagaagttgatactgatgagcattaccagccaaaaacccctatcggcatactcaacatcacgctaaaacagcaagctttgagctgatagcttgttgtccttacctgaaaatgacttatctgtactccaagagggtccatacatcgcctccaattgctgctgaaattgattatgattatggcttcctctagaagcccatgggttgcaaagaaagaaggcgcttaatcttgcctggcagctaaaagcttcttccgtctcatggagtagttgtgtataaatttatccctggtgtcattcggctgtcagtttttgcaggcattacagtgtattttgatgcttggttgtttcattgtaaatttgaagcccatttggatcatgaatcatagaacttggaattcatagttagttatgaggaataagttcatctgaggtcccttaactttacaccgaatccgattttcgtccctcgatcagaaaaccagacacaacgggtccctcaactattaaaaccggtgcagattatgttcctcagcggttttgagagcagttttggctgacgtggcgcctacgtggctaatttgactcggtctttgtttgacgtggcattgacatggcgcttacatggcaattcgacccggaaaaataataaaacccgtgggacccacatgtcagtctcacatagaaaataattaaaaatttgtgggacccatgtgggccccacatgtcagtcaaactcacccttcctcttcttcctcctctctccccatctccctctcttcatctctctcccctctcctctcttcttccggcgagagcggcgagctggagggggcggtgagaccggcgcccaccggcgagagcagcgagctggaggaggaagccggggcaataaaagggagggaggatgtagggaggccggcgatggccgagcgccgtgggcgggggcttgatagcgacagacggagggagaggtgtgcagccgacggcggccagtgggagagggagcggcgaccgccctccgccgcaacccgcctccaccaccgagcttgtcagcgaccgcccaccggagtgaggaggacgacagctggcgatgggtgaagaggacgaaggcggcggtctggagcagaggtcggaggagagcccccagccgccaggatggcactcgatccgtcgcatttcaccaccaccgagcttgtcagcggcagcccaccggagcgaggagcttccccttccccttccccccattgacgtcgccgccgcaacagctgaggcgccgctccccatgccgccgcttctgtggcgcacgccggatgcggacggggacgccatggccgtggctgcggacgacatcaatgtcgacctcggcatccttggcgactcccaggcccccgcgccgccgccactagcggggggagcagcgcacggcggacgtcctcctcttccg

SEQ ID NO: 298 - DNA, 2732 bp, Oryza sativa
tacaacatcggagccgatgccaatgatggtgatggggaacacgaggtgcgtgaaggaaactcaaagccaaagtaatagatgagcaagttgaaatctccatggtgccggggaatacgtactatctccattctacgtgcaatcaattctttaattttgaatcatgataatagattaaaaaattaaaatggccatagtatatggatgggatgcaggtctcgagggttggtggaatgataggacccactaagaatatatcataaaaagtaatagggtaaaagtcacattttacgtatcctatacagttctaccaaaataaaatggcaacatcaaattggggcaaaatagaagatcacactggttaacgtcagtacgtcagcatacttgtactttcggttgtatcctttgtaataatatcaaaattattaaacacagtgtggcacatgccctataccacatagctagctagctagctgctacacatccatcttgtgaaagatcgtcgcggcttcacttctccgcagcgacaaacaagggcaaaaggcacaaaattaaagcacatattgattgattgtatgtacgtacgtacgtacgtactgtgcacttgccttttctcaaacgtgcttgttaacatcatatattgggcagcagtacaatattccttctaaattttgccaccaaactgtccgtttccaaacctcttgttttgcattgcaagcagtcttgcggctctcctcccacacggagaggttgaccattaccagcatgcgtgttgttatccatcgcaaattaaagctgatttaaatcatatcaaacaacacgtcttccgtgcactataagtataatctctcactctctcctctttgatcatcatcagctcatcgatcactagcatagctagctggctgcaaatctgcaaaatgaatatgatgagtaactaatgcgtacataggagagtgtgtttcttgcctatattagtgattagttgcgagcttagctagccatggatcatattggaattagcggcggcggcgagggcggggtggtgtctccggcgcagccgtcgtcgccggagcggcggtacaagggcgtgcggctgcggaagtgggggcggtgggtgtcggagatccggatgcccaacagccgggagaggatatggctgggctcgtacgagtccgccgagaaggcggcgcgggcgttcgacgccgccgccgtctgcctccgcggctcgcgcggcgccggctcgctcaacttcccggagtccccccctcccgacgtccgccgccgcttccccggcgcggctctcacggtcgagcagatccaggccgaggcggcgaggcacgccaaccgcccgtttccggcgaacaccgccgccgccggcgggtcgtcgtcgtcgtactcgatctcgcagcggcaagaagcagcagcccctgcgcggtcgacgagcaacgacgacacggccatgtcgtcagtgccctccaccgacggcggcgctgccgactacgacggcggtgatgatgtcattgactggtcattcatggacacgttgccggcgatgtcgtcgtcagcggctagtaccaatgctgatctggtcccggccatggatgatttcatgtacgggttcttgcacacaatgccgccatcgccatgcgaagacggtggggaggatgtgatgatcgacggcaattgcaacatggatcagacatttttctcagtagatctttggagattttgatcctagaaatctactagcaactggtacccaagaacacaaatatggcggcggcctatatatttaccgcagtcacattagcattctcaccagcatagatacagcatgatacgaaattaattaattagtgcattgtgtataaggttcgatttgtatttgctgtgctatacgctgcgttgtgcttatttttaagttgatatacttataatcgccgtacattgttttacggatcaaattatagttttaaactagttagataaataaattaaaatatatatgttaccatacttccagtttttcatagttctcaactttttttatttcctattttcaaactgtgatattacaactactaatagaaaaacaatttactactacgaggctgattaactacaggctgactgtattttcagttggggcggcctggttgcaaaacaatatgattttcgtaaacacatgctaagtggcgggctgtctgcgtaaagcgatttgatcgcctgaaaaaatggttttcatagtatcgaacaccaaaagaaaataatttccaaatatgaaaatgtgtggttgtatccagtggcggatccagaacaagatttaagggggaactcatttccttcttcctttttcagtcccccctactcttaattttcttcctattcttttcctttcatctccccctttgttagtggtgatccagcggggtaggggggactcaagtccccctagcacctacgctggatccgcccctatttgtatcagactatatcatactgcactgcaatactaaatggagcctaaagttgggttgcattcatcgatttgcagattcttccgtgggatatataattaagaaagtccaaaggaattaattaatcacttgcaagttaatcacttgcaagctccatttctagcttagctagctagatgatggtcaacattgatttggccaagtaagatgatgtctatgcctgtgctgcttagatccaacaacaacctcttgctt

SEQ ID NO: 299 - DNA, 5607 bp, Oryza sativa
ctgacgaacaaaaagaagggacggatgggggattccgccatgtgcgccaggtcgggacaacggaaccaccagtgaccgggcgtgacgtgttcgcagctaaaactaattctaaaatcatgatgctgatctcggcgtgacgtgttggcagctaaaactattccaaaatcaaggattaggactaccgaatggcactagctgccgtggagaatctctatgcattgtttctccagtgttaacatcgtttctccttggcacgctaagctttccaattcctgctaaaattttattacctttttggacgaaaggtggtgattaccccaagtacaaggaactaaaaacaaattgtcatactccaatatagcaataatagtctgaaacaacttgtagtgtctgtttccatgttgcttcttgttaatgtagggtgacagctaggataattgagagttgacacgtaaggcagcttcgttacgatgcttgcttttagatgccttataaaacaatttacgatttgctaaaaatccgatctaattatgataacatttgccattttttccttaaatcaagcgatgtttatcttcccataaatggttgaatgagcaaggtgtgggaaaaaaaaaggaagctttgatcagtttttttttatcgagctatctttaaaattatttttcataatttattatattttctccatcatttgagactatttcccttaacgagctgggaagccgaaccgaggcaggatgaaaacaacttccattcaaaattaaatagtaaattttattttgaaagaaaaaatagattaatgagagcaagtttgtaccaagctaactaaacgagcttttatttttttttctccaaatccagaatgctgcaatccaattgataatcacatttaccaccggataacctcatgttttagataactcaaatggcgaagcatgcgtgcgattaaaaaagttcgttaaaaacgctataaaaggcggcggtgcctttctccttcatccgtgatactcccaaagattcttatcgattgaagaaaaaaaaaagccggagaaaaggatagagagggaaagcaaccagccatggagtcgctgactctccgggcatcgccgtcgacggccgcgccgttgcgccgcgtccccgggcggcggcacgcggcggtgtccgtccgcgcctccgccggcgccggcgagccggacctctccgtgcgcgtgaacgggctgaagatgcccaacccgttcgtgatcgggtcggggcccccgggcaccaactacaccgtcatgaagcgcgcgttcgacgaggggtggggcggcgtcatcgccaaaaccgtaatcctctcaaccctcgcaaccgcaattctcctggatggatgacttttcctgctctaattttccgttgaaacagcgcacaaggataggatctatgtgatgtagttagcatttcagtgtttgagataagttcgcgtattaacgagagtgccttttggctgtatgatttgattccgatctgggttgggtttggagtgggagtgggagtgggagtggaggtgggggccaattcaagctcacttgaaaacaggtagctgctaacatgatgtcaggaaaggtggcggtgtgagtttgctattttggttgcggcaaaatcgaatcatggagtcgtggctacgttagatttggtggtggatcttatgataggttttgatgggtggccatacgagaattgatagattgatgggtgccggatgagaattcagttagttatatatatggctggttagagttaggatctttgcatattctaggagaatttggtctgtatgtactacttgtgttcactatgactgactactgacaaacgtcttgcttgaagatgagatggcctaatttttgtgagatgagcattgcatcctcagtattaaacatgagaaattagtttcaatttcttttgttctgcattaaccctttgcaatcatcatttccacctttttcacatacacattgttgtttccattgtgcatagtgcctttgcagtcatcactttcacctatcacttccaacggttgaatcatcaactttgtggctaattgttggtatgattatgaatggtaggtatccttggatgctgagaaagttatcaacgtaacccctcgctatgcccggctcagggcggaccccaatggatctactaagagtcctatcatcggatggcagaacattgaacttatcagtgatcggcctctagaaactatgctgaatgaattcaagcaactgaagaaagagtatcctgacaggatactcattggctcaataatggaggagtacaacaaagctgcatggcatgagcttattgaacgcgttgaagagagcggagtggtaaccttcccttatgtgcattttggtgcattcttggtcgaacttatcatgttggaatgttaatgatctgtttctatcaggatgctcttgagattaatttctcatgcccacatggcatgccagagcgaaaaatgggtgctgccgtgggacaagactgtgacttgttagaggaggtctgcggttggataaatgagaaggctacagtgcctgtttgggcaaagatgactcctaacattacagatattacaaaggttagtcaaacatatacatcttcgcagcacttaaatgagatcctaaattagtttttatcccacccggttttcacattgttttggacatcgtgttcgcgaattattatttagcgttcgtgtaacatgttttggacatctcttgaagccctagcatcaccatctatggaattaccactacattagaataccaagatttaggtgctttttaagatctaccaagaattagttttttttatgggtcaatgttttcattccttacttgcattgtgcagcctgcaagaatttctcttaagtcaggatgtgaaggagtttctgctattaacacaatcatgagtgtgatgggaattaacctcaaaactttgcgaccagaaccttgtgtggaggggttagattcaattccctgagttctttttttccctatggaacatattcctttactgttaccattttttttcttataaaaaccacttgattccacagttattccacgcctggaggctattctgcgagagccgtgcaccctatagcacttgcgaaagtcatgcagatagcaaggatgatgaaagaagaatttgctgatggacagtcactctctgctattggaggcgtggagactggcaatgatgctgctgagtttattctacttggcgcagatacagtacaggtaagctctaacatggtactaatgttagtattatgcatgtttatattctacttgatgctgctgttattacacatgtttccaatctggcaacctatgtggctccctttactatggattttgaagatcataatgtgtgctgctcgtgtacagttgatgttgaattatattctagattttttcaggcatcatttttgcaattaattgattagctccatgcttatcttgaacagcataataataagacttgactaatggccattcattgtaggtatgtacgggcgtaatgatgcatggttatggccttgtaaagaagctttgtgcagagctgcaggattttatgagacaacacaacttttcctcaatagaagatttccgggggtatgttatcaccacttcccttcttctgactcttgttgatttgttgttggaaatcatctggagaaatcaccttagtttagagtactgtactatgatatgttgcctacgaatgaacttaggaagaaatggaaaatcaccaacatgagtgttcatgaaacttttcttgtaaaagaacatgctcaggggggttacacatcttttcttgcagttttattttccacatttctaagtagaagcaaggacgggacactctattgttaaaaacagacttgaggtaatgattgaaggcagacttataggttgttagcggtagtcattatgggcttgaaccttcattatgacatgtttaggcaagccttccaatggctctgccttgcacgcctgaccctactatgtgtgaatggtgtagattaaagtcttgtgtaccttatgattaattctgtgtcactttggccttgttttactcattctcaaggaagcctttcagagctattgtttagttcggtactttttccactcgcagaggacactaggaccatctcttttcaaattgtcgaaaagcataatgttgttttattgaactaaaatatggtttatttttttcctttgttaacaaattatcactaatccaagctcttcacatcatctcagggcctctctcccgtatttcaccacacacaccgatttggtacatcggcaaagggaggcgatcaaccagaggaaggctattaggaagggcctggaatcagacaaggactggaccggtgatggattcgtcaaggagacagaaagcatggtgtccaactgattcgactctgaactcacacccccttccaccatacttccaacttgtgattaaacagggaccatgttcagcccaaaacagcagaaacttttgcatcatctcgttcaaataaaaagcataccaaattacttccatcatgttgtcctgtgcttgtccattgcaatcctaatctgtgcatttttgagtcataaacttcgggtcctgaatctggaccaggtcagtagttcagaagtcgttttctacacttgatgatttgtagcaaacatgccgtgctcataaactgttccatgtgaacataaagtcagggtcactgagctttgggatatctggacttgaccttgtaaagcctcaagacttcaagtctctgctggaccgtgtgcctgagtaaagtgtgagcaaacgatggcatcagcatctggtcagattgagccgtacatgtctctaatccttcacacctgccgttttgtacctgagattcatgctacaattatctgtggcgcacactgtcagaaatttcagcatcgatcaatcagaaatccgctgatgaagaaggactttttcttattacttcttctatcctaaaatagaaatttcagcatcgatcaatcagaaatccgctgatggaggactttttcttattacttcttctgtcctaaaatataaagtttctaaataaatatatcaaaatataagcatttttaactactactatgaatctaaacataaacatgtttatataagtatgtctaggtaaataaaccagaagttatattttaaaacaaagtgagtattacaagaaaaacattttagtatgtctgacgggggaagttggaagtttagaccatggtattcatgggagaacatgaactcaatttttctccgtttacataaaactgcattgaagtggtaagtagtagcataattcggatacgttaaattgtaatcgcatggtttcaatttcacaaattttaatggtatttttcaaaacggacaaatttatagtgacatggatccaattaatatatatatatatatatatatatatatatatatatatatatatatatatatatatatatatatatatatatatatatatatatatatatatatataggacactcatatggggcacca

SEQ ID NO: 300 - DNA, 5573 bp, Oryza sativa
ctaaatctcggcaggacccaccacataccatgtcttatacggaaactgacttcggatatggaggtagttccggataaagaaagacaactagagttctacatggaaacgacaaggactactcggattgtatccatattggtttccctagttctacttggacaaggggacacctatgggtataaatacaaggccccctaggaggagaggggacacaatcaacatacatggaacaacatacaagccaacatacgccaagacaagatgccggacatcgacttcagagataggcatggctagtcccctacggtgcctacagataccgtcaggagagatatagcgctgtctctgatctcgccggatgcggattcgaggaggaaggctaccctattgtcgactataagtcagaacttcagaccgctatgtcgacaatagttagataggctaccccaaatattgtaccggtgtgattatgatgaataagagcaatgaccggcttcggccaacaggatgtagggctattacttgacaattcaggggcccgaacctgtataaaaatccttgtctctgtctcttttacctcaatctcgcatatatcctagtaccaacgatccctatcctatgcaaataacggaatcgcgacatcaaatgtcgacagtgctcacaataaataagagagtagccaatccgataactactttacaacttattgcttacgtactaaaacccttaatatgtagtatataatatactttattttatttttaataaaaataaaatacgagtaaaaacatagaaaaaaaggaaaaaagataaagaaaacgtgcaaagcagacaaaagagaaagaccctgtcttgctggctatacgtaggcatgtacagtgtactatctcaactgccattcccaacgactaactcccctgtatcaaccaaacaaacaaaaaaaatatcttttttaaaaatggaagagaaaaaataacagcggccattgattttgttttattattttggttggtggtgccgtgtagagggggaggcgacgagacgagacgagaggaaggagacgagacgatacgcggagatccgggcggcgacccgcggaggaggaggagcccgcggcgccatggattccgaccactggatctcccgcctcatggccgccaagcgccagtacgcgctgcagcgcgcccagaatcaccaccacgccaccgccaccgccaccgccaccgccgcgtcgcactcccacctcggtataccttgccttgatttcttcccctttcttgatccggcgtagaaagccaagccgcgattttttgtttccctgagcggaagattttggtctggccgcggaggatggatgtcccctttccggatctctcgattcgtcgtcgctagtttgagtcttttgaggctcggtttgtgatgggttgatttctaggaattcgattgatttgtgtttggattcatgttgtttcggtgaggaccaataagaggaggattgagcatgcatcgttgtttcgtctcatttggctccatttcttggttttgaacttttgatgggggcctatttgactcgtctgaaagatttgacctttgatgaaatgcacctatgccaaacgtgataatcttttgaatactcagtgcgttcatattgattttccgtttttgaaatgctacgttttccctgttcaaatgtaagtcgcgaaatgacgctttcggatttggtttgacaatattgcgttatttctttcttcggatatttgcaattatttgagattggtttgctttcttctggttcttgatgttctatttgtttgccttatggagacctgattgaaattaacattcattttatactatctaacttttgcatgtcttaaattaattcacttgcagatcggtatgggtacgatgatgttgagccagaggacgaggtacggccagacttcccatgtccttactgctatgaagatcatgacattacatctctttgtgcccatttagaggatgagcacccctttgagtctaaagttgtggtaagtatctctgctttctactctctttctgtattttcttatatgcttcttttatctgaagtcagtcaaatgtgtgagaaatcatatccactccttttgtttctttcattttggatagccatagattaaccttgtagaactcgagtaggttactaaatttcgttgtgaataatcagtgttttgttactacatggagatattgaattaatacataaatgatggagagagattgtgagaagaagctaaatggaaatactcatattttgcagttgttacacattggctacatgaacctttaggttaaagtttaactttgatgtgtattggaccgttctgatatgattgccttaatttgttgtgttgcatatgctgtataatttgttacttaatttatagttgtatgctgcaggaatgatttgttttaattcttatccaatgtcatctctttaaatgatccatttaaatgttgagaggtttctctatgaatgtttaaaggctgggcttgcaatacccaggtaccaatatgttatttgcatagtttaatctctctctaaaatgattaatttaacagacagtatttgatctaggacaaagaaaacactaatgcctagatattcattttaaagacagaacatacaattaaggcatagatcttcttttctagccagaccagacaattagaactcaattgttccttttgccataaggatactatactaaggggactaagggttggtttgggattggcatactgcgctggactaactgggaacacggttatactggaaactgtggaaactgctggtataaaaaatcaagctccttctgaaggtgcatcgaagtatcgaactatagtcaagtttggtgctatcaattttctgaagacatgaacatttgtcagtaacgtgatttagtaccgaatatgttcatttcaatagtgaaaacaacatcatgatgcacacaagcaagatatttacacagttcttatataggattaagccaaaaaccagattcagggcttataaattaaaaaagtcagccagcttttggtacaataacgaggtggacctaatactccttccatatgatatattctgtagttcctactccctaaccatacttgtatactctccacaggcttgcccggtttgctcggctaggatttcaaaggacttattggatcacataacccttcagcacagctacctgtttagaatatcctttttgagatgttaaaagtctctaaattctgtatcatgttttgtgaactgttattttcatatgtttccttaatggtgtattacctgcagagacatcacagattacgcagagttgctgttcctagcaaccatgctctctcccttggagggagagatctacaggagacctacttaaaggttcttcttggaaacagtagtcgaagcagtggtaccaatgcagcaagttcagtcactgattcactactatcttcacttgttttaaatttatcttcatccgaagccgaagatacagcgaaattttctgctctagctgtggtagaaaataattggtttaaaagaacactgccttcaaagacttggaaggcaaggtatgatcaataccttcctgtgtgctactagtactatttttgtgccttgtatggttttctaggtcttaatcccagataaaattattataactttgtgaacaaataatcctcaatttaccagttcagatatgctttccgatactcaaaattgtagatctgcttggcctagatttcattcctaccaattgtgttactgtttgtacatcctaaagttcatttgtatgctataaattgtgtaagtaaactcagcttataagtcactataaacttgtgagctctattgatccacactaaagttggtttatctataactatactaatatggcaatctgaggaaattcccactaataaatctgaccatctatctaggtgggaccaagttattatttggtttatacacactgacattgagctcgtcatgctctatgaacaagagcgtatgttaatcgactatctttcttgcagctctgattctaatcttagtcaggaagaaagggagagaaggcggaggcgagctgcagtgagatcatcttttgtacagcacctgcttgtctctaccctttttgatgactagcagaagaaaaaaagagcagctccgtgcactggaatctcgagtgggccttttgtccacacatttctggatgaatgatgaagtaaagcatcttccaaatcctgaagcagttcatccaaccggaggctggttcctgatcctttcgacattgatgatgaaccgatgtggctggcctcttacttgtcatggaagcagttctgaacatttatgttcgaaatccaattcagattgctaggctatcgactagcgttactgtattgattgtgttattccatatgatttcattatgtgcttaacaatacaatgaacattacccccaatttgattcttactataaacatttcaaaattgaattccatgtttggtatattcatgaggttacattatctgttctatctggcgtcaattttcctgcaatagccacattacctttattttgtttggtagagttccagatgaagcaatttgcttggatttacatccatcccaaagtatcatttctaatctctactctctccgttcaaaaaaaaaaaaggtaacctaggaggggatgtgacctctcctaacgtccagatttattgtactaggatccttttttttttctgggggacagagggagtactagtgaagaatgaatctgagaatacaaccaggataagtcacatcatctgattaatattatctgttagaatcataaaatgatcaaatagataaaataaatctcagctattgagggtattatggatttttccaacactccctcatcgtggcaaagagataaaaatagtagagattagagagcaaagaaataaaagaaaaaaaaaaagaactacaagctacagcatcgtccatgtctcgcatccctgcaccgagccagggagcttgggcctatagttgttgattgagttagttgactgttagataggtccataaatatatataagatttggtttttaatatgtttataagtgcatatgagatttttttatatgctcttctttaaaaacataaaatagaaccggttgatcccatgtgaaaaagggcatattaaacattgcaatgccaatcactacaaccccagatctcacatcaagtgcgaataataaaaatattatactttctcaataggaagtaattgggcaccaataaattttaaatacacatctctattcatagttgtcgtttggaaaatggaaattctcatctactctgtccgtcttcaaattttccaaattatacgggggatctccaaacgagtaaattctccggggtatctaagtattttcacctcaatcttgaactctactaaacaacaacctaggactaattatatttgtggacgaatggaatacataatttataatcggacacgcgaacggtg

SEQ ID NO: 301 - DNA, 3910 bp, Oryza sativa
catgctcactacctcttctctctatcccctctctctctatcctctctctctccctcttttctctctccagccggcgaagcagggagggcggctcttgccgacaccgaagtccctgatgagcaggatcttgaagctgcacccgtcctcaccaccgccgctgctccccgcccccggtggcgcggcccacaacgccggccgttggtcgaaaattccccattccaaaatcccaatcgcgtcgaattgagtgaagccatgaacagtgtgggtgcagcgtccaggctaggtggcgagcctctgcagactgcaggccggcgcggcggtgcttgcccgctcctagtgccgcggtgccacctggcctgcacggctgtgcgcctgcgtgtagcagcccagctctaagccgagcaggcagcaacaccaacaagtcagcaagggcaaggcagcaaagcaactagcccgattcagcacaaatggatagaaaggggaaaggaaaggctttggcatcataaaaatgtaacatttgttgagtatttgacaaatgacaagtgaaaacattgcaatttgcaaaagtataatgaacaatttgtcattgattcacatgtctgtaattttccgtaattttgtttgtagatttgaagagctatttcaccaggtagtccagtagttgccgagcagtatgctttcattccacagcgcggcggggggagaagtcgcacgacctcgacggcaccgtcgtcggcgggcccaacggcaacaacgtgttcaccgaccaccggggcgcgtacctacagacggaggcctgcacgtacaacacggcggccatggttggcgtcttctctaagctcatggaggtcgaagccgagcgcggcgcctctgcccgctccgcttacgtcgccggcgacgcgcaggccaacctcaagaccctggtcgatggcctcgtcgccaacggcaacaccaacatcaaggtggacgccggcacgcacccgcagacggccacaggccacgggcggctcctctgctcccaacggtcggcgccccgcgcccctccggccaccgccgcgctgcgacttctcccccgtcggccggccgctccgcccacgacgcgccgcttcacccctcgtctccgcccctctctgcctctgcccctctgctctgccgtcgcccactccgcccgccgcccactccactccgtcggttggagagagagatggatagagaggatagagagagagggggatagagatatggtggtgaggatgacgtgtgggtccacatgggcccacccattttttattatttgtgtgcgaaactgatacgtgggtcccacgtgttttattattttttcatctaattgccacataagcgccacgtcaacgacacgttggacgaaaacctggtcaaaaggagccacgtaggcaccacctcagccaaaaccgaagacagtaccgccgaaggaccttatttaaacggttttgttaagttgggggacccatcgtacccggttttgcgaccggggacgaaaatcggactaggtgataaatagagggacccaaagtgaacttataccaatgcaatttcatatcaaacagtcacggatgggctttaggaaagcagaactgggcccggcccagtagatcacatagcccaacaagatctaaaccgcatgctctcgtttcaacaaattatcacaccgattgcatttgcatctgctgcacaggctaaatcaaacacgtagccatgaaccattcacctcacaagtcacaagcattgcatttctatggttaccagtgcaggacgaaatgctcaactagcccaagcaagaatggagcatgacaacctcaggcaccaaaagctctataaatatttgcattgcacaaatcaaaagtttccaagttttaatcagagaagttcaagatatcagaaagaacaacacataccaggatgtctcagctcaagtcttctagcctggctgcactgctgatcttcctcctggcagtgttcaccactgcagcagcagcggcaggtacagaatgccagaacgatgtcgaggtgctgaagacaacctgctacaagttcgttgagaaggacgggccgaagctgcagccatcacctgactgctgcacctccatgaagggcgtcaacgtgccctgcgtctgcacctacctgggcagcccaggcgtcagggacaacatcaacatggataaggtgttctatgtcaccaagcagtgtggcatcgccatccccgggaactgcggaggtgagcaggcttcacttgattggccacactgatcacctgggtaagaactgacaataacacgccggctcctctggattgcgacttccagtggggcccaggtgtcggtgtcagctgggtaagttggtgtcatctggtatgggaaactttgatgttttgtacatgtggtggtgctcttgtcaacattatatagataaggagagaataggacaaacatgacgcttgaatagcagaagagaagttctatccagcaatatcaaaagtacagctgtcattttcaaaaaatgtaaaacaaaaataaaacgaaaaacccactatactagtgccaataaaagaagaaacaaaagagaactacattattgtcaatgccatttgttgatgttattattacttttgtttataagaataacaattgtacttataaggcctacgatttattacaggatccaaggtctaaaacaagaactgattgacttggtgaagttggctgacaaaagcaaggcacctagcagttgcacggctgatataggtaaataatgttggtcaacttttagagtacacggattgtacgtcaaccttcagcatgttgtgataacaaaatatgtatcaatgatggttgtctatatacactgaaaatgcaagagtatttttaaatcacatgttgtattgagtattgacccagctatcaactgtttgttgatgtgccctgttccttagtctgataaatgctaatatagcacattgctaaaagcataaataaatatctagacatattggacagggtgaacgatgaagaaatgtccaaactccaaatatgagtaggataagtttgaaaaataacaaagtagcaatatataaaaacaatctagggatgctctgcaacattaaaatcaatcacatattcagcaatctgcatctgccaatacaaaacaatcaaaattaattttcatacgcaatatgtagggcaccatgatatgcaagatccttcttaaaacaattttcttggagttcccatgcttctaaaaattgtagatgagcagttgacttatatgctagtgttttgattttgagtaaatttcccagaactacaggtattttgaccaaactatcgcgaaactatagatttaaggtgttctgtcacaaaactacatatttagcacaaaatttatcacaaaactacagatttaaggttaacatcacaaaactgaatatttaatattgaagttatcacaaaactacagcttttagagtttaaatccctagaaccgttgttatgttggagctatacacattattattttgttcctaaattggttctaagcctatagttttatgataatttagttactaaacatgtagttttgtgacacttcattttaaatgtgtagttttgtgataaatttggtattaaatgtgtagttttcttttgtttttgaagctgaataatgtgaaattgcttaaaagttataaatagcctggtcaggaaccaaagcttcagaatcccactcttgcaatccaactagacagaagtaacaagaaaaacaatcagctaaatttttggccaactttacaggtacacatataatctgtttaaaatgcctcttgaattacaattcaataatcccaaccaattttactgacagattgattgctagagat

SEQ ID NO: 302 - DNA, 5742 bp, Oryza sativa
tgttcagttatgtccggattcaatccgagccgggaataacaagtatagtaaaaaatttatgtatatacaataagagaccgggatttattctgggtcaggaacaaatttacttatgatagggataataagagaccgggaatcaatccactggttaagaggtgttgaactaattcgaatgttttgttgtccctatcatgtaaattggtttccggcccggaataaattccggtctctcattgtatctattataaattttttattatacttgtcattccagtccggattaaatccgggtgtaaccgaataaggcttgaaggagttggtttccatcagttttcagagatgagggaaggaggtgttacacctaattttgcggtttgagactttgaggggatacattattttcgggagcaagacatgaggagctcaaatcagttcctttccgaacacagcacacccctccttgacatgggccggcccaaggcccagcacctgtatctggttacggtatactaagtctgcagttaagtaattaattaattatggtatgtgatacttttctcaatacgtaataatgttcactttgatgttattttcatccatactatttttagataaagttaccaaaaattttaactaccttaagtttattgccaaattttagcaagtaattatgaaatcttgccaaattttggcaaccttgccaaaattttgacaacttagctaaaatttggtaatgccaaaacttgataaggttaaaaatggtagcaaagtgaacaagcccgaaatggtgtgttaaccacttcggttaattaatttcagtactcagttcattaaattaattaaagaaaggccgaatccctagaggtggggaacgggtgggcccgcgcaaacgccacgaggaagaaagagagagaaaaggttagcaactttcacgggacaaaaaccagcagactagtcagatatacatatactcctcctcaacaaaacaaaacaaaaaacgcgagaagagagagagagaagcttttaattcgaattctctctctcatcacggcttcttctgcttctccttctcctcccccctcatccctcctccgccggtagccgccggccgggagcgagcagcgagcgagaccggagcccgccggagccggtctcgctcccccctcctcccttgttcgcgccacccccgaggtacatcccgccgatctctctctttctctctctcgttggtctgctctgtgattttttttttttttgccaaggctgttctttatttggcacagagattgttttttttttccttctttgcgggtgtccggttcgagtccacggggtttgactctgccggaaatggttcgaatgcggcggccggagggcggaggaggggttttggggggcgttcttggtgggttggtttgcgccgagtctttgttaatttgttagggttcttgatctgatgcggcttctcgttgccgggatgcgcttgcctcatggctgaattcaaacaggccggtctctctctccctccctctctcccgtcagccgtgtgctttgaccgagtaagtttttgaacttcgattggttgagctgggggttcttgactttttcttactccacgaatgttcctttttgcacaatggggctactaatgaatggaaagctagagatggtgtgcctaatggtgatgtgccgtcattgtgttagctcggatttgtactgcgaatttgcgagctcacatgctcagctgatgatgtgttgatccagggagtatatataattggttggtagagtacttgctagattgtgctcacgggtctcatttcaaagttcagtatgaaatcttggttgtaaagtagtactagtgttttgttaatcgttagggagtacttctcctgcatttttcttaattttttccctttaaaaactgtaggtggatttgttattagtaaagctgatttgtgccaaatagaaattctgttttatccgcagtaaggtactgtaaacagtacttgcaggcactagggtttattggcaaggttttctatgttacattttaataaatgccacctttttcttcgtcaaaagaagccacggttataaagaaaaagtgaagcattaattgatgtaaatgcacgaactacaaatttccacaaatataaaccttttaataaaatccacaaatgaaagaaaaatgcagttcacacaccaatctctttctcaaaatttacacttttcttataacaggtatgctaaattttcttaatacaaagcatatacaaaacatcacaagcactatagacattcatgacatatctgttgcataggacaatatgcagtatgaagacctggctggtcaaaacttccgatgcacatgtgaggccctatccatgtgctttcttgatttctgctcctttatggccctatctccttcaaagcccttaaacacttcaacagtgtccaatcatactatgagactgtatggatatgggcatatggctatacttttgatgaggcaatgattttttttgttaataatagtgttaataggaagtgttgaattggttttttaaaaggaagtatttaagcattgaatttgtcatttattttgactcactaataacacagatagttctctttcctagcaggaccccttacaatatctagtgtatttatggcctcagttacttatattgatgactccggttctgaggtaattgatcctccaaagactgaggtgctggatgttaccgaacttgctggtgatcctgttccgcattcaccaaaaccaaatgtggtagtttctagcagtgtgcgtgaactgcttgaatgtccagtctgcctgagcgcaatgtatcctcccattcatcaggtgcacatataccacttattgaatcttttttgcacttaaaaaggatattttcttgtatggaagtcacttgggaaacaaaatgcgtgtttcatttaattgcattgcttttactatcttgaatcctgctatcatatttgtagtctggcctgatctatttgaacttatctagatgatttcctggtttaaaacggtcgttctgagctgctttttcacatatgttctgttccactaccaaattgttacccatgtatttaagcaccaaaaaagaagttagctaagatagtatgtacaatatgcacattgttgtactatgttgtaagttgtaaccccaactctttttctgctaatgcagtgctctaatggtcatacattgtgctctggatgcaaaccaagggttcacaatcgctgtccaacttgtaggcatgaactgggtaatattagatgtcttgctctcgagaaggtggctgcgtcgcttgaacttccatgcaagtaccagaacttcgggtgtgtaggcatttatccttactactgcaagctgaagcatgagtcacagtgccaatataggccttatagctgtccatatgctggatctgaatgcacagttgctggtgacattccatacttggtgaatcacttgaaagatgaccacaaggttgacatgcataatggctgcaccttcaaccatcgctatgtcaagtcgaatcctcatgaagttgagaatgccacctggatgcttacggtatcccctcgttaactccaccatgttagttattgtgaagtatatcactgatgtttacttatgcaaagattggttcacttgtctgctaagatagtccatatttctgtactgagttttatgagcctttctgtaaaaataaacattggttcacttgtacagtatgattgcactctgtacttttcatgtcaactgaggatgctgatcatgcagcatagttattggtctaaaataatctctcacctatgaagaaactatgcatcagaatatccatctgcttccatttccaaaaaaaaaaaaaaaaactttgtctgctttacagcacaataatagcatttggacagggctcttgatctgcaaccttttcttgctgctttctaagtgcaatataaaattaagaatttccttctaatctgttcttttccattgaacaaaatggactaagtaactataatgcttccatctaggttttcagctgctttggccagtacttctgcctacatttcgaagcatttcagctggggatggcacctgtgtacatcgccttcctgaggttcatgggtgatgacttggaagcaaagaactacagctacagcctggaggtaggaggcactggccgcaaaatgatctggcaaggggttccccggagcatcagagacagccatcggaaggtccgggatagctatgatgggcttatcatccaacggaacatggccttgttcttctctggtggagaaaggaaggagctcaaattgcgggtcactgggagaatttggaaggaacagtgaaaataaaatgtgaaatgatctgttcatcgttcttaacccttgcatgaacctatgtatcatcacagtgcgagaattatagccattcataggcagtgactctaaaatgaagacttgtaatgttattagcttgttttagctaccatcttctgttagattggtgcctgtggatgactagatgacagtcatgtagaccagagtggcactattgtagaattcctggcaaacttctctttgccttgaactgcttgttgagttgccattctgtggtatagggaaatctaatggcaattcatgagatgaatgtgttgaactctttttcatgtttccagcatatttctagcttctttgttcattctttcagcatatctctagcttgtttgttcattctttcagcatatttctagctatgttaaggcatgatctgaaagttcttaagaatcggatatgctgtaacaaatcatggtgaaatgtcatgtagcatgtaccatttccttttatcttaaatgctgcttttgaattggagggtgaataccagaatgattttgtaagctttttccgaataaagtttcaacttggtgtgcaagattaaatcggggttgagcacccagagtaaatattagtagaagataaaatgaagtgctgattttttttcttaaagaaaaaacaagagttgaagcgctagaatcaataatttgatctgcatcatgtccggagtagtactgtttgtacgctataggagcaataatgttgtgcccgtacgttactgccttcccttcaattgtctgcacctctgcacccgtcgtactactgtgtcgtggacgtggcaccttatctgaaggatttcacaaaatttgctcatggaagtaagggttaagggagtagtttgctttgatgcccagatcaactctaccaaaatttggtattgttaactcaataagtgtttttgatttttttttctttgccccatttttgcaagaggaagtttctagaataaccaaattttgttaatagaggctgttttgggcaatatttggattggctttggtagagtttgttttagcaacaaaccaaaacaaacgctaaaatcacacaagtgacgccaatttgggctcacatgcatcatcgtgattcatatgtcagcgttgcaatagcctgctaattacagtcgtgaatcatgtacatcatatttgatgagagaaacaataagtatggttcattgtacactaatttcgttaggtttaaatcctattaggttttgtacacactagaaatcggatagacacatgtacaatctctactgttctagttatcttgaatgatacctcatctatgccttcgcacaaagc

SEQ ID NO: 303 - DNA, 2950 bp, Oryza sativa; identical to SEQ ID NO: 221

SEQ ID NO: 304 - DNA, 2987 bp, Oryza sativa; identical to SEQ ID NO: 222

SEQ ID NO: 305 - DNA, 3026 bp, Oryza sativa
ttaagcatgacattgacccatcgaatatttgcatatcttggtcttccagattgcatgatttttccttcatatgtgactggaaacagtggggccatgctaggttacataaattcctgggcgtgatacactgcgaatagtagctatcatgtttactactgtcgtgttgagactactgtacagtagctcgtatgtatttctcgtatgtttgtgcataagtgaggggtcgatgagagtgacttactagacttttctcatcctaaattcctaataactagaaaagatgaccgaaattgggaaggcgacttgtgcctcttttggaatgatcgaaatatagaggaactttcatgttgacctgattcttacgaaaatcatgtaaaactcgtgttcgttgtcaaaaggcccaacttcatctcagatgagcataagtataccatattaatgcttcaaaatggttaatgctagctcgtttttactgcacaactaatgctcgatgtccaaatatacttgggttattattatttttttgaaggatttttcatgtgagtctcgccgaggtccactaaccggtacacaggcgccgacctctggcacattattttacacgagaaatttaaggtaggcatgaaatcatcagtcgcacggatgcaaacgtgacgacatcatcagaaacaatatactgctgcgccgatttaaactacacttaaattaaataattctattagtggtacgagagtagtactactcctgtatgtagaatagatgtgcacgggcgcacgtgtttcatccctctaattctgaatccccacgtgacgatcgagcttaaagccgaacgggcggggcggggggataaagcgggtcccccagccgctgtctccagttcacacccacaacccgaagtcgatcgctcgtgttcgtgtccgcctcgacggcgaactcgacgggtcccgacccgcaaacccaacacccacacctacttatacccacctccactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaacccggcttctacatcccgaagaatgtacacagccaatcctactaaatatatataagcacctcttgtttgtttagaaaaaatgagattaagggaaaatattctctttttgctgtctcacgatcaaattttgaattttgatgaattactggatcatcctaagcatattaatatattagctaaaaaatacttgcatccctgtgcattgaaattggtgtcacacgagtaataaacacaaaaccatccattttggttttacatttgttttatttgaataaaatgtttgtcgaaatgtttatattgttacaaaattaaaatcctaaaaatactttgacagtagatggatagcaaaggtatccacacatacacacataaagttcagacaagcgtcagccttagctagctagggaaaagagtaaaaaagggcaacaaaatattttctcaatagacaaacgtgtgaatcaattaatttgcagatatttggctaataactttttgaatatcttgagtggacatcctctaattatcattatataccctaaataccatataattagtttcaaatcaaaattttctccaaacatgtggcactttttatataacgtacatatatataatatctatgatcaaggggtgaactcataaatttgttgcacccgtgacatatatagtactgtacatgtacacggatcgtgcttaagagacatatatgcatgatgtcatcttctatcgagaaacaatctaacacacagtaggtcgttttgccaaaaatcttttggccaatctaacctcaaagtaacacggtcaatctgcaccttagagcaagtttaatagtatagccaaatgttaactccaaatcatctataactaatctaatagcccattcatacaatagttacctataaaaatatactccctccgtttcaaaatgtttgacaccgttgattttttagtacgtgtttcaccattcgttttattcaaaaaatttaagtaattatttattcttttcatatcatttgattcattgttaaatatagtttcatgtacacatatagttttacatatttcacaattttttttgaataagacgaacggtcaaacatgtgctaaaaagtcagtggtgtcaaacattttgaaatggagggagtactacagtattaatacccggccggtcccatctctcatatacacagaa

SEQ ID NO: 306 - DNA, 3319 bp, Oryza sativa
ccacattgctacactgaacatgcttaatcagcaaaagaaaacctgtagcaccgcacgatatccacaaaatccatcgaactaattaaacaaatatacacggacaggaacggctcaacaattcaacggatcactgatgaaaggattgatgctctagctgctacacatggccaaatggtctttctttacaacagcagctagcggaggagtgttgtttgtgtgtagtgtttgtgtggatggaaatggagctactagtcctacatggataaactccgcacgtcagtcgccctggtggtcgtcgctgcatgcgctttctgcactttttttctgaactttttgcttacaaaaccttgcgctttttgcccttttccccgacgagttgggcggttatggcgagggttgggtttctggacgcaagttggcagcggtgtagcacgcaggattgattgcacgttcgttgcagcattgagaatctgctggctttcgcataccagcggccggacgtgtacgacgccggttttgggctcgagaccaaaaacgggtggtggcgtccttgcctctattgggctctgacgaatgctatgtttatccggatgaggtagttagcctactagtagtagaagaatatttgtttccgttttaaggcttattgtttgattaatcgccgatcgagattgtcatagtggagtgctactctacgagttgatgatgggccgaccaacgagaattgcttactccctcaatactaaaaaagaataaaactatttttacacctttcgaccaagcataactttttttatttaatttattcaattattttttttcttcttaataaactaatcataactattttttatttaatttattaattttcttctaaagcaaccataacattttacatccactttcttgatccacatgaaaatattatgctgatatgttttttctttagaaacatagtataaatacaggcgctcacagagaatctattacgctcacttggttctgtgctggcatgttgaccttcattttctgtgaaactctggatgcagaaacatttattcagtttaaggttgcccattccattccagagcgagtgcgacctgtgcacgccgtgaccaccaatcaggatagacttccttccacggctgcacctctcgcccactggaccaaaccaaaccaaaaccattgccacccccacaaccttccacgtctcgtcacaagccgcttacaaatactcgcgttccaaaccaccatttcccaccacaaacacctccatcaccatcaccacggcaccaccacctccaaattccaatgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcgggagtcatcatcgtccgtgttcccactcgccatcgacgtcgtcgccgaggacgccatgtccgccacgtccgagccgtccgccgcgagcgacgacgacgccgtcaccagcagcagcagcacgaccgacgccgacgaggaggcatcaccgttcgagctggacgtggtgagcgacatgggctggagcctgtactacgcgagcttagcggagggcctcctcatggagccgccggcttccggcgcatcgtccgacgacgacgacgacgccatcgtcgactcaagcgacatcgctgacgtgtctctgtggagctactagcattgaagcagacgcgcgtcatgctcttgtacataaaagagtgacttcctaattaacagcagctgagcatgtatggccttgtatatagggtttttttttttttgatcgctgtacatttttcctacctctggaatctttgattcctatgtacggtttcctcatttcggcatgttttgagtgattgagagtgaaattataaaaaaatgtcatgcataatcaaagactagggaggaccaaaatattgcaaatgaacattgtttgtgtgtcgctacgtttcattaatagtgtagaaagccaaagttatgttttaccccgaaacggctaaaattcaccaccggtttttaactcaaatcccttaatttcaactcaaatcagggggccgttccagggttccatatttcaggctgaaaggcattgtttcggctagaataatatttttttcagttaagcaaaatttgatcatattcaactttgtttttctagtttttgttttttttttttgaaatttcaattctacccgatcccctcgaaatgttttttatttatatccctagatggttccaacgacataaaaggtaagaacataatttttattttttttatttgaaatttaaaactagaattattttgacgggatgccagcatgaacagtaaccggatgtatcgataagcagcatgaacggtcaagatcgtcttggatctgtctaggatttcccttatcattttcggcacggttaccgaaactccatagtaatatagttatcacgataaccacgagacatatcgtggttttaaaaactataaaacgattttgtaaaccctggatccatctgttgcagggtcctaagtgtgcgtgcacttcaccacacacgcacccaaaatactcttccgcttgggttgattagttcctaacaatatcaaaccaaaacgtcatttcgtgagaaatcgatggacttcgatcacagctaatacccgtgtacagtggcgaatctagaatataaattgagggggtgctagagcaaattagagatatgtcaactcgagaaatatttttgatgaaacccaaatatgcataagatcaacagaaaacacattgtttgctccattttaatttccagttacattaatatgcatctacaaaatgtatgaacaaattagtattttgtactgagagagtgtaagagtgcattatatatttgcaactttaatcaccaaactcttcagctaacatcctggcattctttacgtgcgg

SEQ ID NO: 307 - DNA, 6851 bp, Oryza sativa
accgaactgccgccacgtagatcagcggccatggtatacacatcaacgctcaacgcaacaaccaggtcaaacgctatatcaacagtccaatttgcaccctccgtattattaggcataactaaaatttaaaattttaaaacctatttttgtgtttatttgattatttatttatcgtagtttattttttatcatttgatttttaagtcatcagtacacacaatatataaatgttgtacacataagttcttttcttgataatgtgttcgctaccagggatgggaactttgcatagtgcgtacggaaaacggggcggcctattagcacgtaattaattaagtatttgctattttttttaaaaaaatagattaatttgattttttaagcaactttcgtatataaactttttgcaaaaaaacacaccatttagcagtttgaaaaacgtgcatataaaaacgagagagatgagatgagaaaaatggcatccgaacacaccctatagtcttataatcaactgtagacgaacgaaacgtaatgattttccctgttacacggaaaatatacaacaccacagatacctattatacgcgcacacagtcacaaaagtatacccttttacacacactcatttttcttttttaaaaaaagaacatactcccttcgttctaaatataagagcttatctagattcataatactgtaaaatgttcaattttagatttaactgcgatgcattcgaagttggaatttttcaaggatgaatcgacagaccatccatccaagttgtaagttgtatatagttcatgaaaaaaattaaaaatttatgtgtagaaaagttttgaatgtgatatgatgtgatgaaaagttaaaagtttgggtaattgaggtgtactaaacacgagcagccgtaagtttcaaaaatttccggcaggagaattcgtaatgaaattcgattatcgaaacggggacgtgttgtcaccgacacgaggacgcgaacgcgagagggagatgccgtgacaggacgcggttgcgggtgcccgtggcacaactcgtgtgttgacccgcctcgcgctcgcctgccaccaccgccaccgccagcgagctggatgagccagcagccgcccccgcccgcggttgcttcccctccccaccacgtcaaaacccaaccccaaccatgatgctcctgcgccaccaccaccacccccacagcggcgccgccaccaccagcagcagctgcagcggcggcggcggctgttagagaggagggcacacaccaccaccgacaccgacacgctcgccatgccaccaagcgaggcggcggcgtgaggcgacgcagatctgaacggaggaggaataggaagaagggaggaggaggggagggagaggagttggaagagttggaggaggaggagatctctttcttgttcccgctcgatggagcggggggaggggaggaggggagattgctccgtgcaagtgaggtgagctgggattttcttgacttgttttttttattctttttttctctcgtgatgaatctctgagcattgctgagagcggcgctgcttgtggttgttgtggagtagttgcggcatggaatcgatgcatgcttgtgtgcttactttttatcggtagtaattcttgttatgaacatgttgaaagtagagtaaggctatctgtttgtccgtctaattcgtttgaagaatgtttttgtttccctttcgtcaagtttattattagttgggaattatagctggatgagatttcaggacggcgtctagtagctttcatgtgttaaatcgggtggaatagtgacacccttgaaattgaaattgagtgggaaatcttctgtgttcttggcggtgcacgtgctgttgcttgtggaatgccatcgtggcgcaacatgaaaaagaaaagaagtattttattcttagggccgcttaccgttgattgctgatagcctccttgatttttggacaaatgaaaaggattccgcttttggtttgttgtttttcataatttcaattgcatgctgtttcgatttgtgtcttgcaatgttcagctttgtggaattattgagttacctcattgggtcaggaagaagagaacgcgaaggaaaagcgatggccctgattcaatcgctgaaaccatcaagtggtggaaggagcaaaaccagaagctccaggaggagaatagctccaggaaagcgccagccaaggggtccaagaaagggtgcatggctgggaaaggaggtccggaaaattcaaattgtgcttaccgcggtgtcaggcaacggacatggggtaagtgggtggctgagatccgtgaaccaaaccgtggaaggcgcctatggctaggatcatttcctactgcgctggaggctgcgcatgcatacgatgaggcggcaagggcaatgtatggtcccacagcacgtgtcaattttgcagataattccacagatgccaactctggctgcacatcagcaccttcattgatgatgtctaatgggccggccactataccttctgatgagaaggatgagctggaatctcctcctttcatcgtggctaatgggccagctgtgttgtatcagcctgataagaaggatgtgttggaacgtgtagtccctgaggtgcaggatgttaaaacagaagggagcaatggcttgaaacgtgtttgtcaggagcggaagaatatggaggtatgtgaatcagaagggatcgttttacacaaagaagtgaacataagttatgattatttcaatgtccatgaagttgttgagatgataattgttgaattaagtgctgatcagaaaacggaagtacatgaagagtaccaagagggagatgatgggtttagccttttctcctattagagtagtagtcatgctgcgggtcaataggaatatttcattctagctgctaggggatacttcaaatatctgcaacctgaagctttgtagtcatttacggttttcgtcttactgggtaatagctttatatatactataagccaactggtacaagaagttgtactgtgtgttgagtgcactgtggtaaaaatgaatctatatttaatgagcttactctgtcaatatttttgcttattttagtgtggttaaactcaggttagatattcaaaacgagtggcagatacttcaaagactttaggatcgaattaaattctcaaacaggtatattaggaagtttatttctgcatgcataaaagtatgacaaactatgatagtacaaatttgcatgcatatggaattttaaatacttaaacatactactatcgcattatagcgctctatggtcattcaaagtaccaaaagatacatcatggagatttcataaggggaagttgcagacattctctgaattcaagcctccttgtttcactgtgaaaggtcttctgtttgttaggccagtaggtcagccaaatccagcctctaatctcccagtccatggtcttccctaatgctgcaccacagatcttccaccagacgctgtctccatattcatcacgtgcgaaaatgacaccacccttcttcgtgaatgggcgatacacggtcgagtacctgtcacgaaaccaggcccgtggctgaagcagggagagcttggaaggctttgaagaataaacctcccttccgtttacaccatcatggagaaaccagttcaaggttgtagtgtttccatgcacagactgttcaaatttccagggtttcatggtcagtgtgaggctttcgctgaccgatgcctttagtccaaatgtgtttggggggtcgaatgaaccttcaatgcccttctcaaggccaaactcatgcgtggggttgtcggaggacttgctgactgaaaccgacaggacatctgattgttgcataggtgtgatttgcagcataacacgtgatggaaagtgcttctcctcagagccatgtccacgttcagtcatgaggatctcggagaccaaagagtccacatcacacctgagatgaatccactgtaagtgccgctcttggttttagatgatacacgtatggttgttttttttccttgtgcagttaattgtaactttgaaacaattcagtttgtagatagactgcttttcaaggtctagaaaactctgatttaactacctaaattgagttcttctgcagctggtatacagggagaagcatgttaccgaactatgcataattgcttgctcaatgttaccttactgtaggcaccaaccaaattatttgctagttaaacctttagctttttttaccaaacatatgcagctacgctttgcatgccgcaaacttaattggttcccccgagtgatactactgtcacctcaggatgagtaggttttttattttcacctaaattagtaagtgtgtatacagttcatatgagatagaatcaaatccttgaataaattactgaccttatgttgtccacctttatctcgacatcaatccagttgtcccttctgattgttttgtaggcgagctgaatcacaccttcaagttgctgataagtaagcgagaagagaaggcgctcatcctgtgttggcactgcaggatcttccatgctcatggcaatgagtgggcagtatagctggaccttccagagcccacttgctgaaagagcatatgagaacagtggcgatggcaccccaaatgaatggtgtgaggatcgttgctcaacaatccagttagtcactgcaagattcattgtctgcatccattgctcctcaaggtttgctcccaacattctgacaaaggtctttgcagcatctttgcactttggcccagtcagctgagtcctcagggattcgaggcatcgacagcgaagagcatggggagcctcatagatgcaaactaggaaggccagggacaagaaaactatgttaaacacgtcctttagattgccatgaatctgtgccctgggaaactgaaaggacagctttttgtttggtccggatctcagcacccagtccacaatgtcaacaaacaactctaacatctcttgttcgtctagagactgctgggtgtatgatttcaggtggactggttttgacgtccacagagaaattggcacacggtaatttgcaaagatggagaaggtgacaaaggagggctgggtgggaggggttttgacaactgataggttcaccgatggctgtgatgattctgatgctgatggtgtggggcagatgcaaagggacatggcgttggagcgccattgggagaacggaggcaggttggtgatccaaccccatacatcaagaggtaagctgtgagccattacgttgttgaaaacttgagcttgttttgcaatgtgggagtatcccagtattggtgtggttttatagatggaagagatgatggttcctcagataaaattttggctcatccatgactgagtctaatgaagcacggcataatttttggtaaagcggattcttggttgttagaagaggaaatcaagtcattgagctgaggaatctttgttgttaattggagtttgaagaatcttcatttgtgctttgcacaggtgctaaagccaaaagttaactgctatacggtaatatgatatatcaaacccaagttggttggctaatgttgtagtgaagagaatataacgtggctctaaacaggaaagctggaaagaacgatatggttgggtggaatggattagtttggatggattctggataactcggttcaataagggcctaacgacaccaaatttgtgacttgaaggttagcttgtgtgtcgactgggaattggaacctgatgcatctcactctttgcttccgttccgtcaagcttcaagatttacctctcaatcgagtattgctttatacttgtctcagttgtctgatcttattgagaattgtaggatccaagctcgtgcatctcggagccagcatttggcaacaggaaaaatggctctaatgaacccagaaatgcagaaaagcggttcgcgtcatggtcctgtttctttcagcttgggattattataatccagattattaggagtaagctgaaagaatcagacaacttattgaagtagcttattataatctggagcccagcttattataatccgataagctcatttaggtgagctttttctagattattgggtgaaaaattacccaccatatgccaccccactccctcattatacttgcaaactcaataatctaggctctaataatctaggaaagaaacaactatcagcttattctactatagattataacaatctagtttatagtaatctgactcaataatctagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcag

SEQ ID NO: 308 - DNA, 5320 bp, Oryza sativa
acaattgccgtattgaaattgtaaaagatagaagtagaataaaaattaacttcaatccaaacaagctttactactctccacattaggtacccaaagtcgcaccatgaggactaacgtggaaaggcagctttgaaaaatattgccaatttgtaactttttttagtccaaaaatgttgactttcttagaaacttatgtggcaagtttattccggtttgtattccctcgaaaggaaatttccataagaaaaaacgaaactacttcctccatttcaggttataagatattttaactttggtcaaagtcaaactgctttaagtttgaccaagtttgtaaaaaaaagtagtaatatttttaacccaagacaaatttattatgaaaatatattcaattattaatttgatgaaactaatttagtattataaatattactatacgagaaaaatgtcagtgcgttgcaacgggtgaaagatattttaatcttattattgttgtacggtttagataaggtgaaattcactatgggaattcgcttggatattctttttataaaatcatgagccgcaattaagggtctaataatctcaagttagcatgcaagttttgtaaagagatttcttatacgactccttctgtatttctaaaaagaagaaaattaaaaactgactcaaacacggatctatatttccaaaagtgattgaacttaaaaatcgattcaaacacggatgacgtaccaaaagtaccgacaaaagcatctccaatttttataatagtagagatttaataataaacttagttaaacttaaaacagtttaaaaacattaattaaacgagtccaccaaaaaagcgaagcttctcccccaccgcacggcttacgtcacggtgaggcgtgccactgacatctaggccccacgcggagatattttcccgacccggccggatcacgaagggtccggaactcgcctataaatacccacccccaccactagatctcgcctttccttccgatctctctccctctctctcttcttcttcttcttccttccctctcaacccgacgacccacgcgaagcgaactctcgcgcgagacgagagtagtaaaccctagaaacctagaggagatccccaccaccaccatgacggtggatcagaggacgacggcgaaggcgatcatgccgccggtggagatgccgcccgtccagcccggaaggtgagatcttgctctccaacatcccttcactttcccctctctcttgtggttacttttagggggtggggtggttcgagtttgggcgggagttaggggttgggggttcgctcgattcgttggtggatcgagcgattttgggtgtatgggttgtggattttaggttggattggttgtatttgggcggggttgggtgctagggttggtggaatttggggggctagggtttcaggatctggttattttgcctgaatatgaattgggggtgaagggtgcagggttggattgtggggggtgaccgtgcggtgtagggatcatggaagatgttggggattttgttgggttgaaagctgggacagggtgggcgattgggggaggtgggatctctggatccccttttaattgggcggcagtgctttgctggagtccaaatcaatcgttgtgaattccatagctaatgtttgtagttgtatatattataggtaaattgagtgttttgggttcgaacccctttgcaagtttcggttttttcccctactgtgggtgactttggtagtagtattgtttcaatggtgtgattacctgttgattttgtgtgagactgttcgaattacttgttgtttagagtcttgagtagcaaagttatactactatggttctagtcagcaccatctccacagaaacgtgtcgtatgccccgagtcatctaacttaatgtcattctttgttgctgtacactgctgttatatttttgtaatttttgtcagtttaacttcgtaatacagtctctgatacatgtatgtctatttgtcttgtcttttggtaattagaaaatgtggaggcgaggaaagtactggaaaccttgattccgtccaaccgataggtatgactgctttgatttgaacacctttcgtaaacaggaagtactgattgagatgggtcccttgtgtccagcagtgaagtgtgagcacaaaataactgcttgtgtttcagcaggagctcttccctgtaatgagcatgcactcttggcccagcagacccccaagggagatgcgccatcagtgggctctaagatttggtgtgtttaaccgttctgatatgtctggcttgctcaatttgttggagcatgcgggctatgactaccaggcttaactggttttttagtatagagctgcacgaaagtattttttttccttgtcttttcaccagctggtttctgatcagctggtttaagcatattcggtttctctcttgatttgatcctgttcagctgttacattgtgtgaaatggaagaaacaataactgagtaggtccagtgaataaaataagcatcagtgcttttgagatgttacgagtatttttctaaacaattagctcgagcttgattgattgagtgaaatagtacatctatgtgcgtgttgcttgtatgaacttaaggaattgttcgcagaattcattgaaatgaataactggcaaattagagtttagttatcaagcgtgattatcatcataatagtacctgtttctgtggatatggtctgtttgtaggaacatatgaaagcatatgtgtttgtggagaacagttgatggcactggggttattgaacgcgtttagttcatgtttctgtggagatggtctaccttgtgggaaacattcattgttctgttctgctatgtccttttcccttggttatgtggatattttccctgaatctgtagaacaattactaaagttaagctccttgtttagcaggaaaaagcgaccacggagatcacgcgatggacctacttcagttgcagagaccatcaagcggtgggccgagctcaacaatcagcaggagcttgatccacagggtccaaagaaggcaaggaaggcacctgcaaagggttcaaagaagggctgcatgaaggggaaaggaggaccggagaatacacgttgtgacttccgtggtgtgaggcaacgtacctggggcaagtgggttgctgaaattcgggagccgaatcagcaaagtagactctggttggggaccttcccaactgccgaagctgcagcttgtgcttatgacgaggcagccagagcaatgtatggtccaatggctcgcactaattttggccagcatcatgcccctgctgcttccgttcaggttgcactagcagctgtcaaatgtgctttacctggtggtggcttaacagcaagcaagtctagaacatccactcagggtgcatcagcagatgttcaagatgttttaactggtggcttatcagcatgcgagtccactacaacaacaattaataatcaatctgatgtcgtctctaccttacataagccagaagaggtttctgagatctctagtccactgagagctccaccagctgtcctggaagatggttctaatgaagacaaggctgaatcggttacctatgatgagaacattgtcagccagcagcgtgcccctcctgaagccgaggctagtaatggaagaggcgaggaggtctttgagcctctggaacctattgccagcctaccagaggaccaaggagattattgttttgatattgatgagatgctgagaatgatggaagctgaccctacgaacgagggtttgtggaaaggcgacaaagatggatcagacgccatcctggagcttggccaggatgaacctttctactacgaaggggttgatccaggcatgctggacaacttgctcaggtctgatgagccagcatggttattggcagatcctgcgatgttcatctccggtggcttcgaagatgactctcagttctttgagggcttgtgatttccccttggcggcagccggccatactaaaattttctggtgctttggtcggctagctcctgcacatcgccctcaggatcagcaagagaaacactggaccggattgggttcgttggtggaactggatgagcatctagtagctaaggaaaaaagatccttttatttagttctgtaggcaatggaactccttgagaactccgtttcagtgtttgttaatttgataacgcttgcttgtttgtgtgtgtatatcgatctcttttgaagcaatgagaaaaaaaaaaggactgaagaaaatgtgtatatattccaagcgttcttcagcctttcttagccttcatattttacctatgcacgtgggatgttgcagttttagagcttgtgagccttctctaaaaccggggattaaaatgcgactaggcacgatatgttcaatctaaaccgaactccctagggtgtatttatttggtgttgtctttttttcattatcctaagattgcaagttacaaagacgaatacccgtcctagtaccaccgatatttgcgataccagttgcgacattttgagatgaagagatcaagagagtattttcgttgctgttagtatgtactatgttttataattgtacccctcgttatgctaattactgaagcctccgtagagagtaccgaacattccccatatttagcaagcgaccttttaagatgcttcataatttagcaagcgaccttaaggtacttgcaaaccgatcctaatagggaaacaaaaccatgctgactaagctgaacaaacgttgcagaagttaaccaagcaggcaggcagctccaatcgtatgcgcagtacggcagtagtgtgacgatgtgcgtctgtactcccgatagttgaactacgccaatattctttaaataaatgaaaaacaaattgaattaggtctttcttctacttttggccttcaccatcctaggttacacattgtacatacacactcacatgtgccaaccaagagaagacgggcaaaagttgtgaatgctaccacgctatgttgttatcagatcttcgggcgtatccactcgtctcctctgcaactgtctcccaaccctccacgatcttctcagcgtatgcagcctgtcagacacaggcaacagattatttcagttctcagctactcacagaaaaccaaggttttcaacatctgtgtcatgtgcaccaacatcataatgtgcaatctattcggagcagcacagatactggagtaccaaataacctatattttagttactttaagtgatgacccaatattgtagtcaccaagaaaat

SEQ ID NO: 309 - DNA, 6591 bp, Oryza sativa
taaaaaataaattttggctatgcacgaccaatcgacaaggaaacaacgaaagctgaaatgtatcatctctctttgagggttaaaagctagagcaacacaatgtggtatatgttctaaaaaacacacacaatgtggtatagtactagtattactttaggaggtttagagccatttgatttgcaatgaatggacaagattgatgtactacaggacccaattaaacgataaaattgctacggaaaatttccggaacaaacatgaaatcgctactacaaaatcactgttttgtacagtggtacaaaatctgtttgccctctgaattttcggtgttgtttagatcgatgccatttcaaaccatactatttttatgaagttgtcaaatatgtatatctattaaatttttaccgaactctgataaatacaaatcctaccaaaatttaataatattccctccttgccatatgatccgttaccatatgtaacatgtggtcacctcatacgtcatcatcggagaagattcacttatattaacaaaaatcacaatcattaaagccctcaaaattctaattaaactactgtactaatcacaccgaattagcagcccctccctaagccattcccaaccatctagaatgaaaaatcatgtggcaagtaaataaacgaggaaagagaagaaaatcatgtcttgaaatgttttctacacaatatccaagacatcatgtgactatgtgagataagtagcattaaatttaagtatgaaatagtgatatttgtattagaagagtagtgtctagtactaatttcttaatgacgtgaagtttatggaaactatattagtgttttggattgggaatgggatgcatcatcaacagcagcagcaaaagcagcgcgcacttcaacggggagagcccagctgacgtggcgtcatacagccactgacgtatgggccccaccccaccgtttttataacctcgccgcctcgcctccccctctctatcatcttctcgctcgcctctcgctgtctcgcactcgccgccgccgccgtcgccgcgcctctctcgccggcggggaggtgaggtgagtgagcccgattccgcggcctcgtgagccgagcccacgtattgtcgcgtcaattttccgctgatttttctttctttctttcttttttttgtgattctcaaggtttttcttaggtgtacggatttgatggcggtggcgtcgcggctcgcggtggcgcgggtggcgccggacgggggagcggcggggaggaggaggaggagggggcggccggtggtcgcggttccgacggcggggagggggcgaggtggggccgtggcggcgagcccaccgacggaggaggcggtgcagatgacggagccgctcaccaaggaggacctcgtggcctacctcgtctccgggtgcaagcccaaggagaactggaggtgaggagaggagattcccttgtgtttgttttttttttctttggtgaaattggatagcttgtcactgcttcactagtggtagtggtaggtagttttttcctctaaaaaaactagtggttggtagaatggttcgcatggagacatcattatcgtattgggttcgatggaaatgtggaattggagaatttcctattggcatatcctaacacgctgctttagctacgcaattgcagttttagttatagttataaatcgattgatttcgggctttctattgatgactgatgaactggtttatatggctctagtactctaatgttggataaacaaactgtttagccttatgcattgttaatgcaactgtttgatcatttttttattggtaattttagctgtgattgttattcctacctgatctgctagcaccattcgttgggcatgaaagtgctgctggtgcctgcattcagtttttgtgtcattggcaatgtcatcttttttgaaagaactttttcctttttgaaagaacattggcaatgtcatcttgtttgttcaatttactcccgctttgtttgatatggagtattccagtttgttattttgattatgccataaataaatttctgatttcacagaattggcacagaacatgagaagttcggttttgaagttgatacattgcgtcctataaagtacgatcagatccgtgacatcctgaatggacttgctgagaggtttgattgggacaagatagttgaagaaaataacgttatcggtctcaagcaggtagtattcttctgttatttccgctatgagaccaccttacatgacttagaccaacaattaatgtggactgccgtaattaattctaatggagaaacaaacaaaaaaatgacagtttgttctgacaattttagtttatcccttaactcaggctacttatatggttgcagggaaaacaaagcatttcactagaacctggcggtcagtttgaacttagtggtgctcctcttgaaacattacatcaaacttgtgctgaggtcaattcacatctttaccaggtaatgtgcagtgcatccctgtattaacttcttgctttatttgattttcacttatgatttgcgcattgccatgccatatatatcttcagtccgaaagtttttttgccagcagttgatccaatccgaaacgtctgttcttgtaggtcaaagcagttggagaggaaatggggattggatttctcggaattggttttcagccaaagtgggcactgagtgacataccaataatgcccaaggtagttttggccttagaccttgtaaagctttagcttttctatgaattcagtgttgcctacatatttaacttaacttacgagaagggttcctataaattttaatgcttcagattgtttctttatagggaaggtacgaaattatgaggaattacatgcctaaagttggctctcttgggcttgatatgatgttccgaacatgcactgttcaggtgattatatgttcatgtactaattttggaattccatcttaaagaaacttgcaaacttattgttacttctctaaacaactttacttgagtcatgaaggttaatcttgacttcagttcagagcaagatatgataaggaaattccgtactggtcttgcattacaacctgtgggtacttttgttatcttccctgatcatttactttaccccttgacatgaacctggtttattcatttaatggatcgttgccatttaacagattgcaacagcaatatttgctaattctcccttcaaagaaggaaaaccaaatgggtatcttagcttaagaaggtgattgctttattgcttttaaaagtacattgttttgttgtatgaagttgccaacaacatcattcatgatctgcagccatatttggactgatactgacaacaaccgctcagggatgcttccttttgtgttcgatgactcatttgggttagtatctataattcataccattcgaccctcttcccccacccagaacactggcaatgtgattgaaaacctcattttggccaaagatattttatacatgaaatgaaggtttccatgtaactgaaattctgattatagttcgtttctttgatgcagatttgagcgatatgtggactacgcattagatatcccgatgtattttgtctatcgtaataagaagtacattgactgtactggaatgtcatttcgggtctcttcctgtttctgttaccttagtgcttgtgctgttatatgcagtagagctttggctatagaatacagaacttggttattaactagactaactggatttatatttgttttgcaggattttatggtaggaaaactcccacaagctccgggggagctgcctactttgaatgactgggagaaccatctaacaacaatatttcctgaggtttgcccttcaatttgtatagcacgatcatcatggcatgttgacactgtatgcttaatgtaataactatttgttcttttgtatttggcttgcaggttaggctgaagcgatatctagagatgagaggtgctgatggtggcccatggaggagattgtgtgctttgccagtattttgggtttgttagcttactcctttgcacttcttttgtatttctgtacagtttgcagtgtggtcattggtgtcaagtagaagtaaacgcaaggagtttggacatgggtactgtagtaatgtatatcttccatgttctataggaagaattttgaaccagttttggaattggtatttgtatacaggttgggctgttgtatgatgaggaatcactgcaaagtatttcggacatgacctctgattggacaaatgaggaaagagaaatgctaaggcgaaaggtatcttgagttatttgtgctctctgtccctgccaagttatataatatactgttgatccataaataaacttttgttttgccttacaatcaccagtttaacagaattatataatcttttttgtcagaataatttgtaaattagcaaagtaacccaggttcggaagttacaacatgctactagagtcaccttggccttactgtatctaatttgattaggtacctgtaaccggtttgaagacacccttccgggatggatatgtaagagatctagctgaagaaattctgcagttgtctaaggttagtaactttcttgaatgtacattcttttataacacggagtgcatgcagattatagtaatgctcctttttttgttattccagaatggattagaaagaagagggtacaaggaagttggtttcttaagagaggttgatgcagtgatcagttcaggtgaagatttcaacattccagcatctcttttcattgatgaagatatcaacattttcatggttttgctgcgctctagataacaaatgaagaatttaactctgttttcagacaataattcgtagcctactttgttgcaggagtgaccccagctgagaggctgctcaatttgtacgagacgaagtggcaacgcagcgtcgatcctgtcttccaggagttgttatactgatgctgagaaacctcttacacagcaaaactggacagtctgtagatgtactcccccatacagaaaaaacctcatatccattctatttcatgcctcggcagctaatgtccgccatccgttcttcttgagcctgaagagggaaaaataaccgccgtgcagcaattcagcttcacggactcaattgtttctgcctcctggaacatttgaggtcggaagcctttgtaggtgctgtctttgttggggccttttacaacttccgatttccctcgtcaacagggagatgggacaaaccactgtttgtaccagaccctcttttgttcctgatgatttttgtatgaaaaataagcccatctggtgcatgatggaaactatatatatatatggttccagaaaatgttggaataagtatttgacaagcacgtggagtgagttccatccagctaaaagaaatatcttgcagatgtaatggctggtgtatttggtggtctccatgaaagtgcctttttattcggtacttatatgacttgactggttgtttcctgctgccttccttttggacctttctaccaatctatatatgctatcctgataggaactcaccctgtcattttgttatatgacaagtaatcagatattactgcatggttttccaagataagatggctcttcttattattccctgcgcctatgccccatcttttatttatttttcatcaacaagctggtgaatgatgttgcataaacgaaatttcgtcgtctcaagaacatgatcaagtttgtgcattgttaatgtataagcaaaaaacaaacgtgtgaggcgtgcatatgctctcttctgaccaagcccgtcttactgtcctgaaagcacgcacgccaccacccaccaccaacccttccccactcgcacctactccctatcacttacatgtgggacccacaagaaagaggaacatacgtgtgttgtgcatctcccatgcaaaacgggccaagatgtgcttaatcttatcgtagtgttttactggaaagaaatacgcttccaaaaaataagtgcgtgtaaagaaagataccaatgcaactagctaggcattaaagacaaaaaaaggataatgaaaagcacataatttctccatcgaagcttactatcagtagtgtctgtatcatccacggcatcttaaaaactagagtacacacggcaagtcggtaacactaactgctaactctcttataagtatcatgtattgtctgtagcgtccgagttaaatcttgcatatgtcgcatgtattctcttcttattaactcacaagtgacacatcaactatcagtggagaagataggaggggcgagcaggggtctcgtctcccctaagcccctacaactacactatatttgctctagtttttgtaaaattttaaaagataagtatcgttgatctctccgtcaaataaaatttagtgtttcttgtttcgccactttctcaaccatttgcctatagtagagtcgttgaactctgtcctagttgaagtattgggagctcttacatatgccccatatttcagccttattcatatcttcaaaatcctacacatcaatctggt

SEQ ID NO: 310 - DNA, 2936 bp, Oryza sativa
tagttaagttctcataatttgcagtaatatcatttttcagattcaagttcagcctctctccatactgtagtgctgttgatggagagtgaagatcatgggggtattccaatgaaatgttaattcagttctttttaatttttactgtacttccgttccgtgtatgaattgtcatggtaattttagccctcatttttgctttttttttgacatttttactgtacttggtctatgtgtggtcatgggcaattttaatcttcaatttgagctctaggctagaagaaatcctaacgccaccactaatctgaagcacgaaacaaatcaattaaagaagccataaatgataaatgaataatccttcatgcataaaaatatttagttatccataaagagacgacagacgtatgcaacgttcatattaattgtcactctacagtgtcaccgagttgtcggtccaagcaattttacccatacatgaaaaccatctgagaaagggcatgagagtagtactgcgtcaatacacatgcagttgcacacagtagctgagagagcgagccggaaacatctggtcgccggtccacgatcggtctacgcatgggcttccccccgaccaggtggtgcgtgcgagcctaccacatgtccacatgcatgcacggtgatcgacatcccgatcgacgtgtcgacagtgcagccaccccgccgctcgctcgctcgcgctcgcgcagtcgcgctagcacggacatacggagtagtatatgcgtatgcataggcacgcgcgcgcacgcgcatgcagcgaaccagagcgcgccgcgcacgggcggaggcatagcttgcgcacgtacgtgtcgcgctccggcggcctcgccacgacgcgtgtcgcggaggcgcgcgcgcgcaccgagccgtccgcgtcgccgcgcgacacgtacgttgccggcgccctgatcccgccgcggagcaccgccccgtccgtcgccgcctataagaaggacagcgcggccgcgtcgtccatccccatcagctcaagccgcagaagacatacacacacaaacacaagccacccttccgatttgttcatcgatcagttcgcagcgtacgtcaggctagctaactagtgtttggcaatggcgtccgggcagcagcagcagggcaggtcggagctggaccgcatggccagggagggccagaccgtcgtccccggcggcaccggcggcaagagcctcgaggcccaggagaacctcgccgagggtatgcaaaataatactgaaacttttgatagatcaaacttgccatttcattcggtatttcggttgaagtacgtaactaatatgcgtacgtgtgcatcgatcgatcagggcgcagccgcggggggcagacgaggaaggagcagatgggggaggaagggtaccgcgagatggggcgcaagggcggcctcagcaccggcgacgagtccggcggcgagcgcgccgcccgcgagggcatcgacatcgacgagtccaagtacaagaccaagtcctagactacacacacttttgcatccgtgaatgccagtgtgtcgtagtcgtctcagttgtagtcatcgagtcagtcttagctagctagctctcttatcaataataatgtaggtcttgacggatgcacgcatttaggcgcccgtatgatttgctatgttatgtttcatatggtgatgcgtgcttagctttagctagctttggtagtttggtttaggtgctgatcgatcatggtcagtagctagggtatgtgttttagtttattgcaggatcggtcaggcaggggctgaatgctagctaggtgatgctttggcttttcatggccagcagctgctagcttcttgtttccaactgatgcctctgctgggtgtgtcctttgtaaccgtgcttgctttcagttaatctagctagctgttgttcatccgaaagtgccagtgtctatgtctgatctatcgcggctaattgttgctgttgctagttgatctttgattcctcagagatgccatgtgcaggatggaattattagcgcaaaacacaggagaagggacaacaattttaagttgcctaatttttttcttaaaacacctgctggggcgtgcacacaaaaaaaaaatcaagtacctcgtctaaactgaatgctcaagtttgaaagtgaaaacaggacgtgccgtgccaagaacttcgagatatctccgagttctcttaagcttaatggaagataaacctgcctctttggctcaactcctgttcccggacgctgttagtaagtaagtagtaactggcgatcgatgaattggatgaagccaacagccgcgcagacacaagttagaagaacgccaccaccatatggttttcttagccaggctgaatggttgatcagaaactcagattacatgcaaaaagagaacctctggggctctccagttcacagagagcaaaacgagtgcaaaatgaacggacgagcagccatggaggaaacattaaaaatatttgaggactgaattctgaagacgagcaactgactaaattttttagcgtggtttgatttgtatttttttgtatcactgcgagatgcacagcaaacggagtaaacatttgtgtacattttcccctccggacacctatttaaatacgtactctgaattcaacaaccaaattaaatgcagcgcacaatgcatcaatattacttcaccttggtcagctttatgttcttcgcacctaaggtcacaaattgtttatgctctattacgaaattattacctgcctgtgctggattccataatttcataatcaaagacacaatttgatcgaagcagtgctcaagttttgcagcccactagcactgaaccccccacaggtgttactgacattattcatctacagtctgtctacacaccctacaacatcggcggcaaagtagcaaaacga

SEQ ID NO: 311 - DNA, 4844 bp, Oryza sativa
ttaaggagatatgggaagtagggtaatattaataaaaagatcacgcggaatgattttcataaatgattaaccatgaataatatttcgaggttattattactcgtagtactccctccttctaaaagtttaacacctatttcattctttggtttttccaaaagtctaagtcctatttgtagttattatgtactaaattaaattgttgataggaaaaaaaagtattttaatacttatttgttgcatgtttattggctttgtcatatgataaatgaattaattgtttcttgttcttggtgaaaaagaaataggacaatttttttttgaaggagggagtactacgtactactccctccattccaaattgatctacatattttataggtacactaagaccaagaaaagctaataactctctcatattacatttactctagcaacaaattcaatacatgcaccatcatcactattttctagtcaatagcaaatcgagatattgcatgtgggttataaatacttgtgtgcatggatgcatgcatcaatgtccatttactctaatgcacaaataacgaatagacttaatgaatgaacacaaatatgtagatcatttaagaataacccaaaaaaactatatatagatcaatttggaatggaggaagtatcagtttactcatgattacgctaattattccactcaattctcactttctcagtgccagcaatcaatgctagccagcctactccggcagtcgatgcattcaatattcaaggagtaaaacgcaaaaatgaataaactgaaggtgcaacattgtaaaatgaccttctccgaaggggcgaactgaaaaactccaaaggcagcacaaatctcgtccgtacctgccccgcttctacccaagcgccttccgctgcaagcatccactggctgacaggtgggccccaccacgtgcccctcctccacctcccgccatataaaaaccccaaagccccacccacccacgcttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagaggtatgggcgtcgctgggagcggcttgatttgtgtagtttacttgttcttcagggattgattgctgttgtaaatcgttagttctacggccgattgggaatttttttggggatcgaggacgctcggtggatggattgggaggaaaaaaaggggatagataattttaggggttgatcctgagagatcagatttggggtgatactcctgtttaattggtgatttagggtggaatgatgtgcctccatgtcttatttgtggtgatcagggcttcatgtgctgattctgtctgctaggattttagagatgccatttcagctcttgcactgttcgatcttttttttttctttttctaaattgcgcaatccatatgattacctttttctccaaggagttgaattcgcagtaaaggggaaattattctccgttctctttggaggtctccccatctgggttcttagttgttagatggatgaccctagtatcgcttgatgtggttgtatgattgcgagaggattgttccggacgtaattcaactattagtcgaagtaaaggatttttatgatgttgactgtcaagtcctacatgccttagcatatactcctggctgtttagtcgtcctggtgcctgtttttggttctatctttcggtcaatagcgtcaaatcatttttttgtggtctttgttggcctcttttgcttagacatactagttcattttatttatggggatgttacctcttgtgtaaattgtctaaatcggttgtatctagtcagtcgtgtgagctaaaccacagatctttgttgaagtgttgcaactcagttttggtgttccttgtttacaattaatgttgctgcagcatattgatgttagtccgtaaagcacaactttagactgcaattgcagaaatgatgaggtccattcatgggttttttttcctacaatcttgaatttcatgatttgagatatgctttcctaaaatttgaatgtttatacgcatggttgcatgttccaacttcatgtttgtgaccaaaagaaaataacatcagcaagagaagttcatctgtgtaatttcttgccattgatgttgaccttccattgcagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggtaaggattatcaatttgattttttctctctgaatatgcacgattttttacattgctctaattttgcttgtgtttttcaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgactatatatttatatattatatcttgttagattgcagccttgcagggttgttgctcttgctactgggcgcgtgccatccagaatcaggatttctggaaagatgcttcacttcctcttttcttgatgtgaataggcagtatgaccggccaggtataagctttgtgataacaagaggggtatttggcacatgttgtcactttttcttctcgagatatttttgttaagactatgactaattcagagcgaagacctacgagcttcgtgactgttagatattttttaagaagggcgaaatttcaatgaatgtttaactgcagcactattctagatgtctttggtccaagtcaaaatatccttgcatcacacttggatcatggtcaatgtcagtacagtctttacgagttgtggacttgtggtcccatgtcatggtggttggtcgtgatttgatgccgacatggttgcgcttgcgcatcgcattcttgatttgttacggctgggtcatgcccttttccttctctcgcatcattttttgctatcctcataaatcacatggcttcccctaaagacaaaaggattatcaaacgtggtggccactagtgttccatcaagggagcatcacaagccaaacactaccaccgtttgtctcccgttggccagggtcattgtgcgggacagagcgagacagctctacctaattacctaaagcttgttaagatttcaataggctgccgttgtatatgaacccttcaacaagtttagaaacttttgagtgagagagcttgtgcaatgcatgttccttcagctgcaccaactttgacttgcctctcttgaagctctaatctcacctaccttcgctagaaaactgaaaactgaggttagcatcgaactctgggtgcggcaggttaatcacaggatctaatctgatggttcgctcctaacacattctctgttaggttggctcctaatcgtattgtattaccttgta

SEQ ID NO: 312 - DNA, 5343 bp, Oryza sativa
aaaaatataaggaataatcacattgagatttgataatgtaagagtattttatttttcttcttgtttttatattggtatatacatgtgtaggacagattaaaaataaacttatttcaagacagagggaatatttgttaagtctatttaaacaaaaggcactgtctacacatctgttgacagaaaatcccacctcctatctttcaaattttggaccaatggatatgcttcaagattcgtgcagaccccttaaccctaacttctctcctcccccccatccagatcacgctgccaccgctactcccgtccctcgcgcgtgatcccccgccgccaccgccccatcgtgccgccgcccgccttgccggctggccgaagggcgccaacggcgccgacgaggccccccagccagcctctccctctccttcctcctcgaaccgtcggcgacgagatgcccccgccaccaacgccggcccaccgctgtcctccagccccgcggctccggcgcctcgccacccgcccgatctgccgtccaccgccgggctgtcgcctccccggccatccctctaagcccggcgaactcccccttctccctcctcccccttcccctcccacccttcccaccccacccctaggaccctaattcatcggcccttcattggagtttgggttgtcgtcggcgccggagaagaagaggagttcgtcggagttggagaagaggcagctggagcacgaatcgcgaagcacatccagtgaaccaaaaattgcaagatttggaggtaggttttctgtcgactgaagtgtagcaattccgtaaaaaaaaaccatttaatttatccctacgattaagtagataataataatacgaatgttgcacaagagataaaaaaagctctctcatcacatcatgggtacaataggggtgtggtcggatcaattccacccattcttttcattcatccccctccccccataattaatgagcccctccccctccctcgtacacatcacacgtttcgcctccctcctccgctcgtcttcttcattctctctccttcgcttcgcttccaaatcgcccgcaatttctcccccaaaaacctcccctccccccaccaccaccattaataaacccctcctcctcctcctcttcttcctcctccgcctcgccatctcaccgccaccgcctcctcactcactcacttcctgccacgtcattcgcgccatcgatcgcgtcgtcgcctcagctgcctgtaagtggtgaggtgacgacctctgctgtctcctttcttgttctttgttcttcctccaatatcggatcgtctcgggttggggttggggttggctcggcgtggatcggtgtgttgttgttggtggcgacgtgtttcttcttcctcgttgaaagattggatttttttttttgggttggtattattgcggagatatttcgtgggtgggttcggtttgtttctatcttttttttttcttttttacctttccttttttttgtgggggtttgtggggggattttttctgggggttgtgattaatcagctgccaatctaatctggggggattgtgctgggtgtgaatacttgaattttggatggaaagttcttggattcttagctttcgcgtcctctgtttcctttcttgatctcctcttttttttcttttctttttctttttactttccttgatgatgaattcgaattcgcttgtgatgttgatcgatccgcttgtggtgatgatgctgggaggagcagagaggaagaggaggagtagagctcgtcgtctccgccgccgcagctggtgctcgctgttgatttatgtcgcctgctctacccccgtttctccatggttctgagctccagtcgccgccaacggtttcttcctgctcccttctcatcctcctccttcaaaattggtatacgaggggcgcaagaacacagcaaaatcccttcacgatctccaggtaacccatgcatttctctgtttggtttaatccgattcgtttgaattgaaaccaatattgtccattatctcggtaaataaagtcagtcgtgtgtgcatgttgttgtttctctatttctttctaggacagcatatattatatgtactaatatgtttattaagattgtcttccttgcatgatggaagattgttttttcagttgctagttgcatatctagaggagggcatggtgggtggatatattattcttttaattcaatgagtatatatgactgcataactgtgttaagaatgttgatgcaagtttggactggttacccagctgagctgcttaataaggattgatttgttgatcttgtcatagtcataacgtttcactatttttagatgcaaagatggatacgcttgcttgatcattctttgctctaataatgaccaatgtgccttctttgcttgttggtttcagatttggatttggggtgaaatactttggctttcttcatttagactggtgacaattgaagatagcccccaaattgccttaagatttggtaagtgttggctgtttttaaggcaatatattatcagcaaataactgctcttccgtattataactttcctagtttatttgtactacttaaagagaaccttttcaagactaacttacagggcatcatcacaaaacctctttttcctttttattctttcaggtttggcttgagtggatcaagtacagaatccgaacttttgcaacctgacattcttctagttcacaaagtcggccagatttgagatttctctcggacatctctgtacacacaggagctctcttttgctccagttttaaacagaagttggacaaaggctctgtttctggttttttgagtttctgcgataagcttagagagcagacaacaaacttttgtcctgattcatctaaactcttacctggtaggtgaacatcttttctgttttgcttctttgcaatttcatatccttttatgagcatatttgacacatcctcagccttctctgcagactgcaatcaaggccaattgtaatccaataatctctgatcttgttctggttgcacgttgagatgatggtgccctcttcacggaaagtccgtgttttctgctctgatcctgatgccactgactcctctgatgaagatgaccagaataagaaggaaaggagattttcaagggaaatactaattccaatggaaaactccaaggcatccaaacctgttaagacccttgttcaatgtggcacaaagactgtaaaggattccgagaaggaaccgacgagcaaatacaggggtgtgcgccggcgggcgtggggcaaatgggctgcagaaatacgtgaccctgtgcgaaaatcaaggaaatggattggcacatttaacagtgaggaggaggccgctgcggcatatcttgcacaatcaaaccagttccatgaagagttgatggccttgaaaatccaatcttctgtatcagagcaggaagatttgtcaagctctgttactatatcctgcgtgtcctcatctcagtcatgtgaccagaagattcaggcaaagccacaagaacacaagagagtgtcagtggtggttaaccgtgagaccgttgagcagaagtttaaggcacagccacaagctcagaagattaaggcacagccagaagtgcagaagagagtgtcagtgaagattagccatgagactgaggatgagcacttgctgaacttgccgtccacgcctaaaggcaaagagatttcgatgggcgctgttcttggcaggatagatgagattcctgtgagcaactgtgtgggccatattgatgaatttccacctgatgatttcactaggcttgcagatgcgttcccagttagtgattttatcggcatggcagatgtgccactgggcgatgattacattggccttgcagacatcagccacctgccgctgcctatcacagatctgaagttcgacctcaatgcagaactcaactgggacgggttcgactttgcttcattggaacaagaactcaactgtctttgatggcttgaatcctgttctatgtgaaaacctcttgttgattgaattgagtgcaggaggtagattcaggtatccatctttcacattgctggcaggccgagtgtatgatctggagattttcatctccaattttgccggaaaattgtacagtccccctacagcaaacaaatgagtaccgcagtatttatgtatatgttcaccaatctcaaaaatgttaatgagattgtggtgacagaccgtccttgatctcagtttggttgtgtatttgttggacgccattattatatttgttaattttgatattgttcttgtgattctgaagttatgtacaaatgtaaatataggcctgataaaatccagttattgtaaataaccttactaattttaggcaatgaacagctaagaatagttcattgttgaacaaaaatgattaatttttgttgttaaacatggtaacgttgcttttctttctgaaggatcagttccctagttgattggattcctactctctgctgaacatgtgtaattctgtcagacaagagtagtaacacaaaaatgaaaacaaaagaataatagtatccaacattgcttctcttagtgcatggaattagtttcaaattcaaaatgattgacatagccacattactgctaatacaaacaccatgtagtagtagtctaatgatgcagcatctgaagaacatgaatacatatttctctagatgttgttaacttctctgaattcagctgtgggatgcaaaatgctgtggagaaagaaagaaagacccatggccgccgccgccaccgccggcggcgctccggcgatcagtaggcggcggcgcactcgaaggagacgtcgcagccggggacgggggtgagcttgatggcgtgcttgaccctgctcatgaacaccgggaggtaggacatggcctggcagatgcaggcgttgtcgatgcccatcagacgccggcagcacgccgtgtcgtaggggtcggcgcggtggctgcgcagccgcccaccgccgccgccaccgccaccgccatggccgtgctcgcgctcgcggtgctccgccattaccgccaccgccgactcgttgagctggcgcagcggcaccgccgggttggggccggagaaggtccggaggctgcaggcctcgtttgccaggttgaactgcgacctgcagaacacctgggcgttggcctccgttgccatgaaagtgaacagtagcaggagtaccagtagtactactactgctgctactgatgacagtggtggcaatggtggtgatctcttcttgttctccattgctgctgctgttttttttttct

SEQ ID NO: 313 - DNA, 5320 bp, Oryza sativa; identical to SEQ ID NO: 308

SEQ ID NO: 314 - DNA, 3122 bp, Oryza sativa; identical to SEQ ID NO: 211

SEQ ID NO: 315 - DNA, 3709 bp, Oryza sativa
atgatagaaaaataattaataattatttaatttttttaataaaacgaacggtcaaacatatttaaaaaaaagtcaaaggcgttaaatatttagaaacagatagagtataattaacgggtaaaataaaactatattgttagttgttacacagttacagtatatatatttttgtgaaacaaactagactaacatatctaatcaccacaaacgatatatctttaaaaaaaataattaaccgtaaatgtacatgtaaacttaagtcagatagagatagcacgagaaaccaaatcaagttaattgttagtcctacaatgacgacgttgttttcgagcgctgatgcatcaacaagatacgactatgactatgagcagtccggaaaatctaagctactttattctaaagtccatccagttgccacaggattttcagtttttttttaattctccgtcgacgatataaacataaacgtacccgaatattccacgaggaagcaagagagaaaaacgaaaaacatcgttgtcttctcaaaacctcagctcgatcgatcacgagagtgtacaagttacagatccggccgtcgaaaaaaaaaatcgacggctcacgtcgcttcatctcaccctcaccgccgtggtacaaacacgccatcgcaatagtactttgagtaggtacaccaccccgaacagcgaacacccgatcccaccgccaaacgtgcgcgcgccacgtgccccccttgttaactgacaccacccggtcgccctcccgccacgtgtccatctcgagaccaccacgtgtcgccacgctagtggcctaacgtccctctaccgttccagccgtgtggggccatgggcccacagtgcagtggcccgggaggaagcttcgcgcgcacgggccgctccccgacggaagaggcaattagtgaggtgattgctgattagcgacgctaatcgagataagattaggaaaagaggcgtctcgtcgcgtcggctataaaagagctcccatggtgtccccctccattccccaaacccaaacgacggagacccactactccgagccatcaagaacacacacacatccagaaagcctaatccaatccaaaagccctaatcacccagactccatctctgtgaggtttgagagaggtaggtgagccgtagatctgagcgagttcttgggtcttccagcaggtagatcacttcatctgaggatcaatctttttttttttcctttgtttttgagcttctgttggtgtacaggacagagagttccagagccttttagtttctggtgttctgatctgttcttggtgtaagattattggtctgatttggtagccaagagggttaattttttccacacctccttgtgctagttagcttagcttataccccccttgtaaagtgattagtagatctagaacttctcttttcgtctgccagttcttggattttggaaagaacaggtggtttgttattcagatttttaggttagaaaaaatccacaaaaaaaaagatattcgatggcagctgctatagaaggaaatctgatgcgggcgctgggagaggctccgtcgccgcagatgcagaagatcgcgccgccgccgtttcatcccggcttgccgccggcgccggcgaacttctcctcggccggagtccacgggttccactacatgggcccggcccagctcagcccggcccagatccagcgcgtccaggcccaactccacatgcagcggcaggcccagtcggggctcggcccgcgggcccagcccatgaagcccgcttcggcggctgctccggcggcggcggcggcgcgggcgcagaagctgtaccgcggcgtgcggcagcggcactggggcaagtgggtggcggagatccggctgccgcgcaaccgcaccaggctctggctcggcaccttcgacaccgccgaggaggcggcgctcacctacgaccaggccgcgtaccgcctccgcggcgacgcggcgcggctcaacttcccggacaacgccgcgtcgcggggcccgctcgacgccgccgtggacgccaagctccaggccatctgcgacaccatcgccgcgtccaagaacgcctcatccaggtccaggggcggcgccggcagggccatgcccatcaacgcgcccctggtcgccgcggcgtcgtcgtcctccggctccgaccactccggcggcggcgacgacggcggctcggagacgtcgtcgtcgtctgcggcggcgtcgccgctggcggagatggagcagctggacttcagcgaggtgccgtgggacgaggcggaggggttcgcgctcaccaagtacccgtcgtacgagatcgactgggactcgctgctcaacaacaataactagctcttctcttccatagcccgccattgccggccggcgcagatgaggttttaggcattctgcgcggcggcgaggcgatggattatatgttcgttcttgtgtagatccttttctttttgtgttggttttttaggttccggaggctgctcgccggcgtcgtttttgtgtccggcgtctccgatgtctagtaagcagtgactcgttagtgtagtagttgtacaactctacaaatgtacaaatacttgtgcatgtaggttgttgtaatcaattgttggtaactacctgtaatagaactactgtgaattaactgtattaatgtgcaaatcttcatcgatctttcagttgtaaaactttgacttcttaatttcttattatgcaactgcttccgaagaatgaaatccaaccaacataacggactttccaaccaacataacagactttttttcgtttcacaatgggatttctgttcaactatatccttaagcagttgatcactgatgcaccgtctgtttggacaggagtgaactgtattcccttctgatttgtgaataggaagctcctctcctactagtagtttcataaaccaacggtgtttcttttccttctactctatacttcccagttcccacgcaataaggattatcgtacagcatatgctgttactaattgattagctgcttcttctgtaacccttgcgagttggcagttcatattccaacttccaaccgacacccaaatgaatcctgttggtcattctgcagttactgtgctcaaggcgatctgcttgctatctgtagtctttcggcaagcgaagaactccacggaatattgtcctgatgtgatgaatttccaagatgctgaatccagtatccacggattgagcttgcttcttgctaacgccttcttgtttgaatgtatccagtaccaactgcacctgatcctgatccttcttgttcttgaccactctggtcttcattttttaagagaatggaaatgcttgtggtcttccttctaccagtagatgttatttagtataacaagtaaaaggcacgctttgaaccatagaacattcgtatgaataagatacacctgtcacatcaagtgcaaattttttctctgttccatgaaaccaaacgaaaaacaatctccgtcatcatatctgagcattcccccaaattgaacggttttccatatgagaataatttcccctacatttttcaagacaaatgcttgtcaaaacgagataaacattcaaggttgataggtcctagaaatggcgtggattcgaggacttctttgccgtcgttggatcctgtaaatgggtgatatgttgaggttctgaaaacgata

SEQ ID NO: 316 - DNA, 3122 bp, Oryza sativa; identical to SEQ ID NO: 211

SEQ ID NO: 317 - DNA, 4443 bp, Oryza sativa
aaagaggagagataatagcagcaggctacagatttatagcccattgcagcacggattccaagacgcaggtgggaccagatattgattgtgtagcatatgtttatagataactattgtataaattagctattaagttgattatagatgatttgaagccagcagttggctatactattaaacttgctcttagacgacaaaaagcctaaaatgactggtggaatcttcttttgagaccatatatacacccaagggacaaaaatagtaagacaatctagagaacattttaatacgattgttgccgtgactttgtaaccccaagtttagtgttttagttgcctttatcaatgatattgcgtgcgttgaacacatgccagtaataacagccgtctctccttttcagattaaaaaaaagaagtgtacacccttctttctccatggtcgtcaaaggcttttcaaaactctttttttttttctaaacaaatatgctcccttcgttcttaaaataattggcactattaactactgctatatcatttttaacttttactgtagatgactagattataataaataaaagatttatgattatattcgtaatgctacataatttgatatgatatgtttttatattttatttgtcaaaagataggttattaaagttttaaaactgaatatatcgtgaagtgagcgtaacacaactggttagtttcttgtggtggatccagcccatattgataaacgacgtcctcactgataacgagatatccatgacgatgtgtgtggctaacccatgaactcacttatagaacaaaataagtaaccgtttattttagcctataggtaagtttgcgggttagcaacttaccactaatctgagccgtcaatctcgcatcagaaggtctccacctgtcccacgtggaccaatcacactcagccagctggccacctcccctaaccaccatcatatttaagccccaaatggccaaatcctcctcactctctgtaaaaacaagcaaacaaagaaagaaaagcatcacaaatctcacgcactgtctctcgttcgcgcaaagcacgctgcttttctccgctttgcgagcaccatagcctagcccaccatgtgcggcggcgccatcctctccgacctcatcccgccgccgcggcgggtcaccgccggcgacctctggctggagaagaccaagaagcagcagcagcagaagaagaagaacaagggcgcgaggaggctgccactgcgccaagaggaggaggatgatttcgaggccgacttcgaggagttcgaggtggattccggcgagtgggaggtggagtccgacgccgacgaggccaagccgctcgccgcgccccggagcggcttcgctaaaggtaaaacaagaacgcgagatttgggagataaaagcgagctgtttcttgattttggttggcccagatttttttttttgcttgcggtcagtggggagattagtaggtgaggagaaggatgccttttttttttctattgttctgtaggaaatttaatgtctgcaaatctgaaaattccacctaattattgttgcagttagtgcttgcttatcatgctaggttgctgctgccgggttagctttattaccttattgattaatcttaaggaatattattatatctcagttttagaaatcagggcctatgttatgatgaatcatcatgtcctgtgatggctcctacgattcatggatggagcttccatacaacacaatttggagaagaagtttctgagagtttgcccaaattggatcagatctatgttttttcgtgttaattactgtactcaagtaatcccgtatgaagaatcttggatccgacactgggcgtatagaatcttgacatttctgaacaaagttaggactcaagcagatccatgttctgaagaaatatctgtttttttttctataccatgtgattggactgaacatgtacagtattttcttcactgtttttaatatattctcttctgttttcttttcttaatgcttattggccagcagttcttatgttaaagtgttcgattctcaatgcttctttgtgtatgctactgattcaaaaggttgaaggataataagtttttaccatattaaaatttatacaccgatcttgttccttgcttcaggtggattgaaaaacactactgttgctggtgctgatgggcctgcagcaaggtctgctaaaaggaagagaaagaaccaattcaggggtatccgccagcggccatggggcaaatgggctgcggaaatcagagatcctcgcaaaggtgtccgcgtctggcttggcaccttcaactctcctgaggaagctgccagagcttatgatgctgaagcacgaaggattcgaggcaagaaggccaaggtcaatttcccagatggggctccagtggcttctcagaggagtcatgctgagccctcctccatgaacatgcctgctttcagcatcgaagagaagccggccgtcatgtcagcaggcaacaaaaccatgtacaacacaaatgcttatgcctaccctgctgttgagtacaccttacaggagccatttgtgcagattcagaatgtctcatttgttcctgcaatgaacgcgattgaggatactttcgtgaacctgtcctctgatcaagggagcaactcctttggttgctcggactttagccaggagaatgatatcaagacccctgacataacttccatgcttgcaccgaccatgacaggtgttgatgactccgcattcctccagaacaatgccagtgatgcaatggtacctcctgtgatggggaatgctagcattgatcttgctgacctggagccgtacatgaaatttctgatcgatggtggttcggatgagtcgattgacacccttctgagctctgatggatctcaggatgtggccagtagcatggacctttggagcttcgatgacatgcccgtgtcggccgagttctactgaggggtttggggtgtagcaactggtgcctgtatatataaggacaaatggtaagcatcagcaatgtgaaaacggctaactctttgtgacatttcgatctccatttctctgatctttctccgcctctcgtttcaggaataaacattctggacatccaagaagcggcatgtgtctgtcgggcgcttctagttgcgctatatagctatgttagtatgttagtatgtgctgtgtctagcttagatgctgaagtctcaagtactatttggcagtgaaactatctatctgtaactgctatatgaggctggaacaagttacttagcttctaccttatctgtacttgctatagtggctgtgaaccttgtggatctgaactctgaagccaatgtttactatataatgtggttggttttataaactctagttgatttggacccctgtcaatggtcatgctatggctggggataagaaccattgatgatcatatttgactagaaacgctgcttccaaaatatcccataaagtaaagctgaacttgtactaatgttcttgcacaagttgcaataatgttgccttatggaaaaacagtttccggaccaagtggtatctgtacgaattgctattgtaggctaacaacttgtgctcaagtggaagatggtgagtatgaatcatctttccttcagttgcacttaaactccggacctacatatacattgactgataggccccagccaaaatcttgtcttctacataggaattctcgggtagtttcttattacttggtaatggttgttgcctaggaaaaattttggttgccactcagttttgattgttcttaggttggagaaaatttggccgttctttgaatttgttgtagatagtagagcatcatgttcgattgagaattttgaccgattacacttcatgaattgtacaaaattttttttatcgggctcctttctatgatttttttttacgcaagagttagaatccatgttggaatgagtttatttgagcctccaattctccaaactatggttatcaaatcttgataataaaaacatctgtgctgtgtatccaaccattgtgcactaatgcactatgatatttatgtatgtttggtttgctgctagtctaggatccttgctgcaatatgctaaaactctagtggagtattttacgttggttgttgctggtaataggcaccatcaatattgaccatatgggtatcattaccctcccaaaatatctcaaaagttaagcagtacataacaaattgcaaaggactatcttaagaaacaccgtcttataattggatttttgggcagcttcattgttgatttcgtgcagaaagtggtcttttagttcaggaagaaagtgaggggaaaccaaagagagaaataatcttccttcttcgtcgcactgctgtatgtactcggaatagacctgtcagtttgttgaagg

SEQ ID NO: 318 - DNA, 3131 bp, Oryza sativa
agaaaaaataatggaggaaaagaaagttaaaagctggagtagtagcgagacagcatgagccgactcgaaatcaactgctattaacccctcccatcccttggacccttataaagggatcctctaacttaagaacacccataatggttatttatagtctctctacaaaatattcatatcagcatattttcttacttgaaagaaattaaatgaatagagagagcaaagctatatactaacctggagatagtctatatagaaaaacgaggcaatagattagagagctatagatacccatgtagacatactattgagatggtttactattaatctagtttattgttgagatgtacatgttttatagagagcaccttaatttaccattgcaggtgctctaactactatgtaattgaaccactgacatgtggaacataacaaagtgggacttatatatcagtgactcaattgcatgcgaagttaagttaggctgtgttcgatacccttgagttcctcgtgtacgcttttcaaattgctaaacgttttttcaaaaagtttttatacgaaagttgcttaaaaaatcatattgatcttttttttaaaaaaaaatacataatacttaattaatcacgcgctaatgcaccgttccattttcgtgtgcagtatatgtgttcccaaccctgagagccaaacacagccttagaggaggatcttcttctattggtcactagagtaggtaaccatacatgcatatccgtgcattaataaacagagcgctatattacatctttgcctacgtgagatgcaaggaatccaactgggatattacaatttagctacacatgaaaagcctagctttgctcgccgtgtgcctctccgtacagaatatctgctactgctcgctagctggctgctccaacggtggatggatgggcctaccccgattggccgatttcatcagcaaaactacgtagaaaaatgggagtaattggccaaaggccaaagcatgcatgaaccgaaccacatgatttgcacccgaggaggttgcgaaatcacattttgcatgacacatgatggccccactttagttaaaaataattaatccttccatttccagagttccagacttccagtgctagctcttcctcgggttcaaatagcgcgacaacatcacgcatcgcctcctacctgacacaccacactgcaaaccactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccgctggcgggcggcactaccgcggtgtgaggcggcggccgtgggggaagtacgccgcggagatccgtgacccgacgcggcacggcgcgcggctgtggctcggcaccttcggcacggccgaggaggccgccgcggcgtacgaccgcgccgcgttccgcatgcggggcgccaaggcgctgctcaacttcccgccggctgtcgccggtgacggcgcccgtcgcggcgccgccgcggccgcgaagcaggtcggcatgagcgacggtgagtgcgtgatatgaaatgaagatcagtttgacatgtacagcgcgtaggatgaggatcaaaacccagggttaatttgcagtaggcacttggcctgagtgttagtgtggtaatgttctgccttattgatggtacagtggtaccaagagcatgtcatgtagtttgttactctgtgcttagtgctcacattttttatgatatctttcgtggtgtgataccaattccgtgagcaaagtttcacttgaaggcatcaatcgtgctttccaagcacgaagaaaatattgtaacatggcgatatgtccaagatatcatcaaagtgcagcgttctagattgatgacagtttagcctgtgtaaagccaagttcataaaaaaggaatacttttaagaccattttcataaacaacctttaaaaacctacattaaaaaaatgacctatgtatgaactcttgaaaagaacagaatccgagtgaccgggtccaatgctaataatcacttatcactgtgaaatactgaaatattactgtttcttaccgagatgccagggaaacgaatccatgcaccgcgaccacactggcaatgccttgagatgttacatcattagattgttttacaaattacaattacaaggcctccattgaccagtcaccattctagatcaacttactcctgaagttcacggatagctagtggcaccagatgattacacaatttaagtacacgatggctcaagacttttccccatgccatgctgcagttggcaggtaaaatcgttataagaaaagcgttagatattcccaagtggaacactggcaatgccggcaacttgtaattaaaaccgaagcaacaattttcgaaatattttccatggaagattcgccgtctcgtgcatgggccaccacctagatgagctcagccgtgacgtgatcgccggctacgtgggaatctatgctttctcactgaccgaggatcctctatggctagagcagccatcaagcaagcccagacctgatgacgttactgtgcatccgttcatacttcatctcgtaatttcgatgaccatgaaagtatcaaaaccatccgaaaaatctcttgtaattgttctcacatatcaactgccaactgttcactccaggaaattctaaccatggaagaatcttgcgccaaacgcatcatcgcagaatgatgaccaggacccgcactaaacccaccagaacacatgcgttcccat

SEQ ID NO: 319 - DNA, 5255 bp, Oryza sativa
gtcagttgggcatatagttgtttgactttttaagaggtacacttgtcgtcaactatgcacgtttatgtttgcagctgaggaggagagagcaaagctatttgaaggatcaagcaatgttgaaatgccaagaatgagaactcaccaagaaattctcaccaaatataagtttggcggggtaattccatttcaaaactgtggttctaatcatggttcctatgtgtgtacctaagctaacccaaatctatatctcattgcaggatgcggcggcggcggctgctcatgcaaaagataagctcatgcagcgacaggagaaactagaggtgagagagtacatttcaatactttgtgctttgcaccttttccattggtgtcacccctagcctagaccttcatatacgttaggcaccgatatttgaagttgtggtttttatggagtatattaagaaaacgttgatgaatactactaactagctcatcattggtttaccagagaataagccaacgaaccgcggagcttgagagtggagcagagaattttgcttccctggcccaggagcttgcgaaatcaatggagaacaagaaatggtggaagctataattaacgttgttgtgtttgtatatgctgcgtcctacacaaatcaagtaggtccaatccaggcatgacatttacatgtactgattgctgattgccattgattcatattcattgtgtgccatctggtggtgttgtgtataatattagtaggaggggagccttggggaaatatgtagcgcaaactttatatgtaagacaaactgtctgattatgaagtgaatgtgagagatttgtccatgtcatcacgagtaaaagttttatttgtggtgatgtggataaatcttatacgtcaatttgttttatcatttttaggtatgcactacatatatatatatatatatatatatatatatatatatatatatataattcgtttgtggtacatatttctccgagcttgtcgcggtggtcgtttatacacacgttagctttagggtcatgttgtactacacgagaatgtaatgtttctctctctcttttttttttgaaagaaagaaagatagtaatatgttgtattacagcagaatgtaatgatatactagtatgtaggaagagtggaaggtagttttgggaagagaaatggggatgtgagtagtttgtggttgggagtgtaacgggtggggtggtttggaaggtgatgaggtattggatggagtggagggaaggctgaggtttgccgacgagttcccaaaagtgggatacggacagatggatagatagatagatagatagggccggcaacccagttgggttttcctttcctttttgcgttgataaacccaggcgggggcggcgccgcgcagcttaccaataccaattggagtagaaccaaccaaggaaagaatggcccggctgctactctccggcgtcgcgccgctccccctcctcccctgccgccgtcgcgccattgcatttgcgctcccacttgggaatgtccgcctccgcctccgtgtggccgcacccaccagccgcgtggccaccgtggaggaggacgacaatgaaaataatgctcctcctcctccttgtgaggacttcgacccgggcgcggcgcccccgtttggtctggccgacatccgcgccgctatccccaagcactgttgggtgaaggacccctggcgatccatggggtacgtgctgcgcgacgtggtggtggtgttcgccctcgctgccgccgccgcgcgcctccacagctgcctcgcctggccgctctactgggcggcgcagggaaccatgttctgggcgctcttcgtcctcggccacgactggtacgacggtattcatttccattttgattcctactccactctactacactagtagtaattaattcgttcatggaattggaattgcagcgggcacgggagcttctccaacaactcgaggctcaacagcgtgatgggccacatactccactcctccatcctcgtaccctaccatggctggaggattagccacaggacgcatcatcagaaccatggccatgtcgacaaggatgagtcctggcatcccgtacgcattccttccttccttctcgatttcactacttaattgcaactactccagttgggtttccccattgcaaatgaatctgatcaatccaatccaaaatgcagctccccgagcggctgtacaggagccttaacagagccacccggatgctccgcttctccatacccttccccatgctcgcctacccattctacctggttaattaattgctactctagtactctactaatattactagcataacaatgtactctacgttcattattccattatatatatttatatgtgatgtgatgattaagacgatgatgaatggatggatatattgcatgcatgcagtggtctcggagcccaggaaagtctggttcgcatttccatcccagcagcgacctgttccagcccaacgaaaggaacgatgtgctgacatccacagcgtgctgggtggccatggctgccctcctcgcaggcctcaccttcctcatgggacccctcctcatgctcaacctctactttgtcccttactgggtacgtagttaccccctacatacatacgttggttcattgatgtgatctgtggattgggttcctctatcctctgcctgccctcgatctcctcttttgtggatgtggggaacaaaacctaccttgctttcttttctcatcagtttgtatttcaattctacttctctgcagatttttgttatgtggctggacttcgtcacctacttgcaccatcacggccacaacgacaagctgccctggtaccgtggcaaggtccgtttaactaattactaacattttttactatcaattactattagacgacatgcatatatacatcatttcttctctctaattaaactcgctcacactatatgcatgcttaatatattcagaaatcaagcaatatatatgtatgcatggctcacacactgaatgaataagctaggttgcaacttttatttatgccgttggatctagtaatcgattgattgcagtacgtagaaaaaaaaagattaggcataactaccttgtcaaaaatagtcaatttaggaagggactttgacctgagcctgtgattaaacgagtcatagaaactagatgataatgcaaagatgcgatcttctgtccacaaaaaatcacaatacgttgtggtccatgatgcaaatgcaagttggatcacaacttttgtatacatgcatctttttcctagagagctgcatcgttttcagaattcatactgtgaggcagtgaatttttttcttttttttttctttagaaaatgttcgtaggcagagaattactcaaggaaatccaaataataataatctcacttttgcacttttgtactgaatagattgatgatatgtacaggaatggagctatttgcggggaggactgacgacagtggacagggactatgggtggatcaacaacatccaccacgacatcgggacacatgtcattcaccatcttttcccccaaatcccgcattaccatctaattgaggcggtaagctctagtctctgcagtgcatgcggagtactagtaattaaattatgctatgtgatgtttatcagtacgtagtgctgagtaattactaagaagcatgggtgatgaaaatgtgcagacggaagcagcaaagggtgtgatggggaaatactacagggagccggacaagtctgggccttttcccttacacctgtttggagcgctgtcccggagcttgaaacgcgaccactatgtcagcgacaccggagatgtggtctactaccagaccgaccctgctaactaaattaattttacatttccttcaattcttttaagcccggaggcttaaattagcttaattagatagctgcgactgacctggacatgtattcaacattcgatccacagacagatagaaagagacctatatatatcgccgatcaatcgatatatatgtgcgtgtccgtgtggagatatggaggtcacaattctttccatggatatataggagtatacatacatgtattgaaggatatgtagctagatttgatgtgcgtgcgtgctgtactttgtaagacgcagcataaagctagtgacaatttggacaaggccatattgatatatccattatatacacacctcaatgcctcattacatttatatattgtttcaaatactgtagcaattacatatggagggtgataggagtagaggagagagagaggaggattggaggaagaagaaaggttatccactgacatataggcccggtcagtggtgactcagcgagatgggcccgttttgtcaagatggagggtgaaaatttctggcaaactcgacgtaaagttgagggatgacaggtggacttatttcctatttcatgtgcatctcaaatttgagcccatatatctgatgatttaagtccagatgacatccctcccaccgtaagcccatttacattttccaacccatcccatattcatattattctaaaaaaaaaaagaaaagggaaagcccaacccatccgcaggcggcacggcggagtgagcgccggcggccggagcggaggagctagggttccgatggctgtggccgctgcccaagacctcccgccgaccttccatcccaacccctcgcctttgccttcctccatggagccgcgcctccgccagctccgcagggttccgctcctcgacttcgtcgcccgcatcgccgacctccatgccgatcaggccagccccgtccgcaagctcgtcgccgagtcagtgtccctttctcctcttggtcttggacctcccaatttcatcctcccgtcctaggtttttatatttggattgtgtgtggtttaggtgtcaacgttgagtcactctgtaattttatttccacacacattcgatgctaagtttccactcttctatttaccactcaccaacagtaacaaatgataatttagcgcttgctagttattaacaatactgtacacgagcctgctcgctcaaggtgttgttgttcataagagcgtctattagaaattataatactctgcccacgcttttcactgtgctcgtatatgctcatggtttttttgctacatgtgcatgtcaattctaccccgacataggatgattggtgaggttgggtcaaaacacatggcatacct

SEQ ID NO: 320 - DNA, 4606 bp, Oryza sativa
aaatacttatgaatttgaacatagcctatatagaggttcaaagcccaaactttttctttttggacggcaggtatatctgcgggggcgggggcaaagccacgttaaccttagtacacaggacaggtgttatcactgcaaattactccacctctaatgcctattatacaggcttgttcactttgctaacattttcaaccttacctttttttttgggtaaagttataaaaaagtggctacatttagtttgttgccaaattttagtaaatacatataaaatcttactaaaatttgcaactttgccaaaattttgacaaccttaccaaaatttgataatgctaaaacttggtaatgttgagaatgttagcaaagtgaacaagccctacatgttaagtatgcgtatagatacctgataatttttgttctagattcaccattttaccgttatacctggccactgttatatatttcctcagtcccaaaataagtgcacctaggtatctagataagaatgtaactattctaagacgatccagatttgtagtcttattttggatagagagtagtaaactgcactgtacattctatccaaatcgtcttacgcacgggaaaagaagttcaggcctttgtctagcaacttagactgtgtttagttctttctaaagttgaaagtttgggttaaaattgatacgatgtgactgaaaagttatgtatatatgacagattgatgtgatggaaaaagttagtaaacacagccttagcaagacgtcaaatacctgcccgtacccatggacaggccaaaagttcagttcagtttcattgcacacctctcaagatgggccgtgaatttagcccttaggagttaggtcgcgaacttccatagtgggccgtgtctcactactcaaggccccaaagcccatacgaatattcccacccgtactttctcccatggcccaccactcagcaggcatcatcactgctcgagtcgagagtcgagtgtcgagacatccaccgctacggggaggcatcccattcgcatcactatcttcccaatctcgcgaataatcgagagagagagagagagagagagagagaggcgacgagacggcgattgctcggttctcccgcgggcggcggcgagccggcgagggcttctccggtggggggcggcgagctatcctagcgcccgccttgggagcgctctcgcggtacgtgtctgctgttgccccccagctggctcgattggctcttttcgattcgggcgtgttccaatctggtgtaccttgaacagttcgatttcgcgagcgatcttccgtgagggtatatgccgcgagacccccgctgtttggtctatccggcttgttttactgccccgaatgatgcccaatggaactttgcaacgagggattcgcggttctgtatcatgataacacgcatggaatgctagaaggtgtaggtctgtattaggcttgttggttggggaggagcagcaacgtctgatcacacgtccacagcagtggcaaccttttggttgcatcaatgcagtcccagttaggcgatagttggattgggtgtatttaggagagactgggattggtctatgtgttttccttcagaaaaggaaagtgacatacctgattatgctgctgtggggagtgcagaatgagtgtcatgcttgattaccaacgtttggttaggatatttccacagctgtccctcttcaagttaaaggtcattagctgtggtgtcctcttctgtggaattctggaacgctaaggttcaacttgaaagtacggggcacctttatattggcttgaaattgtgaaagcagtgaatttaaataagtggagaaagtgatttttcccccaattttctagatgcctgtactttatgatttgatgaagattggatctgttataatacatactctaatactatgatgaataatcacccaggatctcctttggagctttgatagcatagcaaggtcatggcagaggttgcagatttaactggggatggaggtgttcttaagacggtggtcagaaaagcaaaggatgatgctatagctccaactgatagtcttcccttggttgatggtactgcagttcatatatttatttctcaatccaatcatttccatgaaattccttctgcttgattagcaatctctaggcagttgagttacatttataagttggttaattggtcctaaatcctaataatttctcattcagccgtgtttccactctttttatcagtgacagtaccacacagtgaatgcctgtgtttcgtttgtcatgtcgatgtgtaaaactatttatgtatattactagtaattgagtatgtgcataatacaagacataacacaatacttagcccacttacatttatatcctttcacagttcattatgaaggcacactcgctgaaaatggtgaagttttcgacaccactcatgaagacaactctattttctcatttgaaattgggcaaggagctgtcattaaagcatgggatatagctttaagaactatgaaggtataaaacttctaaattcttattgctagctcgttctgattctttcaaagattttgctgatatggagtgacatattggaatattgaaggttggtgaagttgcaaaaataacatgcaagccagaatacgcatacggaagtgcagggtcgccgccagagattccacccaagtctgttgctatttctcctatgcgatgcaaatttgagttcctggtgtctataattgaatcagctttgtctttgcagtgcaacactcatttttgaggtggagttagtggcttgtaggcctaggaaaggttcaagcctgggcagtgtttctgatgagaaagccaggctagagtaagatgttttcaaatgtcttcttgttatgattacaatatgaagttcccagttattatgttaaatagcacagctgtacaagatacagaaaactggttaatatatcacgtgcatcataatttagtcaaaactataatgctggagaggtaggagttaggaggaatgcagtaatcactttatggaatcaactgttatgctgattgcctgtgaaattatctcgagataattgcttattttctaccttcttgagctatgaagactaatatctgcggaatacatgaatttccttagggaactaaagaagcagcgagagctagctgctgccaccaaggaggaagagaaaaagaagagggaagaagcgaaggctgctgcagcagctcgtgtccaagccaaacttgacgcgaagaaggggaagggaaaaggaaagggaaaatagatgactagtatttgcttctgactactgtaacctagaaataatccgcaacaaatcatcatctgcaagattgcttgttggctactgttcatcagatgctgcgttgttgctcctgtttgacaccatggctgtactgatagaacaaaattgtagttaacgttttcacaaatcatcacatgcaatcattgaccggttattggttaatgattgcatcttcatatctgatgatataccgcgtctctgtaagttaatgctcaacttacacgattttatcggatattgaggagttgccctttaaacaatgctgcatagtaacagaatttactggctaggctacgcatcaacctcgaaaaaggtgttgcagtttgacatgcgccattttcacacaggaagactatagccatgcaagagtgatgaaccacaatatgcattattgtgcaccttatacggtgactgcttatgcgatctaacatacaatgcagaagaatttgaaccagagctttgaagaagtagaatcatccaaacattacccaaacatcgtatcatcgtgttaatattaacaagcatatgtcagcagtgtatacacaaagaaactgcgtcgatgtatgacaaataaatataagttctgttcttaataaacatgtatgcgaacaatctcagatgattcctatcgtggcctttcgctgccataagtggctctttaagagaacaaagtatggatgttggatttacagcagccccccattttttcctgccggggagatctacaacagaattgactacattcaaatctcctaataaacgcaatcagagactacactaaattacaggcgaggcagcatgttctgcctcatcaagtatgtaaaataaccaccacgaaaacaaaggagcagcctagcccatgtcctaacttggagccgtggggaggtcctgtacgttacacttatagcacatttcataaaggagcttcaagaccttgacagattatctgtactgctccaaaacacaatgcttcagtaaaaaaaaaaagaggcacatatgggcaatctaataggaagccagaggtctatgttcagattagcaactacctaatgaataaataaataacagtatctcgtgttaatcacatcgatggtgtagataatggaatatcatgtgatgtacggaaacggaggccatttcccgtattagtcgatactggacaaagccagcagaatatgttaggtcccagcacctgtataaaataatgacaatagttgggacatcaataacaagcaatacctccccttggtcaggaag

SEQ ID NO: 321 - DNA, 6173 bp, Oryza sativa
atacaaccaaaccaagattacatgcaatgggacgtacgaatctaatttggtttgaaccttcgcacatacatgtagcatttaaaacgtaaataacatattatatgaatagcccaatcattttagtatttctataacagaaatctcctaaaccgtggctcaaaatttagcattggtatattagagcaggtacaatagcaggctataagccagctataaacatattttaaagaaataaaggaagagagagaagagcagcgggctacagatctatagccagctgcagcacggactccaagacgtaatgtgtgtatgacaggtgggaccaggtattaatagtatagtaagcaactattgtatgaattggctattacattggctatagattatttggagctagtagtgggctatactattaaacttgctcttatacatgcgcatagacctaagacctagctacacaaacacaattaatacttcttagtactaaatctcactatcaacgggtacagctgccgaatcaagcacagtaaccaaccccagcacgtgcttaagtttttgcttgtaacgtttcaccactcgtcttattcaaatttttttgcaaatataaaaagcgaaaagttgtgcttaaagtactgtatataataaagtaagtcacaaataaaataattaataattttaaaattttttaaataagacgagtgatcaaacgtttgtaagcaaaaacctaaaatccattatattatgggacgaagagagtaataaacaacaacagtcacaaccacaaccatatgcccccaacgtgcacaaattcgtacacaaacccccaccctaaaatagcagaagcaaaactcatcacaacacagaacacacacacagtaaagctagtctgtccacagataatcccaacacgagatccaccacacatcacaaaccacacaaaagccgcaaattcttttttctttttttttctcgcctatttattgcctcctccaccctctcccctcctcgcctaccaccaccaccaccgtcgccgccgccgccgactgagaagaggaagaggaagaggggagattccgccgccgacgagaggtgggggggagtgggttgtgatcgtgaggagggctctcatccctagacgggcgagttgaaaggcggcaaagacggctagcgttgaagcggtcgggcgcggccacgcagctgcgccgcccacgcccagtgggggagccatcgcttctccggcgacggcgtccagcccagccccgcacggcggccgcggggcgcttccctcggccggcggcagcccctctgacctcctcttcctcgccggcggcggtcgcctctgagaccgctcgccccccccatccaccttctctaacatccaatcaacaaaaatctttcgctgacctgaccctgaccccgagagagaggaaggaattgagatttaatcatggagatgaagctgaccatcaagcgggtgcccaccgtggtttccaactaccaggaggatgctgccgccaccgccggcgaacgcccccgcgccggctgcgggagggattgcctcggggattgctgcttgcccggtgagtctcttcctcccaaatcaggattaaaaaaactcttagattattttattgtcttattattacaccttggattccgaaatcctggttacagttttcttctgtgatgattttcttgattcgtttgattagaaaaatggttgtgcttatttttgttgggtataacttgaatattaaattcatctttcgtcgcaaattaaaaaaaaaagaagaataagaacatctttgcaacttccaagaaagttggaggatcctgtcaccactagtaggaaggatgctttacctttgctatttttaacccctgcggttaaaatattgttactggcctactgggaatgtttttgggttcaccacttgtagtttggtttcctccaacttggtaggataaaaataggagccacatattattttacttagatgcttcaaaatcttatagggaatataggcaccacaaaaaaaaaatgtgtggataggcttactaccacttgtttttaagtgaattaacattttttttcttgcatttccttgagcagattccaagcttccgctgtatgctttcaaggcgagtccgaaaaagccgtcttcgcaggaggatgcttccaacgatgagttctttgtcaatctcctgctcggcctggtaaatactaaatagaagcttacactttaaatttcgcacaggagaagttcaagtatttgttctgtattgcgcacaactacgaaatcttgttagctctctggagagctactgaggcaattagataagatatttgccctatgtattatagtagcgttcggttgtgcagttttgggtcatcaccagtttggtccaagcctgttacatgtgtttgtttcaaatttcaaatgggcaagtatcggatactctgtaattggatccaaaagatcgttatgctccctatatatccactggaaatgcttaccgattctgactcgtttcctcctacatgcgagctaagatgtgagacgttatattttgtgattatcaacctactagttaagttgtggaaaaatattgtcaagaagtaacaattgcgtatatttatgacgtataacctgcatggaagttatgatgagcacccatgcacgcattaaagaaatgttcttcaattttgagcatccagcattcatgtttgagtgtatattctctttttgttgcttttgcatgctcttactatgttttccatgcaatagaaataatatatgcatgaagttattactagccaaatatacaccagacagcattatttgcgagatggtattgctgattatgcaagtaacaaataactaatccctccgtttgttttatgatataatctgtcctgtgtttataataggcatctgtgtaaccatgttacgatgcttatgtaagaatactgaagttcaaattttgtttgtttattgcagtgggaagacaggatggcccgaggtttgttccgatatgatgtcactgcctgtgagaccaaggttatcccaggcaaccttgggtttgttgcacaactgaatgaaggacgccacctcaagaagcgccctactgaattccgcgtggaccgtgtgcttcaaccatttgatgctgccaagttcaacttcaccaaagttggccaggaggaggtgctcttccaatttgagaatggtggtggtgatgacagcttctttgtggagagctccccaatcagtgttgctgatcgtgctcctaatgttgttgcaatcaatgtaggctacattcgcactggtaatctattttaattctgatatttatgtattcttggtgttaacatttctatttgacactctgcaggtaagcccaattgaatatggccatgttcttctcattccccgtgtactggaccgcctgcctcagaggattgaccaggagagcttcttgcttgcactgcacatggctgctgaagccgcaagcccatacttcaggcttggctataatagtttgggtgcctttgcaaccatcaaccacctccactttcaggtactcttcacatggttttggaatttgtttactgttgtatctacttgtagctgttagataaatcataaatcttccagcatgcaaaattgcacgaactgtgttttatatgggtacatgtattttcagttgttacagtgacactgaactttgcgtatctgcagaccaaaccaaaaatagacttattgtttgtatggttgctagattaatttactttgatgtaaatgtcgatcttgttaaaactcctggttcccttgtcccaatgcccatacagatacatctagaggagtcatattttctttagtgaaaaacagcgttcccattatgtgtgcatttgatctgaacaattagctgataaagctacctgtacgagtgtatgttatagtgttgtgtttacaattgtatactaaatcattacctgcttcttttatccacaggcatactacttgacagtgcctttccctgttgagaaggcagctaccaagaggattttccttgctgagggcacaatgaatagtggagtaaaggtgtccaagctgatgaactaccctgtgaggggactggtttttgagggaggcaactcactgagcgatctggccaatgtggtttccagcgcttgtatctggctgcaggacaacaatgtgccttacaatgttcttatctctgactgcggcaaaaagatcttcctcttccctcaggtaaaatgatacatgcatataacctcaatattgactgaactgtatatgcccatgcatttacttagttctatccactaacattgatatctcagacttgttgtcacctagctgatctgtataaggtcgctctagtaaacttttacttgttcctaacaaaaaaaactatggtgtatgagttttagcatgctatcaacaattgtgtgaaatgtttgtgatttctttctaagcttcatctgtttccgaaatacagtgctatgccgagaagcaggctctgggagaagtgagccaggagctactggacacgcaggttaacccagctgtgtgggagatcagtggccacatcgtgctgaaacgaaggagtgattacgaggaggcatcagaagcttctgcgtggagactcctcgctgaggtttccctgtcggaggaacgcttcgaggaagtgaaggcctacatctttgatgccgctggtctggttcagtccgacgaggaggaagtcagcgaagacgaggacgccacctacacgcctgtctccattgcccctcctgctgtcgcggaaggctgcctcgtccttcagtgagacggtagaacaggttgtcggcctggtaaagcgctgtgccgccttcgtcttctcatcagtcttcttcagtcttcacccgctggtcgcctagcttcgtcatagttatggttgctggtcttttataaggatcaatgtaatcgaactgcctggagtcttgtgtctgaacctgcatgctacttgctcctcccttccctgctgctctgatattcagactctgcaaatattaagcagagaaactgtgaaactgtttgtattgtttgtgctgttgagcactggatctaatgtgatgaacattgttaataactacacatcttccctgatctgtttgcttgttttaccttgtcgtggggggttcttttgcgtcattgatgttaatttagtttttatattcttttcttgacgtacactgtacacacctattctttgttcctttacagctgcgagtaaattgttaatttatatgaagtggccatgttacaatataattatcatctgaaaaacagagttgaattggattggcattttggcatacatcgattgggaaatttagtatcagactagctgcaactgaaactacatgactagaagtgtagaactgaatatatctatcagcaggtagcagcaatggctgcctgccggaactaataaagctgctgctttatctcaattttcaacagaagaggctaagcaaaactggggggtaaacgatacatttttctcttaactagcacagtactacccttgttcgttttacagcctgaaattgttgatttaagatgacaaaactgaactagctgttgttacaacaaaattttcatctttgacttgataaagagtagctcctcttcgctcaccatcttccacaccccaccaactagcaacctacccttcagaggaaatgccagttctggcatatctgaaatctcacattcttcaggtgatggtcttgataattccggaattctttcagcatccaattgcttctctgggtcagaataatagccgatcctctcagtatgatcatcaggctcaacacttacatgttgctctaatatttcatctcttgattcatgatctacgacgtcaagggtcggaagaacagccactgaactaaatgaacaaggtatcattcctattggacagggggtccaagactttgctgtagaccatctgttacgtttctctggcatgattgtgttcaatgaagccccggtgtcattttctgccaaacgtaaatccttctgtttcaaccgcgacttgaacatttccagcttctctgttgcttcctcaactgattccgtttctttggtgggctctgggag

SEQ ID NO: 322 - DNA, 9342 bp, Oryza sativa
ttagtagcattgtctggccggcgcggcgcaggtgtcaaaatctcccctagctggtggtgtgtgtgcatcggtttggcatgcacttactagttaatgtttgtgtttatggacagttagtttgcagttgcaaaatggcacataccgttctcagagttggtcctcaaaaagaggaaaaatgatattaatgggagtaacacatgtactcctatctatcgtctacctgatatgcaaacacgcgttttaatttgcatgtttccatattgtaagaatttaacgcaatggacatggtcaattatagcacagtaatatttctagctggaccggtataccatttgcatctgccattacctacttgctccgactagtatagtagaagatatactaacattcatcatgaatcatgtattcaatccttttttaaagatagtggataataattatacacagtcaaaatataaatacctctttggtttagattattaagtgaattattgatccagattattcacttgattacagagataaactaaatattttaagaaaaaagtaaactaggcaaatagttaaaaatgactggtctaaagcaataggagtacgatagaatattttttttaaaaaaaagggacgtaattttctaagcgtaaaacaaatgattcattaaaaaaacccgatgaataagctggaaattaagaccacggcgcggtagatcaatagatgcaccaaatcagtttcttgtacaaccgttcggtctattacgcaataggagtatatatctggtcgtattttccggaggatatagtcattaattaattagtccatatatatatagtacatattttatcatcatattgttttaattaataatctagttaattagccgtctccggaacaaataccctaattactgtacctaggtgggggccaacctaatatggcgcatgtaagtttcgtcgtcgtctcctacacgcgcgtcgtccccttcttctccttctctcggatctcttcttataagtagagagggagacgcagcgtgtggcatccaaagctctctctctctctctctcatagctagctagagcatgcagctactagctagcaagcttaattagcagccacacattagagtcacaaagtgagagagaaggaggagcttcacaagctcgatcgagagagcaaactaagcaagcagccatggctgctcctcctctctcgtcgtggccatgggcaagcctcggctcgtacaaggcatgcatataatctctctcttaagtcgtcaattaatctctctttgttagtttcttcttcttcttcttcttcttctaccttattaagctaattaacgtgtgcgtggttaattaatgggagatgggtgcagtatgtgttgtacggggcggtggtgtggaaggtggcggaggagtggaggcagcaaggggcggcgccggtggggtcgtggtggctccacctgctgctgctgttcgccgcccgcgggctcacctaccagttctggttctcctacggcaacatgctcttcttcacccgccgccgccgcgtcgtccccgactccgtcgacttccgccaggtcgacgccgaatgggactggtacgcccttcgccgtctctctctctatctatctcattctcctccgccgtagctagctagtcgccggccggtcgccgacggcgtgcatttgtgtcctattcatttttagattgatttttttgagagggagaaaatatggctttgcatccaaggcaagcagtggtcaccaagcccagagacagtactgtaccatccagtcatccactgttagatcagatcccagcttcagccttcagaagagttcagacagacagacgccatggctgctctcttatctagaatcatcgtaattactactcatatatgtcaccatttctactgcttaaaccagcaccagcagtaaaattaagaatgaatctgttttatgtagacctccctccctcaatcctaaaataactataagtatagttttatactgtccttatctaacgtttgaccgttcgtcttatttaattttttaattatttttatttattagatgataaaacatgaatattactttatatgtgactaattattttataaaatttttaaataatacgaacggttaaatgttagaaacggatatccacggcaacacttatttttagaatggaggtagcaatatgtgtttttctttttttgatgggattattttgcatatatatgcagggataactttctgctgctgcagacgctgataggggcaacgttggtggggagcccggcggtggcgcggcagcagctgctgctcccaagcctgaagcaagcgtgggacccacgcgggtgggccatcgcactgctgctgcatgtgttggtcgctgagccgctcttttactgggcccaccgggccctgcaccgggccccactcttcagccgctaccacgccgctcaccaccacgcctcggtcaccacacccttgacaggtactctacacctgtactcatcatgtactgtactccataccatactccccaacaaagtttaggagtataaaaagggagtgtatttattcctatctatgaactgtttggtgtaccaaatttgttttgaaaattctcgttggaactgtgaaccagtttatgtatgatgttttgttgtcttaatgagttgcagcagatattttgaaacttaatgttggttttgggatagattttgaagtgttttatttgtcgtagtttgttttttctagcattgacttttaaacaataaacaataaaaatataaaatgttatgcatagattattcttttttctgcttcattcatactccctccgtattttaatgtgtgacgccgttgacttttcgactaacgtttgaccattcattttattcaaaattttcgtgcaaatatgaaaatatttatatcatgcttaaataacatttgatgatgaatctagtcacaataaaataaatgacaattgcataaattttttttaataagacgaatggtcaaacgttggataaaaagtcaactgcgtcatacattaaaatatggagctagtatttctacattgattaacccatcagagtggtacaatttatgaagattaaattaatcgagactagcctgaaattttaattttaaaacgtaattatgaagttgattttaagtttttttaatcgtgatccatattttagcaagatttttttatatatattttagcattgtagatataaatattttatctataatttatttttaattatacgtctcatacggttatacggttatagcgttgtaggagtacaattttgactggctgatgataagcttttcctgtgttacgttggtctgcagctggatttgggacgccactggagagcctgctgctgacggtggtgataggggtcccactcgcaggggcctttctgatgggggtagggtccgtgggcctggtctatggacacgtccttttgtttgacttcttgaggtccatgggctacagtaacgtggaggtgatatcccctagggtcttccaggctgttcctcttctcagatacctcatctacacccctacgtgagtgcaaaaataaaataatagtataatgtatttgttttctgataaatacttctctattcataacttttggtaaattggattgaaaattattttagttgaccaccgatatcttgtaaatcgtttgattcaattaatgggaactatatgcttatattttttaatagctaccagtttatttttaaaataggagtgatcggactaaaacaatgcaaggtcaaaattatcaagtattgtaaaatggagaaaataagtaaattatttttgtctaagacagttagttaaataaataaataactactttataaggttgagatacaagtagtactaattatgctgcacttcattgtatggaccgtgctgctatctgcttaattgcatctgtcatttggtcactatcctagtgttgttagctgtactgctaattggttgttagagaaaagttgattaattagtcggtgttgtatgaagaggtgatacaagtaattaaaatcgatttgattgttctaatgcattatgcatatggatttaattgcgcaggtacctgagcctgcaccacagggagaaggactcaaacttctgcctgttcatgcctatttttgatctcctggggggcaccctcaaccacaagtcatgggagctgcaaaaggaggtctacttaggtagggtgcacgcctaattagtgcattttattatgccttttgcttcaagaaacaagaattatattcagtcagtgtgctacaagacccataagaaacattaacatttggaattgattcctgcaaaattcccaagccccaaaaatcttgaagattttttacaattaaaacaaagagatttggagggagagacattgctccagacattaacatttagaattaattcatgcaaaattcccaagccccaaaaatcttgaatatttttacaataaaaaaacttttttaaagaagaaattatgagcgtgcggggattgaacacatgacctcaagggttgaaatcacacatctattatcatttcactatcgagagcttgacggttttataataatattatttcgcgaaaaatggcaattgttgatgtaggcaagaacgatcaggcgccggacttcgtgttcctggcacacgtggtggacatcatggcgtcgatgcacgtgccgttcgtgctccggtcgtgcagctcgacgccgttcgccaaccacttcgtcctcctcccgttttggccggtcgccttcggcttcatgctgctcatgtggtgctgctccaagaccttcctcgtcagctcctaccgcctccgcggcaacctccaccagatgtggactgtcccccgatatgggtttcaggtataatcacaataacccccccccccccccctctctcttctcgcctagcttaattccagaataatttaaaattatatcatatctcatgtcggtataacatgagacaatattttagaattagtatgtgatctcaccgtaaatttttcaccccgtcacatcgaacgtctaaagacatgcatgaagtattaaatatatgcttaaaaaataactaattgcataaattgcgactaatttgcaagacagatcatttaagcctaattgctccatgatttgataatgtggtgctacagtaaatatgtgctaatgacagattaattaggcttaataaatttgtctcgtagtttactgacggattttgtaattattttttttattagtgcccgaacaccccatacgacacactatataatacccgatgtgacacaccaaaactttacacccatgaatttaaacactctcgtactgactgtatcgagaggacaactgagatatcatggatggatcataggttgtccatcaattaattggtagaggtgttgtggtaccatactattcaatggcacctctctcgcaagtacttgtacagtacagtagtgacaacagtggttaatgtgtggctttaactttgcagtccctatagaaaactgcatgtgattcggttttgtgtaggccatctgaacttgtgaattgattctgacattggcgccatgtatgcaaattcacagtacttcataccggcggcgaagaaaggcatcaacgagcagatcgagctggccatcctgcgtgcagatcggatgggcgtcaaggtgctcagcctcgccgctctcaataaggtcagttgttttacaaaagatctggttcgtttcagctttttttttcgattattatcacgaattatttatttatttatttattcatgtcaccaagaatacattttttaaatatttatttattaaaacatttaatttatgtatataatcatatagataatccgttacaataatagtccaataatttatgtatatttaatatttgctacctgtacatgtcttgtctcttccatgcctcaacttttttttccttttcctttatcactttcttgcaatgacacagacacgtacatgtctctttctttgatcataatgtgccgtgttatgcatatagttgagcagtattggatatacagcatgtataataagatacttgtccattaactagtacagtatcactgctgatgattcagtaggggtgttctgtttttcctcatctttcttcaactttctccctgtcattttcaaaagaaaaaaaaggaaaaaaaagagagtatgtgatgttcatgtcagtctctttgctgttcatgtgtcgcccatacagttgggcagcattggttatctagcacagactaccggaaccaattcatcatcatttatgatgggcatgtgaaatccttaactgattcaacgttgaaatggcggcgaagatggaaatgcgaccgtgacgcgtgtaatcggagtagatgcagcggtggctagctcataactaaaaaatctgcgttcattgttcagacagttaaaaagttcaggaatttcatctgatcagcactgtaaacagaatctttaggctagcaatctagcattactcaaaaatcaaaatgcagtgcaacgatctgatcttaactgaaactctttgaatcttcttatgttttggtttggtttcttgtttctgtcagaacgaggcactgaatggaggtggcacgctgttcgtgaacaagcacccggagctgagggtgagggtggtgcacggcaacaccctgacggcggccgtgatcctcaacgagatccccagcaacgtcaaggacgtcttcctcaccggcgccacctccaagctcggcagagccatcgccctctacctctgcagaaaaaagatcagagtcctggttcgtgctctgctgcctgtctgaactctgaactgaaccccaaaaaaggagaaaaaaaactctgtgttaattcacagcatgattagatgagtatgttaaacaagaggatgattgcaagactgggattgatggttctgtgtgctaatcttttttggttttagatgttgacattgtcgtcggagaggtttctgaagattcagagggaagcaccggcagagttccagcagtacctcgtgcaggtcaccaagtaccagcctgcacaaaactgcaaggtaattcactcgctggaatttcaataagtttcagtaattcaaggctgtgtccatgatgtgattgtccacattttctttcatcaggttttatccaccaaccagttaacctataaaacatagacttttgtcagagtcatattgtcccgctgaccaattaacccagaaaaagttacattttttgtctcagttgtatgcaccgaccagatcaccaaaagtttactttagtgtttattttgggtctagctatatttatggcgccaagttgtatgcactagctagttcgacggaaaagcttagggtaattttaccatctaagaaggtacccgaaagttaccgtattttctgatgtaaaatttagtacttccgaatactaggtatctcaagatagtaaatttttttaatgtaagatttaagtatcccgggttactttttcaaataccgtaaaatttatcagaagctaaagttggatggatggcattgttgcagacgtggctggtggggaagtggctgtcgccgagggagcagaggtgggcgccggcggggacacacttccaccagttcgtggtgccgccgatcatcgggttccggcgagactgcacctacggcaagctcgccgccatgaggctccccaaggacgtccagggcctcggctactgcgaggtacttcctccgtttcatattacagtcactttaaacctttttttataacaaaactctttttagattcgactaaatttatagaaaaattttgtccattattattattattattattattattattattattattattattattattatattcttcttctccgagttcgctgacatggtcggccggcgatcgccgggaaacatatgtgtgcagtacacgatggaacgcggggtggtgcacgcgtgccacgccggcggcgtggtgcacttcctggaagggtgggagcaccacgaggtgggcgccatcgacgtcgaccggatcgacgtcgtctggaaggcggcgctcaagcacggcctcacgccggcgtgaccgccgccgccggaggccagcggcgaagccaacgagaacggccggcgatcttgtgggatttggtgtgctgtaagatagaagaaatgtacgagaaaaaaacgatttgccgtgggatttaaattaattaaaatttaatcaaactccctatagcatctcttggtttggaaatagtcgagtcatctcttgtggcagacggatggtggcaaattcccctattgcttctggccatctttgaaattaggaatataggccccgtttggcacagctctagctctcaactccaacttacctagagccggagttgtgccaaacggtatagatccacctttttttgagtggagttggcagagctactcctagaaaataaactacgggggtggagctaggttttcgcgctccacatctccactccaccccaaaaaacccaataatatagtaaaacacacaactcgtggtcttctttgccgcgcaataatcatttcaatttccataggagctgtgaaaaaaaatgtcaaacaggacccgaaaagaattgggcaatggtagattgaccattgttaaaatacagtgaattgtacgttcttcctcggccgcttaaactttgcgtttaaattggttggcacatacagcttaatcttgccacttcagagttcagacatcacatgatcaagaaatgaaaagcccactctagaatggcccatgatcgacacaatcaaaattagttggaataagttcactttaggtccctctatttgtcgcccagtctgattttcgtccctgaaccgcaaaaccgggtatgacccatcccctaaattacgaaaaccggacaaacgaggtcccttagcggttttgagggtggttttggctaacgtggcacctatgtggccattttgactcggtcttcatctgatgtggcactgacatggcgcttacgtggcaatccgatacagaaaaataataaaacccgtgggccccacatgtcagtctcatagaaaaaataataaaaaggtgggacccacgtgggccccacatgtcagtccaactcatccctcctcttcttcctcatctctccccatctcccctctctccatctctctctcctctcctctctctccaagcgacggtggccgctcctctccctcccacctgcgggtcgccgcacgccgct

SEQ ID NO: 323 - DNA, 6196 bp, Oryza sativa
caattacttacattttttgaataagacaaacggtcaaagatttttaaaaaagtcaacggcgttaaacattttgagatggaggtagtattagttagcatcaaaaagggaacgtcgtggtctctcagggtacatcgatttgccctttcaatacgataaccatgcatgttgttatcgcctcatccgtgagtatgggactactcctaacggctaatacaaacctagggtgtgtttggttcacgatcatatatggatgagatatgctcatccatattttgttgaatatagtgatttaatattttttttttcatttggtttgtacgcatatgatgattcaactttttgtttgggtggaacaatgtagcatggataggagaagccaaaatttagtaggacccatttattatatatactctctatgtttcatgtgataagatgtttgacttttttcgtagacaaattttgttaagtttgataaagtttatagaaaaatatagcaacatctaaaatattaaattagttttattaaatctaacattgaatatattttgataatatgttttagataatattaaattagttaagagttctcttctgcagtcatctaaaaagagttcttctacaggtaattaatttggtctatagttctatatacgcatgtaggcaatatgggagaacaaaatggcaatgtataacaatatatgagaatagaatataaaacacttaatttttatttttatcttcatctccggaggattcaaacaccacctaactgatactgttatagtaagagattttagatggacccgcatgcggactcctattttaagctcatgattttctaaaaaataaaatatccaatcaaaatatcaaccagcgtcgctgggttggacgacaggagtaaaagctagctatcgtcttttgatccggccctgatcaatggatttccactctctcagctcggcctatataaagctaacgagtacactccactcccacagccatctcctctctactgtcaatctcaagtgcgtgcccggtatcagctcgaccggtctcgcacctgcaaccaaaccacacacagctagctatcatggcctctaagccagggcctctcactcagtggccgtggcataaccttggaaactacaaggtactaaattatgttttatcgtcatcatcagatttgatttgatgccatacgttgtttgtaagctgattgcaacaatgtgagtaattaacgactgttgcgtacgtggaaatctacagtacgcgctggtggcgccgtcggcggcgtacagcacgtacaggttcgtgacggcgagcagcgcggcggagcgagacctcctcaacttcatggtgttccccatgctgctcctccgtctgctctacggccagctctggatcaccgtctcccgccaccagactgcccggagcaagcacaagatcgtcaacaagagcctcgacttcgaacaaatcgacagggaaagaaactggtaattaatcgatcaaattgagtgtacgtctaagggactgtttagtcggtgaaatgaaaatttcgggtgttacatcttttgagattttgcttcagtctagcgaaaagtaccttaaggtaacggtatatcacagtactaaatcgtttttgttcgttgaatcaaactggacaggatggacaatattagatccaatcatcagaaacgacacctcgagatacttttcgttagactagagcatatctctaagttttttgggttttcatatttacatatatggatgcagggatgaccagataatcctgacggcgctggtgttctacttggtgagcgcgacgatgccgcaggcgcaggtggcaccgtggtggagcacaaaggggatggtggtgacggcggtgctgcacgcggggccagtggagttcctctactactggctgcacagggcgctgcaccaccactggctgtacgcgcggtaccactcgcaccaccacgcctccatcgtcactgagcccatcacctccgtcatccaccccttcgccgaggaggtcgtctacttcgtcctcctcgccatccccatcctcagcaccgtcgccaccggcaccgtctctgtcgtcacggccaacggctacctcgtctacatcgacttcatgaactacctcggccactgcaacttcgagctcgtccccaagtgcctcttccacgtcttcccccctctcaaatatctcctctacaccccatcgtacgtataaatttacctgtttaaaaatataccattacaatttaacgggattgctatttagcgcaatgttggttattttagtacacctttttttctttctgaaaactttcattcaaaaaacttatattggagaacttttacatgaaaatactttatatgaaaaagtgtacagtgagaaatatgagtaataattaattatactaattaactgctaatagagatcattaattagtgtatgtatgtatgtaggtttcattcgttgcaccacacgcagttcaggacgaactactcgctgttcatgccggtgtacgactacatctacgggacgacggacaagtcaagcgacgagctgtacgagaggacgctgcaggggagggacgaggcggcgtggcggccggacgtggtgcacctcacgcacctcaccacgccggagtccgtcttccacaaccgcctcggcttcgccgccgtcgcgtccaacccgcttggcgccgcagcctccggccacctcctccgtgccgcctccgccgtcgcctcccctctcctctccctcttcgcctccaccttcaggtcggaggccaaccgcctcgacaagctcaacatcgagacctgggtcatcccaaggttcacctcccacgtacgtaattttgactaatttttaaatacaaaatatactcatacaaaatctccatttctttaagtatttttttctcgtacaaaatatacgtatagtttggaatgtttgtttttgtgtatgaggaaatagtgaattaattgcgtgcattgatggaatcgcagtatacgtcgaagagtgatgggtacaaggtcagccgtttgatagagaaagcggtgtcagacgcagaagcaagtggcgcgagagtcctcacgctcggcctcctcaaccaggtaaatgcattcgctgacccacctgacagatccaattcattgcatgccttctcactgttcgccggctttaatgtaacagtaccagcagtaggtgcaacttcgtagcatcactctttcctctctgcactagctccccaagtagttacatgggaccgaattcacctaccaagatttacaaaatttattaggctgtgtttagattcaaacttccaactttttccatcacattaacctgtcgtatatatataatttttcagtcatattgtaccaattttaactcaaactttcaactttagaaagaactaaacacagccttactagcatcagacagtataagaatttttttttcatgtttctcaaaatatatctggacatcagttgaaaacgtgcataaatgcttatacaccattttggaatggatggagtaataaatttcagcagccagaggttcatatgacagtggcactttttacttcaagaaaaaggaacagtgtttagcaaatgttcgccccataaatctgctttggtcctgcacgggtatatgtcaggcgatgctaattaaatcgatccaattgtacgtgcaggggtacgatctgaacaggaacggggagttatatgtcgtcaggaagccaagcctgaagacgaagatcgtcgatggaacaagcctcgctgttgctgccgttctcaacatgatccctcagggcaccaaagatgtgctcctcctgggaaacgcgaacaagatctctctcgttcttaccctgtccctctgcaagcgggagatccaggtataataccaaaatgacagtactcgaccagttaatattcttaacagtatcgatcacggtgattaaaaaggttactggctgtaactaatttcgaacaaaaaaacaggtgaggatggtaaataaggagctgtatgaatgcctgaagcagcagctgcagcctgaaatgcaggagcatctggttttgtcatgcagttacagcagcaaggtaattgaaaattggctctgtttggatccgaagggctattaaatagcccttcaggattttgctatttaagagtattaaacgtagattactgacaaaactcattccataactcctaggctattttgcgagacgaatctaacgagatatattaatccatgatttgctacagtaatgctacagtaatcagccgctaattatggattaatatatatcattagattcgtctcacaaaataggctaagggttatagaatcggttttgtcgataatctacgtttaataatcctaaatagcaagatttcagagcgctatttaatagtccgaaggatccaaacagggtcattgtgggtaactggacgttgtggcgtggatgaaataaatcgaaactgcgtgcgtatgcaggtgtggctcgtgggcgacggggtgacggatgaggagcagatgaaagcccagaaaggatcccatttcgtgccgtactcgcagttccctcccaacaaggcccgcaacgactgcgtctaccactgcaccccggctctactcgtccctgaatccttcgaaaaccttcacgtttgcgaggtactccctctgtaccacttacttcgtccgtctcagaatatagttatctttagctatgaatctgaacacatatgcacgcagaattggttgccgaggagggtgatgagcgcgtggcgggcggcggggatcgttcacgcgctggagaagtgggacgggcacgagtgcggcggcagggtcaccggcgtgcagaaggcgtggagcgcggcgctggcacggggattccggccatacgacgaccaccaccaccccggcatcacccatgatggccgtggcgggctgtgaccggccggtggccggatcgaagcaacctggcctgattgtgtgatcttgtgtgtgcttcttcgctcggttgatatataggagtatctccgtgtgtgttatgatggggccagattaatatccagctataaaatcccaagctgtattgttaattctctgccggtgtcataatctattgtttgagcataacttaaatttgagcatgattaatttggagatactctctgtttcccacttgctactgtaatgagtactttcctacagttttatcgctacgattgtacttgtagcggggtagcggctgattatcgatgtatatatccaccattcatcgtcacaagcacggttgattatagagcttctagctccattcaagagaagcggtccttttcctaatatccggcgaagcttccttaagatgtggctgatgtggttgaatctagtcgagatgatctcaacctctcttgcaaggaggccccttttgggtatggtcgctggttttctttgcagttcacaatgtttattctctctttcattagtggtttggatctaaccgtttttcttgcaatggttgttgttgggttgatcttgcgaaagaaatttggcgaaaatcttcggtggtgtggccgaggatcaaattgtttgctagtgcctcaaccttcgtatacgagaggtcccttcagggttcatgaataggctctacctgttgcagctcgccttgttttaagccccgccaaaatcaagatcaaagcatttattatcagcgtcgtaggcaaacaaaggagaatgacccgattacctttttattctctttgtagattttttctgcagaatgttgatctaaagtataacttgcctattctagatgggcttctgtgcaaaactggatataccctactgaattatgctcgacgcactactgcaactcatgtatcttgttcttctccctctgttgtaaaatgaattctgttctgaatttgaatctgaacatacgctatttgtttaaaatctaaaaccttaatgtttaaatcatgctcagtgctcaatcctatcaatttcattgtataatatgacttatatagagagagaaaaagaaatatcgttaggaagtatggtgatccgttttcaatagttaatgtgtaaaatgaaccaataaaatattttaaaggagtaaaatgaatcttttttttaagaaaaaaaaatggaaccgatagacagac

SEQ ID NO: 324 - DNA, 5347 bp, Oryza sativa
ttggtcgagaaagggattaatgatatttggacggacgacatatgtccacggttgattggaggagcctagctggctccttccgtttcggaaaataattaaagctcttaaccataattctttttcaagaaaaactttcggtactcatccgatttttttttcgcaatttttagcgtctccttttttttcacatatcactaggacgtgtgatagatgttgggcttgttggcttgggctaaattgcaactagtcgtgaatgtggctggatgcagtacaatattatctttacaaattttactgcatttgttgtaaatgctgtggctgtacagccgcagctatgtccaccgaacacacccattatgtaagagctaagatgtggttttacacttctcttatactagcgtagattttctattattaaatcatatgttctagagaatattgacgtaccatataaatataggctaaccctttataaattttccgttagaattatatagatggcataactatacggagcaaacaatatcatcaaacgcgagcgacttccccatggtcaacaaatttaaatttatagacgtcaccatactgaaggcgttggtgatgaagctaatccaagctgcactatcgtatagggtaaaccagaatcgtaatactacacagtactatcacgttcaaaaattttggtcgtagcaaaaatttatagccatgaccactttataaaatgtaaacataaaactgacactaaaaatattcactagccaacacatgcatactaaaaccgaaacacctctaacatagctaaacaaggaagctaataaatctcttatcaacaaggaaatgataaaccctttataaaaaaccaaggatatgataatgataaacaatttagtagtacaaactttttgccttttcaagcaacaaagggagatcaaaatcttgagatttgtgtgggtcctcccaaaagagaagaaaagaaaataaagccgctcctctcctcctccgtcccaacggagaccagtataaataacgcaccattggaggaggagatctctccctctcatcatcatcatcatcctcctcctccctatccccttctcccccctctctctctctctccaccccgcgcggcggccgcttccgatccctctccgaccgaccaagcgccgcctccaaggtatttccctctcctgatcctcctccgtgcttggtggtggtggtggtggtggtgatggtgttcatcctctgtttgttgttaggggggaagaaaatccaatccgtaaatcctgggtttttcttcttcttgtttttttctcctcgggacgggtccatccttccggggggcgattagaggtttgtttccggtagattttattcagaggattggagctcaagtgctgaaacccacatgcatgcatgcctgcctgctattgtgttgtctgaatacgaaatatgcggggggtctctagcttgccttgccccgcgctgttaggagtagttgagatggtgtttccggatgagctctgcacttgctgctactgttacttgttactcttaggagtagttgagatggtctgcttgtaatatttccatcagagatcatggtggcaagaagattattggttgctccatgcttgaacaggctgatattgccctgtataatctttttgctgtgtttttggagtttgtcttgtcaaaaaggcagtgctcaaatggttggttggaacggctaccatgatgtggggaacgatagaaatgggcttaaaaatttcatccatgagtgtgctgtcatttttcttttttcaccgagagagagaaggaagcattgcttttcagatagtaacatcttcttgtcttatttttggtagtgagggttcatgttcttctccatatgctaactgttggaatgagctggatctacaggaatatttaacttataaagattagggactgagtgcatgtgaccattattggccgttgacgtgctggatttattttttttttgttcatcattagtttcaaagattcctctccccgagtagctattggttatgcctttgtgttctctttccatgaattatgtgtgacatgtgagaaaagaatcagtgattcactctttcagaaattggatggacgtgtagaattaataaggcggcttgtcatgttccctttatcattctctctgtcaaaaaaaaaacggtgctactgatctttcgattgacgtatccttgtctgaattttacgcttttttttctcatgtggtccatgaaaaaaaaattattttggtgctaaacttagctatcaatgttttggccaactcactaaatttcttgcatatatatcctcttttgcatattgattcagattccttctttgacagaatggggagctcggagaagaacggaactgcttatggcgagtacacctatgctgaactggagagggagcagtactggccgtctgagaagctgaggatatcgatcaccggagctggtggtttcattggatcccacattgctcgccgtctgaagagcgaggggcattacatcatcgcctccgactggaagaagaatgagcacatgactgaggacatgttctgccatgagttccaccttgttgaccttagggtcatggacaactgcctcaaggtcaccaacggcgtcgaccatgtgttcaaccttgccgctgatatgggtggtatggggttcattcagtccaaccactctgtgatcatgtacaacaacaccatgatcagtttcaacatgctcgaggctgcacgtatcaatggtgtgaagaggtccggctctctcttttttttttacatatttttactgttatatctcagcttagcctgagcttgttttatccatatcaattcatttgttacaactaatggtcctacaggttcttctatgcctcaagtgcatgcatttaccctgaattcaagcagcttgaaactaacgttagcctgaaggaatctgatgcctggcctgctgaggtttgtccatcaaaataattttaggctttagtgttatgttttagtaaaaccagaagttgatttcctactgttttaactactgtccagcctcaagatgcctatggtttggagaagcttgcaactgaggagctctgcaagcactacaccaaggactttggcattgagtgccgtgttggccgcttccacaacatatatggcccctttggaacatggaaaggtagaagtttaaccaattctccaagttattgaactgtacttgtactggggcatccttaactcaatttgtcaatggataggtggccgtgagaaggcaccagctgcattctgcaggaaggctcagacttccactgacaggtttgagatgtggggtgatggcctccagacccggtccttcacattcatagatgagtgtgttgagggtgttctgaggtatgcagctacttgtcacattattatctagatagaacactaaaccacacctgattagatgagaagctggtctaatatgatacaaacaatttctaggttgacaaagtcggacttccgtgagccagtgaacattggaagcgatgaaatggtaagcatgaacgagatggctgaaatcattctcagcttcgaggatagggagctgcccatccaccacatccctggacccgagggtgtccgtggccgtaactccgacaacaccctcatcaaggagaagcttggctgggcacccacaatgaagctcaaggtatctatccctgttctgctaaatcttctcacatactacaccaatcatgcaatgcctgtaaaaattctcaccgtcagatcaatgacaagattagaatagacaatacctaatatcgacaaatgacgatgaacaggacgggctgaggttcacctacttctggatcaaggagcagatagagaaggagaagacccagggcgtcgacatcgcgggttacggctcatccaaggtggtgtccacccaggccccggttcagctgggctccctccgtgctgccgatggcaaggagtaatttcaaagctgctacaccatgaagatcaatcagctcctctcagcttgatcgtggccataccttacttcgctacagatagctcacagaaatgaattcttcttggaaatcttgcaacctttcagaacaacaacagccgttcttcctgtcgttataactcatatgcagtacaccggtttcttgtgtttaaaaagctatactcgagatttcttcctcttttttttttcgcgtcgtgttggaaattcttcgtatggattacattttgtcatatgaacaatgaaacaatgggaatgctctgcattacctttatgaatagatgatgtgttcttcctactctcctctcatcataagataagaagtaaggccttgtttagatcctaaaaaattttagccaaaacgtcacattaaatgtttggacatatacatgggatattaaatgtgggaaaaatttgaccatgtgatgctacagtaaatatttactaatgacggattaattaggcttaataattcgtctcgcagtttacatgcggaatctgtaatttgttttgttattagtctgcatttaattcttcaaatgtgtgtccgtatacttcaaaaattttacacccaaagaactaaacacaccctaaattagtatcccggtgcttcattatcactaggtaggtggcatagactgtagagagacgctgacagctggggaccacctcgtgggtgggccccaccgtcggtggaaccggatattccttgggtgtgttgtcttgatctcgtccgagcgaaagacgagcggctgctccggccatggcgcgtcgctgttgtacgttttttttttgtcacgcgcggcaagccggactccggtgaacggcggccaccggttgtggatatacacggcatggggggtttacacacttgcacgtcataaaagggtacagcgttgcgagaacgagaaaacgattggtagggacgatggtgacgtggataggaccgggggcgtgtaaattcaatagcaaagattgtactacatcaaaaaaagtagtatagtactttcttcgtaaaaaaacataaaattagatgtaatgattgaacaccagttttgtttactgcattaaggccccgtttagttcgcgaaatgaaaatttttaggtgtcacatcggacgtttgaccggatgtcggaaggagttttcagacacgaatgaaaaaactaatttcataactcgtctcgaaaccgcgagatgaatcttttgagcctaattaatccgtcattagcacatgtgggttactgtagcacttatggctaatcatggactaattaggctcaaaagattcgtctcgcaa

SEQ ID NO: 325 - DNA, 6809 bp, Oryza sativa
agaggcctgttagagtttgtccaaatttgtcgtattagattgtgcctaattcactactaggttgttatattttgatatatatgaagtacttcctccgtttcatattataagactttctatatgaatagatttattaaaatctatatgaatggaggcaatgctagaaagtcttataatatgagacagtcttataatatgagacggatggagtatctaagacggtatgcttagttgattccaagtgattgttaaagaagcaacatgttaggtggagtacttcacaagaaaagtacaggagtttggatgaagtcactccaaagtactccctccaactttttatatgactttggctagttcaaatttatactagcctgcatcatatatatatggatgtaggtaatagttttataggaattaggaatggtaaatatcataagcgtcaagtagaaaagaatccataagtttctcgtcccatgaaattcatctttttttttctttactcgaaatgcaagaattgttccctcaatatttcctacgaattgagctgattctcagaaaattctgcaaaaaatgtacgaaataatttgcttgtaagcaaaaccaattttgaagtaaaccaccgaaatttggtactctttctatcccataatataatgtacattcatatttggtttggtttctaaaaataatctttgatttataatttctcatatactataaagtttgtaaattcaaatgtcaatctaattatattattttgaacaaaacaaaattcgattcatattatactcacggttaaataaaaattttaaaaactaaatcttaaaatacgttcatatcttatgttatgggattgaggtagtacaaaagtttttggatcttactccagctaggaagaatttgaaagctgtgtcctggctaaaacgtaagtcaaacaaatctgagattctcagggaccagtaggtgaatcccaaaccgtggagggtcaaaaatgcaaaatgaacgaactcgttcttcccctgttcttctcgaatgcaagtctaacctctatataaagaggaagaataaaagcaaaggagatcctgtgggggtgtgcaagaatctacctcccctccccaaatctcgctcccacgcctcttccttccgacttgtgacaggtaatgccccgatcccccgcggaaaaagaagttctttttattggttattattaattaatcccgtgtgttcatggtcctagaagttgattgaacggattggtaatggttctttcttgtttattaatccgccggatttctgctgttcttggcttgttcgattttggcctggccattttggatcggtggctttaggatttctttttttttggccaaagactccagatttgttttggggaagagaagaggatttgttaagcttggacgcttggttggttggtggggagttaagcaagtagtattagccaagctggagatagctgctgtaaatttctatcttttaatctgtgattttgtggattaaacttgcccaaggatccatttctaccgtctactgcgttccatatcatgttgctccccccaaaagggacctacttgctttggtgttggattggagcaggggatcacatttcttactatcttttcctgaaattgaggagatcgcacatggcattccgtaacttcgtattcgatgaattattgtgtgtgggattgctgccagatgcagtttgtacaatttagtatgagctaagttaagggtttagctttaatagtggcttgtcctttgagggtttcatggcaacacttggttttgactacaaagtttggctgattcatgtgttattgattgaatatacatggtcaaaacatatccttgttgtggtttttcatatcaaattctgtgattttagtagtagtagtctttgactgtgtctagaaacatgtttggcaatcagaacttttgtttggtagccagagcagattggttgtttgctttagaagtttataatctcagcaaggacaatgtatacctcttgaacggtttgtcgtcttaaagcttgatgaatatgtgttactgcagaatggcgctcaatgaggagtacacatacgtggagctggagaaggagccttactggccatttgagaagctgcggatctcgattacgggagctggcgggttcatcgcatcccacatcgcgaggcgcctcaagagcgagggccactacatcattgcttctgactggaagaaaaatgagcacatgactgaggatatgttctgccatgagttccatcttgttgatttgagggtgatggacaactgcctcaaggtgaccaccggggttgaccatgttttcaaccttgccgctgatatgggagggatgggattcattcaatccaatcactctgttatcatgtacaacaacaccatgatcagctttaacatgcttgaggccgctaggattaatggtgtcaaaaggtaacttttgaactggtgctggctctgtaaatcccatgttttatttttcaccaattgatgctataggatgctaagatctgttaaggtatataaagcctatctacagaaaaacatagaaatggaaatcatcacatagtatttggcgggaatcatctacctatttgatttgatatgctaatacgatgtattaatttgtgtttggctgaagctgcaactttgggaagtgaatgccacatgttagctatcattaatttagaagcgttagaattggaatgtgtgctgcgtagagaatctatgcgtactgagcttggattgacctggcctgtattggaaagtttcaatcaggggcttcctgctaaacgataagtttgatgacgttaagagaaagtgtggacaagtattactatttctaggcagtgcagttgcatatagcagattaatgtatatcaacataatgggcatggattgacctcaatgaggaaagcataaattagtagaattctacttggtggttggtgctgattgatgatttttggtgtgccttcatttattagtggatgtcccttatgggggataggcagatagggggtttctatgaaaacttttcacctataggagctttatgaactgttggggatcaaggaagatattagaatctttcaaatattatctaaaacttgcatttctctcctggtcaacaaaaatgcacttcaaacatactccctgcgtttcataatgtaagactttctaggattgctcatattcatataaatgttaatgatatgtgtctagattcattaacatctatatgaatgtgggcaatgctagaaagatttacattatgaaatggaggaagtagtattcactggttgtaatttccaaaacaaacagcttttgcagagaattgtgttcaactctttgatagaaaaaaacgagtttgttgagttgactgtattcttttcttttttcagtctatacattgttatcatttcattgttatgcttcctggctttcatagattggcatggcttggggaagcaaatgaaaggaatggatcatacgtagaaccctagaattcctcaaaacagagcatttactttaacaatcctgtcatgttatcatcactcagaagaatcatcattttggttattttttttccttgtaggttcttttatgcttcaagtgcttgtatctaccctgaatttaagcagctggacactgtagttagcttgaaggagtcagatgcttggcctgcagaggtttctaaactttcccactgatatatgttctgttgcaaattgatatgttaattattgttacaaaacagcactgatttcagtaattaccttttagcctcaagatgcctatggcttggaaaaacttgctactgaggaactgtgcaagcattacacaaaggattttggcattgaatgtcgggttggccgctttcataatatctatggtccctttggaacatggaagggtaagctacatatctggtacctagtaaaacttgggtattgttactgtagaagttataataattgattggctctacaggtggaagggagaaggcgcctgctgctttctgcagaaaagctctaacctccactgaccgttttgagatgtggggagatggtcttcagactagatccttcacgtttattgatgaatgtgtggagggtgtcctcaggtaaacattttaatcttatttcttctatgcacaatccagttattcagcatttccatatcttagtttaacaccaagcacatttttgcatagatctgcttttgctactctgatcacgccatgttcagatgataattgaaggtttacatgtatattaattccaagagaagtatcagttgtttgttaaacttctcgaagttttctaaatgttatggaatacttatttgatgagcataattttagattttgagaaacactttcctctttgtgtagttttcttaattaccacttgtccaacaggcaatttattggatgagaaacagagtctgttggtccctctagcttgtacataggaccagtagactgggagcacattgattggttcgtcgatctctagtctttagagaaatcaatgcgcgtcattgcaaattctgtataaatgaatatgctagtatctgaaatactagaattgcttaacatgtctcaattactagtaatgtcaccatgtgaggctggacttttatggcatacaagtactagcagttcaatctgccaaaatggtgtatcgctgagtggttcttctttgatatagttgctcttaaatatatatacttacaaaaaataattgagaaaataaaaaggtaaattttaaccattttgttcttgagccttgaataattatccttttcaccctctgtctgcttgaaggatcttccaacgctcataaagtcagtgacacaatagagcttggatttaactaacatcacagcataccatgtgatctaaagagacataccaatttgtctacatttttttttgggggccggtcgaccaagtcattacattgccaaatgcattcaggttgacaaagtccgatttccgtgagcctgtaaacattggaagtgatgaaatggtcagcatgaatgagatggctgagatagtcctcagctttgagaacaagcagctgcccatccaccacatccccgggccagagggtgtccgtggtcgcaactccgacaacacgctcatcaaagagaagcttggctgggctccaaccatgaggctgaaggtactactatccctgattttcaggcaaccatctgcctatcagttcatcgccccgaattcatgcattctgatcattcatcggaaacttgattcttgcggcgcaggatggtctgaggatcacatacttctggatcaaggagcagctcgagaaggagaaggccgagggcgtcgacttgtcggcctacgggtcatccaaggtagtgcagactcaggcgccggtgcagcttggctccctccgtgctgctgatggaaaggagtgagctctcaccctgggcaggaaacaggcatcatcatgatatagtgctactggtttcagaatttttcagatgccatatgatggttgccagccaccaccatctatacaatttcttgattctgttttggacttcacttcctgaaagatcaaagtttactagtctgcaattttcacttctttgtgttgtaaacgagggtaaaccgcttttatatatatacaagagggtgataatggtatagcattacaggggggaaaaacttcacaagaacaatggaattaagaatgaattcaagatatatgtggcctgagctgtgttaagcattcttaggctgtgtttagttggtggaaaaagtgggaattttgaagaaagttggtagtttgaaaaaaaagttagaagtttatgtgtgtaggaaagtttttgatgtgatggaaagttggaagtttgaagttggtggaggggaactaaacacggccttaggatatgttctcccccctcattttcgaaatcattttccttgttttccgcacgcgactacgcgagcttcctaaactactaaatgatgcgtttttacaaaatattttctataagaaagttgttttaaaaaatatattaatttattttcaagtatatttagctaatacttaattaattacacattaataaaccatcacgtttttcgtgcggggaggtggagttcctcccgaacgtaaccttatttcacaccattttctgagccgtccaatttacatccaatggtactactgctactggttaagttgcagtcatgactgcacctgatccaaatccatgtagcgtctacatgaactattatggaaacatgtatcccgccatgtcatccactcacctaaccttttacttgcatgtgttaccctaaaacatggatgggatcattcaaggtgagctcgtttcagcctataggattagattctcctcgttttctgttagcacgctttttaaactgttaaacggtgtatttcgtgcgaaaactttctataaataagttgtttaaaaaaatccaacaaatttatttatcaaaaatatattaacacaaattaatcatatgctaatcacatttctcattttacgtgcggctaatcagcccaacctatctacagaaacgagcgcaccctcaatccaaccatgtatctacaaaaccaattatgcaccataaatttgtgtttgactgctgtgatgtgggttagtatatagaatctgtttagctttgtgaaacttatgaaaccccactaaatctaggaagatcgtattatccatcatatctcaaacaaaatactctcaagttt

SEQ ID NO: 326 - DNA, 4756 bp, Oryza sativa
caaacaggatgacaatcgtgataaatgcatcggtgtggatcaagtgagtattcgaggccgtgtttagtttccctctattcccaactttccatcacatcatatcacatcaaaattttttctacacatataaacttttaacttttttttcaaactcctaacttttttcaaactttcaacttttttcaggaactaaacacacccgactctccaacatattctactgtcgtacatgcgcatgaacgatgaataacgaaacatatacgtacagcttttgtcggactcaaaaaattcgtactctcttcgtcaaattaaactaatctagtataagattggaacattatattaaaatatatttattttatatcagcttattttggaatggttgtattaattcaattcggataacatgacggaggactgttatcgtcgttggttgcatcaacaaggctcaacctaaaagcacaattatctgttgcagaaaatcctccaccttcgcatcctgtcctgttgagacctgaggtacccttgcagtggtgcatccccctttctttcccacttgaccaccttgtttgattaatcgcttaaaagctgcaggtgtactaatgaaagtagtactagtatacttaaccaattgaccatactcttcctagaatggcgaagagcaaatttaatagtaaagctcactgcttactataaatttagagttaacttatataataagttagttgtaaggttaactttattttttctataaggttaactttattttttccattctctctctttctcactccataaatttaatgcatattttttggaggttgtgtggagctaactcttgcatgagagccaatactacccacttttccttatctctcttccacataaagtatatagtttgcttatagcccattattatccttgctcttatgagggggggcgattagttaacgttaagcacgcttttacgagcgagaagacaggctgtcacgcttttaacagcaaacacatcacacattaatcaattcgcctccagcaccaagccaaccgaggctcttgggagttgggagttgggactccctgtgcctctcctctccaccgcaacgaccacaaatcaccatctgctttctagtttcttcctgaagttctgcgtcataaaggcaaaaatccaagattgattttggatgaaaaagactgcagtgcttagcaagtgttctgttcttggagtcgcaagctgcggctagctagcaagcaagcagctttttttttttcgcagatcttggtgaagagcctgttcttccatggctttcgctttgtgaggtaacatgtgttttttacattctggaatatgagtaggagtatatacttgaaacaataaggtaccatggcatgcttgtaaaatttctataccatagcaccgtcagatttttatggtaaaaaagaacagatttttatggtatttgttcagttctctttagtgagatccttgtgtttaatttgcagagaaaagggtattgttagtcagtaagtaaaagggtggatcttgttcgaagattcaagagtcatgttggattctggttcttatgatgatgttgactatggggatttgttctccatccccaatccacctgcgcctcacttgctcaatttccccctccagttcttcccttccaacggattcatcagttctgctgatgattcccatagatcaccagctggtatgtttggctcgaccccaagccccacatcaaccacaaccgagttggaaaattcagaggatctgtctgaatccgccgacgatgcggtcctagcatacatcaatcagtttcttcttgaagatgaggaagatgaatcttgtcctggcaccatcacatcggtggaggactctgccctcctcgccgtcgagaagccattcgttgacatcctcactgctagccaagaggcctgtcaagagaattcttggatagattcttgttgtgatttcacggggaatggaggattgcttgatacgttcacaaccacacatgccgcttgccagccagcgccttgtgaatttgagaaggagaagggggagtgtgctgttcataaaggccggaagaacccgcatgatgattgcctattgttcgaggaagagagcaggaggagcaagcagttggcagtgtctgaggaggagactgtcagagagatgtttgacaaggtgcttctgtgtaatggcgaatgcgagctccgggcaccactgccagctgaagcacggaactgcggggtgtacgtgaaaggatctggaaataagagaggccgaaagaaaggaaaatctggagcatctgcagaggatgatgcggttgatctcactaccctactcattcattgtgcccaggccgctgcaatcgatgatcaccggaactccaatgagttgctgaaacaaattaggcagcgttcttctgcatatggagatgccggtcagaggttagcacattgttttgctaatgcgttggaggctcggctagctggcactggcagcaacatttaccgttcacttgctgccaagcgaacttctgtttatgacatattgaatgcattcaagctgtatgttacagcatgcccgttcaagaaaatatcgaacttcttctcgatcgaagccatcttgaacgcatccaagggtatgacaaggttgcacattgttgactatggtatacagtatggattccagtggccaatcttcttccagcggatctcgaagagacctggtggccctccaagtgttcgaatcaccggtgttgacttaccacagccgggattccgccctgcacaactcattgaggcgacgggccgtcggttgcatgactatgcccgtatgttcaatgttccatttgaataccatgctattgctgccaagtgggacactatccgtgtcgaagatcttaagatagacaaagacaaggatgaacttcttgttgttaactgccttttccggatgagaaacatgatggacgaaatggtgacagatgacagcccaagaatgcaggttctgaagacaataagaaagatgaatccaaatttgttcatccatggcgttgtcaatggcacctacaatgcgcccttcttcgtgacacgattcaaggaggctttgttctactactcttcactttttgatatgcttgaaacaactgcttcacgggtcgacgaaaacaggctgctgatagaaagagatctcttcggccgggaagctcttaatgtggttgcttgtgagggcactgagagagtagaaagaccagagacgtacaagcaatggcaggtgaggaacatcagggcaggcttcaagcagctaccactgaaccaagagacggtgaagaaggcaagatacaaggtgaagaaatcctaccacagggatttcctagttgacgaagataacaaatggatgctgcaaggttggaaggggcgtatcatctttgctctttcagcatgggaaccaaactagcaaactgtaaatatgactaactcagctgatttcttctgtggaggtaccactccattagttatgtctgattcctatttcaatgaattttgacctatttctgggcaatagaagatattggattttgactgggctagagtatactttggatgagtatctgacagaaaaggatatacttctctctaagcgtgtgtgacctgtggggctcaaaactgtactttgaaaacacaattacacatcatgcatgtactgttcacatggtccagcctgggcaaagggttaaagcctacatggtgaattggtgatataaataacgaaatggtttatctgcaacttgatatgtagtagtacagcgtggatgtaaccaacttgcaactagttcaatgaaccaaaagaacagcacaatttatccacccaaaaacaaaagcccaacttgctcataatgtgctaatgtattgttcagtgcaatgcttctgaattcaagtggcgcctcaacatatttttcttctgtacaacatgagcacggagcgggcccagactgttttttcttctgacaattaatgtttgcattgagaaacataagcgtctcacactctcactgatcccaaatcgtcaaatttgatgagaggccctagagatccaaagaaagagcagtatattgatccattgcacgctgcctttccggtgttcatccacaagtccacaaccccccgcaccatcgctgcgttactggagcacgaatcatgcagcggagcggacaggagaaagctagctagccgcgcgcattgccggaaaacgcgcaacttgattttactttgggtggcagattagctgggagcatgtgtgtgtggagtaataggaatgcatgcacacttcaattcataggatttttttcatgaggtttgtgtggatgaaaattttcccttgttttctctccacaattagaaaggaaaatttattttggttttcttatatctaaattcctatgaaccgtatgatattcataagaattaatccctagaaatccaaatcctttaaaattcctccaaaacgattaggccctgattgttatctttgtatccaacttctgggccgaactatatctaggccctgcctcaggtggaggcctttctgcataaaaacgcttggatttgcaatacattcactaggctttgaatagctgatttccaacccagacaccaaagtactaatacactggtaaaaactttactataactatattttttatgccactgacctttgccatatcaataatgtattata

SEQ ID NO: 327 - DNA, 3019 bp, Oryza sativa
tacggtagcatcgagaccactcctttatataacagtgattgtgtgttcgctcccggctaaaactctatggaaaaacagatcttttgactccacggtaacaaattatggtgtgtatttttaactgccttaattaattaggaaagaaaagaagagattgatgggggaggaatttgtacgtacgtacgtacacatgtggtgacagccaaggaaagggtgagggggggggggggtttaagttttgatctaaaggttaatagtatcgggtccaccgttttaaatgaaaattgacggtcagatatttttcttttttcatattttttctctaatttattaaagcgccacgtggtggcttaggagcgtttatagggtgacacatggcggtttagaagcgtttgtaggaagtttaatgaacttttagtatataatatatatgactaattccaggtaaagggaaagtacttactaacattcacctatactaaactttagtagtgaatgacttgtttgccatagaagttgaccagatgcttctgttaattgcagaatatgtctctgatcaaatgatcaatacgtattgtgcttgatttgggattgttcaatgttcatttgggctgaattaaccaggaaagggagcacaatggacaaggctcaaatatatgaatggaggagctaccactagctaggtgaaaaaacatgcatgtacaacgagtaatgcatgagtcaagctaccagcggcatacaagcaagtcaaagaattcacatcaccaacagattgacaataaactaaactagacaggtgaaaaataaacaaagtggtgagctagtgctaccccccaaaaaaacataagtaaaaccgagtaatattgggttggaaccccaaaaggacctcattggcttggaagtggcctagccttccttccctgcccccctaaatttaccattgtacccctcaccctcctctctatatatacatacccagcacccttcactcccttctccaagtgttcaagctcacctcagttgattctagcttagcaacacacaagcacacagctagctagctcagctctctgtgcttctctagctaagctaatcgttttcaggcgaaggaagcacacacatctccatttgtgcatcagatcaccggccaggtcgtcggcgagaatgcagtacggagcggcggccgagcaggcgtggtacatgccggcggcggcgccggcaccgatggtggagagcgcggtggcgcgggtggagcggctggcgtcggagagcgcggtggtggtgttcagcgtgagcagctgctgcatgtgccacgccgtgaagcgcctcttctgcggcatgggggtgcacccgacggtgcacgagctggacctcgacccgcgcggccgcgagctggagcgcgccctggcgcgcctcgtcgggtacggcggccccgccgccgcgtcgccgcccgtcgtccccgtcgtcttcatcggcggcaagctcgtcggcgccatggaccgcgtcatggccgcgcacatcaacggctccctcgtccccctcctcaaggaggccggcgcgctctggctctaggcctcgcccgcccgccattggcgtgctctggcttagcccccctagtatacctagcacgcaaaaagctttacctgctgctgctgctgctgctgctaatgaagaagatgaagatgatgatgatgactagcaagtagttgattgatttagctgctgctaataggatatccatcgatcgagatacagcccatttacacggtgctagctaattaatcagtgtgtgagtgagtgtgtgtttgagagtgagtgagctagagctagaagaagagagatcgaggttggtgtgtgtgtgcttttttcttcacgacgactgcctctgtccgtctcgtgcatgcttcgcgcgcgcgcgcgcgcatgtggttgtttgttggcgcgtgcgctggatttgcttgctttgatgctgcatgctattgctagctactgaaattactactaccagtgttttatttatttcatctccccttaattaattctgcttatttcgtcaaaactatctgagtctttgaccatccgtcagtatgtatggtaaattaattagttacagttcgaatacttaaactcaacatagaaacagtcagcatattctcatcgccatctgaaactgaaagaatgaaacattctcgaatctagttcagaatgagtgcagagcagaacagaagcatgtatgtagctcctacgacattcctgctacttttgattatgcgactatcaaggctcaacaaacagtgcaagaatcaatcaaatacactaaactactactgcccttttatgaccacgtttaattactatagtttttttttctttgcttaattcatttcttaatgtcttcactagctagctgggccttcttcccccgttctgtttttgttttctcttcatctctccgttcgaggtaacaactctgcactgttttacgtctcctgtgtctgcttgcgtaacgtccttttgcttgtactgacggtctctcctgatctcctatccgaccaaacaaattgtactttgaagatactctcactttgcagtagtaccaccaccgctgcataaaaatgtagcatgtacaaggaaaaggtataggcatgcatgcatgtaaaagctaaagtccaaagatgtagttacatgtacaattactgttactgacataacaaaaggaccgtggttaattaacatgatgacatatggagggcctaaaagtgttgatttggaaagatctatcggtctggatgtggatcaaaattattcccatgcaaatcgcaacatctgccgcctataaaacctatcattacgtaccttggctatcatgttggtcgatctggcccccacatgggccattttttttttgccagctcatcgatcgtccccgttgcctcatgcatgcggtgagcttaataaaatgtttctcttattatgatctttgtgttatttatgatctcctagaccagagtgctaaagg

SEQ ID NO: 328 - DNA, 5876 bp, Oryza sativa
ataatatgatagttttcaatgaattctaatcaattgtattgttttaaattcaaattcttaaaaactgttcaaattttcctcgcaatatgctttcctcccacgtagaaacctcaagtttttccttttttaaataaaataaaattaaaaaaatgtgaaccttgcttgtcacctggtaattgtactagattgtgtccaatcatatcttgggttactctattttataatggagagagtgctattctattcatcacatacaaggtgcacatatacaattttgaaaatactacttgtaacacacgctctaaggaacggaggcggataataatcattttctcagtaaattcacatacacaaagatgtctcataggcatcatgacttgagtatggtagatggtgtcatgatctcacgccgtgtctatcacctttgcattttggttagcattctctcaaaatattatctcaagacagttaccaatgttttgatagaaaaaagacgattactacgttaaagacctctctaattagagcatccgtgttactcctattttccccatgtgacagaagatccggggcccatgacgatactacgaatctacgaccccattggcacgacaaagaacagggagtggggtctttttggtaggatgattgaatccaacaaaatttttctattcaattcttttcgtttttggacctctccaaagcatcggtgaagtttaacaatttttttccttttacctctatgcttggaactcataataaatcacccactactgctgataaagctgccgctcgggataaataatttttcccgcaacaaacatcatcaagctcacccacccactgacatctgggacccacacctcctggccccacaagtcagccaatactgacccaccctcatgtgcaaaaaaattacgtaacagcaacgcacctaccgcggctgatcagactaaccgaatatattatccccggaactcgaaaagcgggatgttgttgctagggttcaaccgtataatcgtacgtatactgtacaggtacagatatacgcgaagaatcattttctttttctgaaaaaaatacagatatactcgagtatactgtgcgtgccaacttgtttcttccttccggtcgtcgtcgccattatattgccgccttccccgatctccaagccctcgcaccaccctccttgttacagctgtgccgcctcttgcttcctcctcctcatcgtccgccatggcttctctcaccgatctcgtcaacctcaacctctccgacaccacggagaagatcatcgccgagtacatatggtactatgatattattgttatcttcttcttcctttcggatctcttcttggctcttggttttgatggttcttttcatggcgacgaacgggttattgttttcttggttttgatgggtagggatatttcgggggatttcgggaggggtgctcctcatagtttgtgcggattcgtagaaggtttcgtttcttttcgcttttccactcgatgactgaagcggcggcggcggcggcggtggtgatcttgttgttcttctcttcctctcctctgctttctcctgttcatgtcaccaccgagtaaaaatcgttcttttccgtttcttttttttttcgccgtggattactgttcaaccccggttttcttgatacgcttgacgagagatggagattacgagtacgagcagtactctcttagtttttgtccttttgggggaggatgatctctgaagtggcagcctctgtctgccacctggtcctctctgcgccaccatttggccacggcgagatgctctcttgttcggttggtgcatggatttaaatctcatcccctaatcacgcgtacttttggtcaaagatgcaaagctttcgatcttaaccaccttcagatcgcaagattactgttttttggtgctcattaagccatggtgataactgataagtggtgtttttctttttctccttgtttttaatgcaggatcggtggatctggcatggatctcaggagcaaggctagggtaagataagattcccagaacaaggaccccatgatcctgtttgttactactcatatgtcttatcactttttctgccaagttatccactggctgagctgttcttgcgcttatattatcatccagagccttgctactcctaaacagattagattctcttttttttttatcaatcatattaaattttggttggttggtggtgcagactctctccggccctgtgactgatcccagcaagctgcccaagtggaactacgatggctccagcaccggccaggcccccggcgaggacagtgaggtcatcctgtagtaagtatcttttcatggcaaatcagagtgaaaaaaataaactctgtttttttaattatgtttttactttggatgcaagcagtaattttttgttcttccatcttgcagcccacaggctatcttcaaggacccattcaggaagggaaacaacatccttgtaagtggtgaccactttttcagtttgtcatggatgtgatttatattctgcagtgtacatccatctctgttcatccagatcagcacatgtctataaaaactgtgtgctgatttattcggttcaaactacatatgggatgtactagtagatgcaccactgaaggggggaaaaacttaatttaatcacttcaggtgtaaaagatgaactattttttgcactgttgaacattaaattttctttttttacctgtttctgatgtcatgggatgtgatcttgattagcgctttcactgtatttttgactcctgcgatcatctgttctacctaaccttatggctagttgaggaatgaatccaatgggttgtttcgtcaccatctcgaataattggcactttattttctaaattatcgtaattcacaggtcatgtgcgattgctacacgccagccggagaaccgatccccaccaacaagaggcacaatgctgccaagatcttcagctcccctgaggttgcttctgaggagccctggtatgcccactaatcttttttgccgaatgattatcgcaacgtgtcacagccatctcagcataattccctttctcataatggttagttgatcttctttgttcttgcaaattataggtacggtattgagcaagagtacaccctcctccagaaggacatcaactggccccttggctggcctgttggtggcttccctggtcctcaggtacaatcatttgtctgtttgattgtggcttaattactaaactgatatggtcaaaccaatcttcaagtgtgacctaactaatactgatcttactctttttgtgtgtgcgtattcagggtccttactactgtggtatcggtgctgacaagtcttttgggcgtgatattgttgactcccactacaaggcttgcctctatgccggcatcaacatcagtggaatcaacggcgaggtcatgccaggacaggtgaacactactctcaaaccttgccatttctatcgtcttgaattagtggagtacatttctgaccatgctaatatcgtgatcagatctataattggtaatgttattaacattgtgatcggtttttcagtgggagttccaagttggcccgtctgtcggcatttctgccggtgatcaggtgtgggttgctcgctacattcttgaggtatggataatgacattcttctatcaatatctcaaattgtgattcagaacggtctgatcgaatgccactgcccctaatttttttcagaggatcaccgagatcgccggagtcgtcgtctcatttgaccccaagcccatcccgggagactggaacggtgctggtgctcacaccaactacaggtgagggatgcttgaacatgaacagattgatatggtttgtgttactctttcatattatactactctgctgatcacgatcacgtcggctttcagcaccaagtcgatgaggaacgatggtggctacgagatcatcaagtccgccattgagaagctcaagctcaggcacaaggagcacatctccgcctacggcgagggcaacgagcgccggctcaccggcaggcacgagaccgccgacatcaacaccttcagctgggtacgcgcctccgtcttcttcttcctcctcctctgaaacacctgaaattcatgtcaaattacaagtcccgatcatgaaaaacacctgaaattcatgtcaaattacaagtcctgttcatgaaaaacagctgaatttcatgtcgaaataagtcctgatcatgaaaacacaaacaaatttttgcagggagttgccaaccgcggcgcctcggtccgcgtcggccgggagacggagcagaacggcaagggctacttcgaggatcgccggccggcgtccaacatggacccttacatcgtcacctccatgatcgccgagaccaccatcatctggaagccctgaagcggcttcttgacgccacgacatcctcgtcatcgtcctccccagctcgccgtgtcgctccggttgctccattgatcggacgatctggtgaattgcatttgtgctgggagaagtaaaaaaaaaaggaaagagaaaaaaaagaaaatcacgccaaaaaaaattctcattccatttcgatttggttgcatgctaccactactactacattgctcatctgccatttagattagctcctttttcttcgtcttttgggtgagtgcgtttgggtgctcttgtgtaatcctccaataatggccgtacctacggtacttgtcccatcctgtggatcatcgtcctcctttccacatgtggttttatcatcattgttattagtgatcacctttatataaagttcttgctgggcttccaatagccgtggcttttgcgttactactccctccgtttttttaatagatgacgccgttgactttttcttatatgtttgaccattcgtcttattaaaaaaattacgtaattataatttattttgttatgagttgttttatcacttatagtacattaagtgtgatttatatcttatatatttgtataaaatttttgaataagacgaattattaaacatgtgagaaaaagctcaacggcgtcatctattaaaaaacggaggtagtactacactttttgctgctggtgcgagacaacattttagatggatgagaatttttaacagaaacactacttttgctcaatggttgcaaagctattaggattttttttctcttctgtttttgaaacgaacaagtgatcgtgatgactaaaatgtccaacgaacgagagagagtcacggaacagattccacagaatgcttgtcctttagcggagggaatcaatcggagattgcgatgagcggttgagcgcgattacgcgactgtttagccacctatcactccatcgccattcatttgtatcgctagccattgatgtagtgtcaatagtgacagtctgacactgaccacccttcttcttacataagtactccctctgtcttaaaaaaaaaactactccctccctctaaaaaaatgaatttcaatataacttgttttgtgagagtaggtccataaatgagatcattagtagtattattattgtataatataatatattatgtgcaacagccaacagtgcaattttgccatataatttcaatgctttcaacaatccaactactcctggggatgccattgttatggccttcttttgttgacgttgattcacaatgttgacctgcagctagctttcagcttcagcatctccaccaactcctgcagctctgttatgcagatcacttatgtaatcatcgcttcatcacttcatcagttcacatgaaaattcttaagcttagctggtcaaccttttagtgtcttggtctcac

SEQ ID NO: 329 - DNA, 3264 bp, Oryza sativa
accaaattatctaatcgattgaatccatgattgccagctaggtttgcttgcatcctttactctatgcatatgctcaataaaatcctccctgaaatctgagatccattaattcctgaagttgatggggattccattaaagatgagatcatttcttctaacccaaatattccagcacccaatgccaaggacttccatgaagaaagaatgagggaaaagtcctcttgcagccatgatcatgttcatgaattctgtattcagattccatgatatatataccaatgtgattccaatattgctgagcaaaagagcatgaaaaaaaaatagatgaatgttgtcctctgtgatgtaaacatgcttgtggttgtgtacactgtcaaaaagttttccttgaaatctttaggcttcaaattctatactatacatcatgcttatatatgctcctgtattaattgcatgcatgtcaatttttttcttgcaatatgtgttataaaaccgatccgaaaccaccgtcgaaaatcaaatatggaagaaacaccatagaagatccaaacacgatgataacactgagacactatatttattattgaggttcaaacatctcgggatcactgattacaggcactcctctccgatccaacataattacagcgcatcatatttacattgaccctcggccgactaatgctggcagccgcttcctcccgtctatatatgctaagtcatcatgtggttacaacatgattgtgtctctatttaagagagagtttagaaatagttcgattttaactctatcctgcatctgttataatttcaagttctaaactgtgaccgactacgtacatatatttaacacaaattctaatgataaacacagttgagcctcccaaaattcttggagtacagagaagacgtctgcagccatgttccacacacttgaaactcgcagattcctgccttgattagcatgtcacacatcgatgtcagcagctaatgcggcagctgcaaaactcacaaaacaacgctatttggagaacctagtacttgtctaaaccactacgccacaagaatgcaccataaaacctgccaaaactagcttcaaacataaagtatattgttcgatcgtcgcatgcacaagcatatggcgccaaaccatccaccggccatggaggcggcgccggagcacggtggacgttcgtcgtcgtcgtcgacggatccagagctggatcagcataacaagggcatactggagaagatgcacaagagcctcctcctcctcgccatcctcgccgccaccgtcacctacaacgccggcctcgccccgcccggcggcgtctgggccgacgacgccgacggccacgtcgccggcgactccgttctccaggtgtgcgcgcccaaacatcaactaatttgtgtgcacatgatcaactgtcgttggactgaatttaatctagctcatgctcatctgacacacacaggcgcactacccggtgcggtacagcgtgttcttctactgcaacgcgacggcgttcgtggcgtctctggtgatcaccatgctgctgctgagcagcaccttcagcttccacgggtacagggtgcgggcgctgcaggcggccatggcgctcgacctgatcggcctcctgggcgccttcgcggcggggggatgccggagcgtgaggacgtcggcgttcgtgctggccctcgtggccgtcatcgccgcctacctcgtcgcccacctgctgctccacttctggatccggagcagccggtgcccctcccaccgccgggagctcgtcgagcttctgaatcttcaccggtgccattcttgctgcgtcggcgccgccgccgccaaggacgacgcgacgacggtggcgcaagcgggcactgaagcacctgctgctcctaagcgcgcgtccagcgtgtaactgcttgcgcctttgcctcccgcgggcaaagaattaccttccgtcgtcgtaaaggcagtaaacgcagacgtccaacaggaaattgctcagttttctttaaaaaaatctggatgcatatgagtagcatcgagcgagagattactcagtatccacatcaattattgggtgcattatcaattattgggtggatatatgagtcttgtttgtgttttctggttttatataggttgagaaaatatctgtatcctacttggccatatattcttattcttggaatctatatataattcctaggttgtaattactgagccatgtaattgtatctcactctatttaggcttcaatccttccccgtgcgcttcaaaaagactgatgattggaaaacagtggcaggaaaaaatcgggcccaccaaaaaacagcgacagaaaaaatcgccacccactgagaaaaaaatcggacggacaaaaaaaggacaggtggagatgggaaaaatttgggcaaaaaaccgcagcaaaaataacggcgacaaaatctgcttgcggaaaaaaatgatgacgaaaaaaaactatcggaaggattacttatttttttaattaagtataaattagaatagaaaaaaatacccgtgcgttacaacggataaatgttattttaattttattattgctataagatttagattaggtgaaattcactataagaactcacttagatatttttttataaaatcgagctataattaggagtccaacttttgtctcacgttcacattcgattctccaactgggcttgttagatattaatggcatgctttttaaactgctaaatgatgcgtttcgtgcgaaaattttctatatgaaagttgttctaaaatatcagattaatcattttccaagtttgtaataattgaaacttaattaattatacttttttaccaccttattttacgtgaaacacttaatcttcatctttaagagattcaaacatcacctaaagagatttcttatcctactccttttgtatttttaaagcaaatgaagttaaaaactaactcaaacacgcggatacgtagaacttaaacattaacttaaacaaggatgacgtaccaaaacaccgataaaaaatattcaatttttataatagtagtagagatatactgtatacctaataaaaaattaattccttagattccgtatttgtttcgtcgtctttttttttccgctttttttttccgcctttttttctttttccgttattttcgctgctttttccttttttccgttcctttcgcttgttttcttgttttccacacgagaatgacagggctcgggcccccgacgg

SEQ ID NO: 330 - DNA, 7556 bp, Oryza sativa
tagcaacattgtggaactagttaataggaaagaaataacaaaagctacctgtaagcatatgtgctgcccatagagaatataatatattatttgtctctacttcttctctcctcctaatactatttgctatctatatacattgtgaagattacaatagttaaagtccatatatgtgagtcccatctatatgtactacttttactatatatattgttgttgcccttacgagtacggagggagtataccacatcattaataattgatctcacatgtcatacacacaacgttttatagtccgtgctgcagctgatctacacttctcttctctctcatctcttatctttttcacatgtagttatagctgatttatacttcctcaatttacttttgatagtcatatttcatcttaacacacagactaaggataagtaattctacttataatctatttaaacatactactagtcattcctcgtaaacaagtaattcgttaatatttatatttctcgatgcccatgtagccaatcttgtatggaagaatagagtcacgtactaaatctgagaaagtcattaagatgataggttaaatctaagagtcattaagatgctaggttgttggattgaaatattccgtatacctataaaaataaatttttcagatttgaaaatatatctatgaaaagtatatgaagtatatggagggagtactgctaaagatgccgtcatagaattgccgtcatttttaaagatggagtcaagtcatcatctgttcgtagatcaacttccaacgcgttcatgcaaacacacttttcatacattcggcgagaacttgcgcactgggttctccatggaccaatgtatggtgatgatggtgtgtgtgtgtggctgtgtgcacctaagaatttctccggtggatgatgtatgatggtggtgccgtagtggcgagagcgtgacataatcctttttttccccctaaatacacataggagagagaaagactcaatagtagtacaaaggagagagagagagagactctagtgcatatttggcaggaagagccgaagaggggaggtgaggatcagaggaggcagcctcatcgtcatgcttcagcactagtagtagtagtgccaccatttctttgccctcgatctttccccagagagagagagagagagagagagagtcttgattgggggaggagagagggagagagagaaagagagaggtattcttcttgttcttgtgcttccacttgattcacttccaaatttgttcccctttcaagatattctttcatggggctgggttcctggattatggcgcttgcatgtgtcttggtagaagttgttgacttgcggctttgggttgggtgggtgtggatttgcttcttgcttgctcatgtccccccccccctccatgtcttccttcttctactttcagtttcagctggatctccgcatgatttggggtaagggggagcatagctatgtcccttggttcttggtttgttactctttctctgtatatgctgttctttggttcagaatttgttttgcatgaacaaagaagtacaactcgtatgaggctttcaggaatttaaggctgctgctttgattttgtctgtgggctagctagactgaggagtcttggcttcaccttttctttgctggatttggtgttctttcaagttcaaaatctggatggtttttcagtgcttaccccccttttcttgggtacatgctgtgtactttcttctctgccaatgaaatgagacagagcttctgactttggatggactgtacggttcttaattgacatttctgatttagttctgcgttaaagtggatgcttagggtacagaggaattagtgccaatatttgaagtttctttagcaagattgcctttgtgtgatgataaataggttatcctggttgaattcttggcggatttcagttgctatttcccccctgaaaagcgggagttctcctaagtttgatgtactatgcaaacgtgggatttttttttccgctgtttagtacttgaagtcttggagcaatcaaaatcttctgaatgattgagttggatcttccgtaggcaagatagtacagggaagtaattactagagatagtacatagtagaagtgattactcattactttaagtctctaacttaacagcaaccttgtggttgaaagtagtcctgaagaaagtttagcatcttgtcggtcataggacatgctgatcattagcatctgaagtagcctagatttgtcactgtactttgctcttggtcagctttagggtgattttttttgtgttctacattggtaactaccggtgtgctacgcggacactgttttttcttatttattttggattagcccggtagatgatgctgctcaggagttctacttcttatcctggaggtgtactgtctagatagattaatccatcataaagttgacatagtattgtttgttaatgatattgtagaggccgtacaatagttctttgatttattttatgcttcgatcattttcaactgttcatccagctgagtttggatgtttgtacaacctaatccctaatcattgtatgtggatactatacaaaccgaattcaaggtactaatttatctagtaacttggctttctttatgtgccactgtcagtctgacctgaaaattttctgaacttcaaaataggacagaaaatgtttgtggatcttgagtaatgccttctaataatgataatgctgttgcaagaaatggagaatcatcctgtccaatgcatggccaagaccaactatgtaagtacatattccacacagtgtgatactgaatcatagctattaaactgaagataatgaacttaccaattcacttctatgtgaataggattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcaggtaatacatttttcttcaatgacatcatctataccagaaacgcattctttcccccaatcaaattttgtggtggttttgcttgaagcctcgaactagtaatttgctgtttctggaaatacacacacatgcatgattgactctcaagcagctaaacaatttcttttggtacctgctcctattatttcggttcagtgccatatgagttataagctgtaaagggagaatattctgataaaaagactatgaaagagaacaaaaaatgcagtcaccacacataacatgatagggttaaactttgtttcattgtgaaatttttatgccagtgagagaaaatgtcgtattcaatcttagaggtttggctaaaattgcagaaacgcagaatatattcttctgtgactatatcatccattttaagtttgaaacaaaagaagtatattgcatttgaatgatgctcattcacctattattcctacttccctgctttattttggtgaaagattgtaaatatactattacttaagggcagataagagttttaatccatatctattctaaccctaatccctataggaattaatttagatgtgcttctgtattatccctgcccatagcttttacatagcgttcatttgtctactttcacgtctgcggcaaccagacctgctacaaaactatgtagtcagaagaatacaccaaagaaaaatctttgctttggaatccatctgagcagcataggacggagcaatgttttggtttggaatgttgtatgtaaattcacgggcctaaatcatatttaattatgcatctaatgatatgtttctacccacatgaaagaaacacttagtttttcttcttgttgattggccaagtgggtggttgttgtatataagtgaaataaatcatgctagcctttcaaatgatgattgtctcgatcttgagcattattgctttaaagatcacgagtctttgcacctgtagaacgctaaagcaaaatctgttcttcaaatggtcaggcttcaaatatatggtaatgtaattcagtatggcgaattaagttgtcactctaatattttgaaaaatacgatatctttgttatccagaattaacaaaatatgatcttacgcagattggtatgtgtgagatcactgtgtgcattcccccgtgttcacaattcatgttcttttcctgtttgtatcaattaggcatctaaaattctacataataaatgaaataactagagggtgcattattatgtgatcaattcttatgctctgggttatgctcttcttaaagagtggcacatgtaaccgacttcaattgttcgatttactagcatattgcccgtgcattggtacaggatttaagaaaagaacactgtcatcaacccatgttggtcatcacattttacctattttcatctcttaatttttgtatatacctttcagctgataagtgggcccattggacccacactcttgtttttaccttcgcaaaaaagcagggaattggtggtgggggtggtggcagattcaccacaaaccaccaccatttgcttcttttgaaatagtatagataagaaatcacttcagtttctaaggtgaacaagtggctgacatcacttattgtatgacagtgtttgtcccctcagatattaacaacaatgatagttgtggggagcgggaccatggcactaagtcggtattgtctttggggaacacagaagctgcctttcctccttcaaagttcgattacaaccagccttttgtaagttaacataatctttagtactactactatgtttgaaccttatgtttagtttacctgttcttgtgtttttccaggcatgtgtttcttatccatatggtactgatccatattatggtggagtattaacaggatacacttcacatgcatttgtaagtaaagacagggctgtaattttcagcctccttttgttttattttctttgttatttatccaaacagaagcaacaaatgctttcaaatggaaatgaaaattatccaaatagttctcaccaattttataggagaatgctacaaatttagtttttcaaataataatgacatttagtgaggactatgcccagtggaaaaacctagaagaatatataggcatagaagaaaacctgcaaaatatatgtggtgtggtattaaactcttgtgtattatcaaacaggttcatcctcaaattactggtgctgcaaactctaggatgccattgcctgttgatccttctgtagaagagcccatatttgtcaatgcaaagcaatacaatgcgatccttagaagaaggcaaacgcgtgcaaaattggaggcccaaaataaggcggtgaaaggtcggaaggtatggctgaagcatttcatatttgttcctagcaatctctacaagcttgggcagtgtcacatagtcatatttagatgatttaatcctccaggtactattcattgattagtcctttttagtgatgtcagatgtatcatttatgcttgtaacattcctttacctgcaaacatcaatagaggcagttacattttctgtaatgattcgaaattaatattcttagtttttgtttgtagccacttatgtttagtccttgtttggttgcatttgtttcctgcatgcgtgccttcctgcctgctgtctgtaactacacttttctatattgtattaataattgtgatgccattatgttcccagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctataggctgctgtgttatctgcatttacttctgtagttagtatttttgtttgtctggtaactcaaggataacctagtcatttgaactattttgcttaattccttgcacaaacctagacccaagttccatatgcaacgagagggagcactactttaaaggctaattgcaagatggtaaatgcatattcttgattccagcttgtgttatctagtgctacaagtgcatatggtcatcggtaacaaccggagtaatccacagtttgtggcaaatccgctccggccgatttttgacgctaagcttgttgccgcatccagtgagcaaatgtgcaaaactgggaatcctgtacctggtttttgacaaattctccaactctagcactcacgaactaaagcgttcttttgcattaacgtattgttaattagcacatggttaattgagtattaattattagaaaaacaaaaactggtttatttgaatgttttaaaaacttttatataaaaagcttttttaaataatgaaaaatattgttaagccgttcacgaagcatatgctaatgaaaaataaggaagttgtaccaaaatggaataccgaacgtggcctgatagtgccaaattttgatactacttaatttttatttggatagatcgggggctactaataggcgcgtgcgctagctggctaactggcgcagctgtacgcccttctattgcgtgttgttatagattcatatcaagaaaaaaaatctccctcatgcgtttcctttttttttccctctttttctttgggataaaaattcgccatgcgcgtgtgttttccttttttttagttgactgaacaaacttttaaatcagatttattcaggatttggaaactttttaactaagatttgaaaactttcaagtctagatttgaaactcatatttgaatattttcaacttaaatttaaaaaaaattcaactcagtttttaaaactttcaaatcttgatttgaaaattttcaacacgaaactaaaaaatttttaactcgg

SEQ ID NO: 331 - DNA, 9154 bp, Oryza sativa
tcacaatcgtgttggtctaataacctttcaaaggcgtcaaaggaatacaacaacaactgaagaagatgagtaaaatatgcaatctgaccaagaagaatatgaggaggatacacatgatgatacaaatgtgagtgattgtaatgaacctcccactagagtgaagagaatttggatgctaatgacaattttaatgagtttgatgatgaatactaagaggcaatgagttggacttacaatacttttgtttagagtgtggaattgtggaccactattatctatatatgccattaggcgtatgataactcccactattttgctatgtcttttgttttatttgcctgctaggctggactgcttgttagttggttatgtatttgttgttgctcaaatgtttattttgttgtctctattttttttgtttatctaattatcttgcccattatccgcgtgcctggctgcttggaagaatgaatggcagggcatcaacaaggtatgctactcaagtaaatataaacaattcattaaccatcaatcttcaattctgaatctattatcttcgtaaaaaaatatcgatgcttctaaggaggatggatactgccatggaggtggtggatgctacatgggctcatgagttaccaataacaaggtatactaggactttaggcgcacttcgtggcgcgctaccgttcgttaaagagacatgtgaaaggaccttgatgtcgcctagaggggggggtgaataggcgttcctaaaaattatcacatcacaacttcatagcatattagagtgatgaaaactttcgattcaagttggaacttccggtatggggttggaagttttggtctcaaccaaaaagttcggcggataacggaataaaaagtttatgaaaaactgaactgtttatagattttctagccgctagcttatacaagaatctgcacttggaagaagctcccgaaacataccctcgtttctcacccccaaattcacctcactccgctagcgccgctctccctcctcacgtcacgcgtgccaagtgcgatcccccctcctcgccccaacacaaacccctctctcatctctcctctctctctctctcgcaaaccctcctcctctcctcccctctccgcccccgccgccggccgtgcccctcctcctcctcctcctccggccgaagcgcgccgcccacgagcatcagctccccctcctcgtccctccctccctccccactgtccgccggactgacggtggggggcgcctctcccgcccacgaggatagaaagccctagcttcgtctctgctctgtgcctccgccgctcttcccccgctggccggacggcggctgcccctcccctcccctcccctcccctcccctcccattcgtcgctcgtcgacccctctccgccgccgaggctcgctgtcccaaggtattcctcttgtccccttcctcggctcctcctccccctgcgccgcaactctgccgtggcccgcccggccgcccggagatccgtccgggctcggctccgcctcatttctttcgctggcgatgaggtggtctaacttgccgatgcgtccagagtaggctctgttcttttgtgttcttttggttgagttgggaacccatccctccggtacggaaaacgaagcagtccattagcacgtgattaattaattatttgctatttttttttcaaaaatagatcaatataatttttttaagcaactttcatatataaactttttgcaaaaaacacaccgtttagcagtttgaaaagcgtgcacgcggaaaatgagatgggggagttgggaactccaggaaacgaacagagccttaaatccagatggatgtttctcttttacctccagctaatccgtccgcttcgttgaggattccattgaatgcttggctgtggtggagtgctacacgactgctagtagcagcttgcttctcagcaatttgggtgaaccccccacattcttgaggtatcgctgcattttatttggcagcgcatttataattgctgtcttactaaaaaaacacatgtttttattttctccttttaacattacattttatatgcatagccatgcaaagttcatggtacagtagggtctactttcaccttatttgcttgtatacctgaaaagcctgactgttggacatagccacgcaataattgtaaagaagaggttagaataatctatatgctaatattgatccttttatgttactgattctgcgtgtatttcaattgtacctcctgttggacataggcatgatgaagcaaactgtttacatttagagtgtattagagcataggaattctatcatcgcaaatggacagatggacatgctatatgaaaatgtaaaatgcattagtctggagtagctattatgtgtgctccatttcaaactgtatatgtggtacttattctggttgactcatcatgtgcagtgttatctattttcaccaaattttaattttttaatagccaacctgtctctttgacatgttgtatccgtcaatacaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatggcaagtctttctttctttcttttttctagactaattcttgttaaccttgatatgattgggcacaaagcatcaattgtccagtttcatgtttggaggaaactactaaactattatactaattatcattcaaaagtgagaaagagcatcaattctagcaatagaaaattaaaacagcaaggttgtctgacgaagtaaggatgtatactgtagaggatgttttatatgaaaattaggctatcgttgtcagctgttcagtaataatctccaaaattcatggaatatgtatatattgaaacgttcagtatatgttggcattctctacatagaaagttagtttcatacgaaaatcttgttatcagagaatgccctttgctgcagagtttgatatgttggcatttaataatccaattgagctactgagcaatgcatatgtgctgtgcatgggacctacacataggtctatcaaattagggactaccagaaaacaatataaacagttgggtttccccattaagaaagctggcaaagtttgcctatggcacgtttttgtgagatttgtggaattcgttcatgcgatttggatccttatgcaccttgaattcgcttgagttccttgaatacattttgtttgatattttatcccttccaatagcttgtgtaatttaacttttggtatatagcatgatcaaaagatatagacacgtttattgaaaaatatgaaatgcaaatcgtaacaggcctatttataagttgcgtaatatgataaagatgtgggcttttttgcattgagaaatttgttatggcagaaagtaatttaatagatactaaggctgtgttctttcccttaggtgttacggagattttcagtgcatgcaaaacgagaaaccattataaacttgaaaaataacaatttatatatagattttttttttgcaaaaaaaggcaccatttaacagtttgaaaagtgttctaatggaaaatgaggaagctaaagtttggagttgtgcaaaagaacgtggcctaagtaataggatgcataaacaaaaattacatgctaatgcctgttggtttacaaaattaaagctaagtgatcaaattcatttttttgaatatgttttagtccacagacatttcaaaacaaactgatctttctttttcataaaagttggagtcttattcatttttttatgtaaaacatcaggaatcaagaaggtaaaattcattattatataaaataggaatatcgggagcttgatagttatgttgtcacctgcagcttgaaccaggtcagcttgctcttgctgctgcttctgactctgacagatccaaggacaaacatgaagatcaaaaggtaaaattttgcaagtagctctctcctttttgtttcatattatcgttgttgcaacaaatattttccttatcactttgtagacattgcgtcggctcgcccaaaatcgcgaggctgcaaggaagagtcgtttgaggaaaaaggtacttgtgttctgctgtagcttttatactaaagaagtttattccttttcaagttttgaaaattgatggtttataccatgttctatttttttcattctgttactaggcattattaaactgtattcttgtattaggattccactatcatttctactagaagatagcatgcgttgcattgggaacttctatatcacttgcagattcatggaaaatggaaaagttttgccaaaattctatggggaatcacttgcaaaaatcggctgggtatgggggtaaatagttcagacagacatgtgcacacctcaaaaatcagaaaatttgtttgttgggcaacatgagaaacgatattcccatcataatatataaggctgcactagatgtgtacatgtctaggataatgaaataatcaagttagtaatagtaatgaattttattgaaaggtagaagatacctggttttaacttatcatccatgcaatggagtctagtggctactcattatttaaacacttgcacaatttgagggatgattattaaaacaagtagtacatttacagtcttacacactatatcagggtaaaccgtcagttgagttggtcagctggcttcatcaatttttggaaaagtatgcttgttgctccagcggctgagctagcaaaataatttattacctgcaattagaaacacaaacgagaataaggatgccacagatgttctcttacctgttctgtaagctgattcagattgattgagctgacaccggccatgattcttatactcaaatctgtggaacaatccacacaacacaaatatacacggttcaatttaattaaggcatgtagcttggcagtgaaaggccacgatggtgatgggtgatcataggcatctaccatcaggttggaccaccagagatgatctctctgctgatgacgtgtactaatctacaatctatgagaactaaacatgtttaagaggatgaagtaacatatttaaggcattatatgcgtgattgcctgtccttgctggagagattggatgctggtcgggacatggcagagagctccaagggtatataggcatgcaagacttgcagtctcgcacagtgccctccaattctgggcagttgcaggtaagaaccacggctgtctccggtgggatgatccattgcagtgaaccatcatatttcattgacttattgaaggaatggagaaggattgattgttgagcttaagaggagattaattaaaaggaatgaacagtgcgctcctttggcttcccatctttttattgcatttctgatggtttccggctgtgataccctgggtgatcaaggagtgccgatctgagccacacatggctatcatacaatgcgagcctctggtagtcaatcaggtgtttgtgtacttgcgtggggaaagaggagataggcagcctggctgggctgggcctcaagtatgaccttgattagtactgcaagtttatctaacggctgataatcgagagacatgttgatccaatggctgaaacttgttgatgacgtggctaaacttggtgacttctttatggtaattattgctgtcagtgggttgtaactgtatagaaagaaaggattttgtgatggcacagtgcacaccatatattgctgggggcaaatagaatggtaaattgatttatgtaggggttactaaacttccattttttatatcgtagtaagtattttgtgtatttgtctggtgatttttaccagtattttgcacaaaaggtctttagtgggtctgcttgttaaatcttggaaacaaaaggagggaaaaataatggtcagtgctagttggcttactgttcagatttcaatgaatatacttttaaagtttctgctgatattgttacattatgtaaaaagggaaaatggttgatgcaagttattcttttcagcttttgtacaaattttcatggtcatgatgcaatattgaataacttcatctttttaggcatatgttcaacaattggagaatagcaggctaaagcttacacaactagaacaagaattgcaacgagctcgtcagcaggtttgcttctattgtgtctcgctgttttgagctctggctgcaagagttcatttcaagtaggcttacgggaatttctcacagggcatttttatatccagctcagtggaccagactcattccatgagtggaaatggtatatatcaaatccttcaatgtttaatatataatcactcttttttgcagcagcaactgtttggttgatcattacaatgggatatatgaaagcaatacataaacattctgccttgttgacagagcaattatactgtattttcttgcaggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaaggtctgtaaagtcttacgatgttcttgttgtttatttgagccatccttctattgcaaagcccctcctattaccaaaaccaatgtttctaccataatattattagcatatcaagaacaaattatcagtctatacctatttttccttctatttcatatactcatatcaccaggtcattgtaaacttgtgctgtaataggcagattgtagttttgataaaacactatcttgctttgcataactcttgcatacctcatttcttgccattggagagcatgttagtacttcatatggcctttctttatttgcttatgaatttatttgagtaagagttactaaaagtaagaaaactgcagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggtaccatgttttttctctctctctcttttctagtgtaaattatgtatgtaaaccttgggtatagtcttatgatgtccatggagtatgtagtatgcggattcgagtaaactatagttcaaaattgtgtactaaatcctctttatcttttccactatatgaaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatcattagaatgggaattgggaacggtcttattgactatcccgtgggtatttgacatctcttaggaaaaactagcttactgtcatggacacagcgccatgtcaataatctaatcaaggatatgtgaccattcagttgcattggaatttctgtgactgatggattgtgttttgtcgattgaacactacacatgtgatttgtgaacttggtctatgatagcttgaacactacacatgtgatttgtgaactatgacagcaatgaaatcattgtcagcagcaatgaaattagcaacttctactcgtttgatcttcctgggaattagttcattctgctgcgtctcgagaattttcatggctgtcagcagcactcaaatctatgtaatgttttgatgaataacctgatgcgtaacggatggcaaataaatagattcaaaacaaaaaatacaaatgcataatcgtcctcaaaattactagttgtacaagaccatgtgcgatcagttaattacatgtaagggaaccatggtttaaaagaatatattacacactcataaataggctttcaataaaattttagtgagatagatgtgatgttagtttcgtctctttgagcgttggtgggtgcatgggcaggtgtggtgttgcgtgtgtgtaccgtgtaatcgaaaaatacatacatgttcatgccacttttttttcaattctccgaaatctacaatacatacatgttccaagtgtatgtcaacgatggttttatctgtagcttactgccagcagcactgaaagtctgaaaccgtgaagcttttttttaactgtatcaactatggtcattgatttgtgcttttggtagaattagaggtgctcccatgattatgatatgcttcccaacgctaattataggccgcacatttacgctaatgctggaaaagttcttatatttataggacgaagttttagcatctgatttaatacttctaaatttcaggaagaagacaatgatgatgcatgtgtgtatactctgttctaacaatcactcttactggcacaatgtgagcaaaacaacctgcaagcccaaacttcagacatcttgtcgcacaaatcacacctacgatggtcccatcttttaagttaaaaccaagcgtccacaaacttaagattattcatggataaagcatcctaagcagcatctg

SEQ ID NO: 332 - DNA, 4773 bp, Oryza sativa
attaagaactaaaatgacccaggagcgaaactttagtgaccatattagctattctccctattttaaacatgaaaaatagatttatttgatattttaaagcaaagacaattttcaacgaaacataccatttgataggtaagtttaataatttggaaaaacgtgctaacaagtcgagataaaatctttctgactttctcttactcctcttcagccatacgctcaagctttaactgaagtccatagaaagcaagcggcagcgtgcaatgcgtgtccagtgcagcggcgcatgcgcgtgagcgcgtcaatgtcgttaagaaacagttacatgtacctgtcagtggcacaattgggagctcaatagcagctgagattttcagcgaggcaaaagacatacagaagtagaagagatggtgagccaatcaaagcacaaaccaacgcgtagtagctgacggatttgaattgtccgcacatgagctctcccagccactaaatcggggagcccaaaggaaaaaaattctctcaattattgctgcgtgatccactgcattattgtccgatcactcaaacagtggtccatcgaagctttcggctgctcgatcgatcagttgccattgccgtttgccaatctcacctgcatgctgtatccattccgactgaactggggtctgaactgaactgttcagatcagagagaagaatataaaaaaacattcagtgacactagtgttaatgcttgtacattttaccagtgcggatgaggtcccgaattgtcgataggttacagctgctgcacacagatgcatggaccaacttcactggcaagtgtagcgacttccttgactgctcaggaagaagggaatcacatagaccaatctgtaacaaaaaaaaaatgaaatattttaatcaagagaatagtgttgttgtaggaaaaattgccacgagtccttttcggagtaccaaaaatccctggattggcttgttccacagccacaaaatatgctaactaaggtaccatcagcatcattgttgtgcgaactgaacgtactcctcttgctacaaatatagaccaaacacttgggactctaaaaagtacacaccaccaatgttgattgtttcatcctacatattaagctcagagcatcctcacattgggcagcgttacacaagtaccaacaatattagaaacctaccaaatatgccattgaaacacactatgggttgccaactccaataccaccttctataagcccaaaaaatttgttgaagaatgcatccaccaagtttagtgctagataccttgaagcgtatcaaactatacatagccatgaagctcctgttaccgaattcggaggtgcctcggatctattgggagaaagctcagcatctctgtgggttcctgtccatgaagctcatttccagagccagatgtgtggcaagttctgtcaaacaatcttatagttttctggtttgcaaaagtaaccctttggtagttcagctcgtttactttgtgataatctcatttgctggtttccttgctctgaagaatctcaagccccagggtaagccaggtccaaaggatttggacctattgttcacctctgtgtctacacttactgtctcgagcatggcaacagtagagatggaagacttatctgacaggcaactctgggttctgatccttctgatgctaatgggaggagaggtgttcacatcaatgctagggctctacttcaacaatgccaatgccaacagaaatgagaacagccagagaagtttaccttcaatcagcttggacattgaattcaacagtcctgcaaacaatggggatcacaaaattacggaatgtggccaatcagaagaaactatgtcgcaaaaccaggtacagcaaaacaaaagcataacatataatccttgcgctgtgttggttcgcatagtgacaggttatttcgtagctactgtcatttccagttctgtcatcattattatttacttttggattgattcagatgcaagaaatgtactgaaaagtaaggagatcaatatgtataccttttgcatcttcacagcagtgtcctcgttcgcaaactgtggcttcacgccactaaatagtaacatgcaacccttcagaaagaactgggtccttttgctcctagtgatcccgcagattctagcaggcaacaccttgttttcaccactcttgcggctatgcgtatgggttttggggaaggtcagtggaaaagcagagtatgcttacatccttcagcatcctggggagactggctacaaacatttgcatgtgaggagaaattctgtttacattgttctgagtgttactggactgattctactgcaagtaatgtttatttgctcgtttgagtggaactcagagagcttagagggaatgaattggttacagaaattggtaggattattattccagagtgttaatacaagacaagccggtgaatctatccttgatatatcaacactttctccatcaactctgttgctatttgcagtcgtcatgttagtatctcctccaaaccctgtcttctaatgaatttaactaaatcagtagaacacttagattagttattacaggaacataacaaattatcaggagaaactgttggaaaatttgatagcttcatcatttataactttgaagattactaaacacatgcattcatgaccactgcagcttgctaggttttatcgattttatacgtcaccgaaatagtagttatgaacttcaaatctgcatctaaataactactgttgaatagagaaagtgagactactttgaacaaataggacagaacttctgacaagggtttaaatgaaaagtaggcagcatacaacatgttttatgtggaacagcatgtttcctactccttgttaacagataatcaacttgcttgcaggtaccttccttccgatgcttcatttctcactgccaatgctgataaccagcccttgacagataaaaagacaaactcgattagcagagcactgtggaggaattttaccgttaacaagctttcttgtttagcaatgttcacattcctggcatgcataacagaaaggaagtcaatttcttctgatccactaaatttcaacatcttcagcatagtttttgagataatcaggcaagttcacatccttttttttttgtctgcccataacagaaactatggctacatcaaaattacatcactgaaaatccgaattgcctagtatgatcactaagaaccactgaaccagcataattaaatttgcaagaacatatcaaatctacgacctgtcatttttttttcttttttggttgcttacaagcaaacagaaataacgccattttatttccacagcgctttcggcaatgtaggctactcactaggatacagttgccagaagttgttgaagcctgatgccacttgcaaagatgcttcctacgggttcgtcggcaggtggaccgaggagggtaagctgatagttatcctggtgatgttcctggggaggctcaaggagttcatcctgaaatgaggagaagcttgagtgctcacgtgccacaaggaccagagcgtgcaagcttttttagagattccacattagttcattgattcgggccgattgaccccgaatcacgattggcaaaactgcaaaaggaggaatttatcaagctttttttagagattccacattagttcattgattcgagccgattggccaaatcacgattggcaaagcaaaagtgcaaagggagaaatttatcgacatcgcttaggccgtgtgcagtgtgcgaacaatcttcatcacacgaacggagaaaggatcgcgctccagtgctcgctcgcgtaaacgtctatcggccatgggcattgtgttgagccctaactaagcaccatgattataagaaaattcgaagaaatgtggaaggaaaaaaaatcgtaacctacaaggatgataggatataggaactgacagaagaggacggcgaggagcggggtcgggggacggtggaggcatcctccgccggcgagctccaccacggaggcgacgccggcgccgagtcgccgccgcgctgcactgctctagtgctctggctgggagggcctagagtagcagaatgggtcaagattgggccgcgccctctacgaagcccatgggctttgggccatttgcttacgctgatctttaggtttggctgttggatggatttgcatttgcgcaccttgagacgagctcatcaccgccatgtgcttttatgtcatgcttgcaccaacagcaccattgcacggtagtaccatttttcaaaaatatacaagacaaacgcaggtgttcacaaacgtgcacacataccatatctttataaatatctcaaaagactgcacaatatattttaaaattaacgaaatgaccgtatctcactagtcactatgatggttacgtcgttgcctaccactgaaaaaaaaagtagccgtaaatacgagcaattctcttggatttgaagtgcctctccaatttaaaaagaaaaagaataataaatgcgtcatggaactttatcatgactttatcttaaaatataagcatccctttatcttaaaatatgagcatttctaaattgtttggcaaatattaagattactcaatgatcaaattttgaattctaaaattgcttaaattcctctgccaaccacttgattgattgaaactgcatatatttcgtctttgaattggaatcactgcctaaaacattactgtggtacagatttta

SEQ ID NO: 333 - DNA, 6488 bp, Oryza sativa
ggtggatccgctcgtcacaggacaaccgccacctgatcaagtgtcggctccctccagctaatgtactgtcggccgctcttgtcatcgcctatcgattagggggttgcgagagaaggaggagaggagaagtaagcaaaaataatattattttcgtatatgggtctcttaagtggtctacctgtgaaaattaattttcacaaatgagcttttattgggcacctctaaactcttttacatacgaatctttttttaacctgcatgtaaaaataagagggtctgtaaaactcagttttttttaaaagtagtgttggaaactcgaaatgtattagctagccttgagttgggatatgccagccacgggccctgatcgtgtctcgggcggatagatggtatggttcctggttcctgctacaagagtatactagttctcctccactgtgttctcttcaaaaaaaaaaagagtatactagttctaaaattttaaagtaacaaattgcaagttataaacatatatgaagatcttcggtagtttacatatatgaagcttttaggatatatatgatatatcagtttagaaatgaaggaggtgactatatcatctcaatacatggaaactaactttggtgatgatttacgcacatgagacaaagcattgcctgaatctcgatatatatacaatgttggtctatttattaattggtggctagtagtgttcatcagatcctagatggtactgtacgtacatgctagttataagttattggtggcttcagttgttttcatatatgtgctactagatactgttgacgtcgacgcagacacttgtagcattagatttcattgttttgtccataaatatgaagtcctatttgttgaacttgatctcaaatttacatcatataatatatatgtgccacgagtgcccttggtgcaatagctttctgaatgattgcactgagcacaatccaaagataagtataaaaaaatcgatatacctcctgctgttgctcttgttcacttgtgctcacagcacctggtaaccccacatacagtgatcacacaacaaacaatatctgttgtttgtgtataaatagccctaacatggcttcctaattcctataaacaacaagtgtgagaaaacccaagaacgaaacacataggagagaaatgagttctctggatgccactactcctagatatgacgagtttaaaaggatctaccaccttttccttttccatgcacacccattctggctccaactgctgtacttcctcttcatctccctcttgggtttcttgatgctgaaagctctgccgatgaagaccagcatggtgccgaggcccatggacttggacctgatcttcacgtcggtgtcggcgacgacggtgtcgagcatggtcgccgtcgagatggagtccttctccaactcccagctcctcctcatcaccctcctcatgctgcttggtggtgaggtcttcaccagcatccttggcctctacttcaccaacgccaagtactcctccaagatgatagcaaccttacctgatgatgacgaccatggtggcagtggcaaaccaccaccaccaacgacgtcaccttcgtctaccctagtggagctcgagctcgctcctcccatggacgtcgtcgtcgtcaaccctaccaccactgcgacgacgcacgacgaggtagagctagggttaggacgtcggaacaagcgcggctgcacctgcactactactcacacgtcgtcgtcatcatcggcatcgaagacgacgacgacgaggctactgatgttcgtggtgatggggtaccacgcggtggtgcacgtcgccgggtacacggccatcgtcgtgtacctcagcgccgtcggcggcgcgggggcggtggtcgccgggaaggggatcagcgcgcacacgttcgccatcttcaccgtcgtctcgacgttcgccaactgcgggttcgtgccgacgaacgaagggatggtgtcgttcaggtcgttcccggggctcctcctcctcgtcatgccgcacgtcctcctcgggaacacgctcttcccggtcttcctcaggctggccatcgccgcgctcgagagggtcaccgggtggccggagctcggcgagctcctgatccggcggcggaggggcggcggcgagggctaccaccacctgttgccgagctcgcgcacgcggttcctggccctcaccgtggccgtgctcgtggtggcgcagctggcgctcttctgcgccatggagtggggctccgacgggctgcgggggctcaccgcgggccagaagctcgtcggcgcgctcttcatggcggtcaactcgaggcactccggtgagatggtgctcgacctctccaccgtgtcgtcggccgtcgtcgtgctctacgtggtgatgatgtatgtatatttgtcctcctcaattattatatttttgacaggccctccttaatatattaattactatcacatgcatgtgtgcacacgtaaaaactaaataaattaccatatcatacatgtgggtacttaatttagtactctggcctgggacatattttaaatcctattggacatctcctttcaattttttttttgaaacaaagtaaaaacgcaggcgcttataacgcgtgcacactcacccttatgaatacaaatcttacccctataagtaccttcgaaagactgagctgacatatcttgagattgacgaagtcatcacgggtatctcactgtcaacaagtacatcactacctaccactaaaagaataattagccataaatacaagcacccgtgtcaaatttattatttgaatctttcattctaattatatgcgatcaaaatagttatgaaaaattctactttatatgggggtgcagggtctcgaggcatctaaatagttatgaaaaaatctataaaaatataagagatatatggtcttcgatgctgtggcacaagtggactagtggttgtcattttacgcgctcaaaatgtaaccgaacgaggcgccgtcatggatcactatcaaaagcagcttagtaccgaattaacatatgtggctacaaatgctaatcagctaaatgataggaaagattgattgctactgatagacatggattgacgctttcagtttgttggagcccttgatttggcactttcacgacgataatccgcaaggataattctccaagtcatattttgcaacaaaatacaactacatctagtttaatttcctctaagttagtaagttgtgactgcaaattaacaagtgtattgatgtccgaaacctagctagatgaaggttatgtacattggatagggatcgaaagaaaatagacagaaacagagaacgataagtcaactgcaagcacatactcccttcatactcataaaggaagtcgtttaagacaatgtttaagtcaaaccttgagattataaatcataaataactctcaagttgttgagtttgaaaatgtaaaaattatatgaataaatttgtcttgaaaaatactttcataaaagtatacatatatcacttttcaatgaatatttttatagaaagaagaagtcaaagttgtattttggagaccgtgtcgatgtcctaaacgactttctttatgaggatggagggagtatatatactctgtacttaagtatacgataatgttatctttgttcagtgaaacttttggaactttgattgttactagctatcaaaatgtttagtttgagaatataaaaattattaatattataattttgttagatattatcgttatgttttaataaaacaacggtggtcaaagtagtacacaccaaacaccgaatgaagtcaacatcggtgtgtgtatatatatacgcggaggtagtacatggtacaacttttgaattaaactcccgaaaaacatatgttctcatgcatgcttttgtatacagatatgatatagctctaaattaataacttgcatgacggaaattgaacatatttgctacactgaattatactgcgtgaaccttaatttgcttatatattctcatgcttgctgcaggtacctgccaccttacaccactttcgtacctgtccaagacaaacaccagcaaacgggagcacagtccgggcaggagggcagcagcagcagcagcatatggcagaagctgctcatgtcgccgctctcgtgcctagccatcttcatcgtcgtcatctgcatcacggagcggcggcaaatcgccgacgaccccatcaactacagcgtcctcaacatcgtcgtcgaggttatcaggtacgcatagtggtggtctaaccttaattttaactgctggcaagtgccaaaaaattactctctccatctctaaatatttgacgccgttgactttttaaaacattttgaccgttcgtcttatcaaaatttttaagtaattattaattcttttcctatcatttgatttattactaaatatatttttatgtatacatataattttacatatttctcaaaagtttttgaataagacgaacggttaaacatgtttaaaaaagtcaacaacgtcaaatatttagggacagagagtatatttcccccttgagggtacatacatttctcctcgtttttatatgtcatcccaaaaattacaaaagaaaatctaaaagttattgataaaatggacatgtgatatattactacactaatatatacacgttcaaatataacttgaacacatgttagaaaaacacaataaatttaactataaatggcatgttcaattcgcaattaaatttaatattttatttctgtttgaacaaattgaatatcatatatttaaaaagagattaattaatgattttttaaacgaatggataaaataagagaaagtgaggaaaatccacatccacggagataatatatataactagaaccatcgtgtaaactaactatatgttacatactcctggatgcagtgcgtatggcaatgtggggttcagcacggggtacagctgcgcgaggcaggtgaggcccgacggcagctgcagagacctgtgggttggcttctcagggaagtggagcaaacaagggaagctcactctcatggccgtcatgttctacggcaggctcaagaagttcagcctgcacggtggtcaggcatggaagatagaataacgcctaactgcaagcacccatgcatgcatgacaacttcgttactaattaatggggcatttcagccggccgccgtactagactacaagagatcgatcgataggtctcccctcctaaaactcctccttaatctgatctccacgagttcttgatcagggttacttatatattataaaggaatgatcagataaatatatgtctatatcaggatctggtcgatctctagatatctgtcttttttttttttgggtaatgcatgtaagcaagtagcaattgctagacatatatatgtgttagcttacgagagtatatactggcgcttgagtcgtgatgatgtgttttttcctcaccatatagaccacaaaggacatgctagttttcttttctccactactactccctccgtttctaaatatttgacacagtttatttttaacacatatttgaccgttcgtcttattaaaaaacttttgtgaaatatgtaaaactatatgtatacatataagtatatttaacaataaatcaaatgataggaaaagaattaacaattacttaattttttttataagatgaacagataaacatatttaaaaaagtcaacagcatcaaatatttagaaatgaaggaagcatatagaaacgtaattgtcctccatatctctcaagttgcatgcaaccacatatcctcgagaaaatctctattactataaaatcacttcttctccctctccctcacgttgcatgcaaccacaacatccccaagaaaatcagaaaaactgtaggatcgaatcacaagaactaagccaaccagaaggggtgaatggttgagatacccaaaaaccaaaaacttttagcggaaataaaagttaccctcgaaatcgatgaatcgcggtctgaccgagatagttgtgccggtctgaccgtctgaaagccaccggtctgaccgagattggaactccggtctgatcgcctgatcagctgccgcttgctgtcgccgccgccggtctgaccgccgctgagatgccggttagaccgccgaaacccggtgaaacacaaatcgaagaactctcaaagtagatgacaactttattacttctatctgtgtttacaaagtgcaccaacatcactccttacaaaaatctcgactaaacttgaaaccctaactaaactagctctcaaaagctatacaaaagcgataccgggaagcctcacgctccccctctatttatacatgaggtaggcagcctaaagccacgaactaaactcatactaagagtcctaaacaccttaggaaaccctctagtacaagacacaaactttacataaccaattgta

SEQ ID NO: 334 - DNA, 3423 bp, Oryza sativa
gcagccatcagttcgtttccccctacgtgagggatagatgacacaacatggtactgatctcagccgagccgaccaccgaacgaatcacgtgcaggagaacctggcatgctaatcgtgccctgacatgtgtgccaaatcatatctgtcgataagcaactgcaaaactgtaaactaagaagatgtttgggacagagggactaaactttagtcctctctaaaaaaaataagtccctagagagagccctctcccccaaacacctcctaaagcaagcgaagaagctcctagctgcagctaacctgcacggtgaaaattgcccaagaagctcactgggcgcgtgcagcggcgattcgaccatctgttccacgcggagtcactcctgggacacgtaacgccggggatgataagcttatctgacttttgacgaccggtcctagctaggagaaggtacagtgcgtgtatactctgcttgtcctgccgagccgggaaaaaaacgctagcgtacagcgacgcctcatcatccctccctcgcacggccacacacccccagatggttgggagccctcacccctgcaagatagtctcacacgcgagcccccccagccgctgcaacgtgacaagccaccccctgccacctcggcttcccgtccgtgagacgctctccgccgcatggcccagttgacgtggacgctgcccacctatactactacgcaccatggctgatggctgctgcacattggcaatttggaattgattttttttttttttttgcgtagaggagatgaggaggtctcacactccaagctcgcgccacgtgtacggcgagagctcgaatcgatcgcgagacggataaccatccgggggagtgtgggggctccgatgcgggacacctggcgcgggacaaaaggcgaggtggggcccacgcgtaccagggcacgagaccgtggtgccacgtgtcggcatcggctccggtataaaaggtcgccgcgcgcgccgttgttctggaacacacacactactgcgactgctagtgctctggtcttacattcgacgaactgatcgatattcgatacgacgtctcctcctacctggagcttgggaaaaatggagagcgactgccagttcttggtggcgccgccgcagccgcacatgtactacgacacggcggcggcggcggtggacgaggcgcagttcttgcggcagatggtggccgcggcggatcaccacgcggccgccgctgggagaggaggcggcgacggcgacggcggcggcggcggcggcggtggcggggagaggaagcggcggttcacggaggagcaggtgcggtcgctggagacgacgttccacgcgcggcgggccaagctggagccgcgggagaaggcggagctggcgcgggagctcgggctgcagccgcgccaggtggccatctggttccagaacaagcgcgcccggtggcgctccaagcagatcgagcacgactacgccgcgctccgcgcccagtacgacgccctccacgcccgcgtcgagtcgctcaggcaggagaagctcgccctcgcagaccaggttcgtgcgccattgccgaccaatcatcagctatacctgctgcatacgtgcacgcatggtgacaatgcgcgctttgccttcttgcaggtggatgagctgagggggaagctgaacgagcggcaagaccagagcggcagctgcgacggcggcggcgccgaaggggacgacgacgacaagaggaatagcgtgatgaacgcgagcagcagcggcctcgtggaggaggactacgtgagctgcctcgcggtgccggtggtggacgtctcggaggacggctcggcggcgtgcggcgggtcgtcgtacgagtacgaccatcacctagactacttgggcggcggccagctgcccgatccgttctgcggcatgccggatctgtgggagatatggccaatggtggaatggaacgcagtagcatgatcatgctaatcaatcagcgtagcatacagtatataaatatatatgtgtatgagtacgtgttgtattgggtctatatagatattttgctgctgttgctgctgctggcttgtgcagtcagttggtccggagagatcgactagagccgcggcgctcgtaagctagacgggagagcagattagagatggaggatgcaaccggccggccggcaaaccatgcaacaatgcaaatccacacatgcattgcgttgcacagatagaaatcctccggccggtcgatcgccgagtcttgctgcttgttatgctaggatgctacattaattattcatgttcgtgaatctggctcccctgcctcggagcccgttcgtgcacatatgtgaaacatatatatcaacgctgcgcatgtgtgccatgcccatgcgcatgccggcgcttgtcgtccatgctttgaacgttattgtgttcgcgcgcagtgaatgttactgtaggacgtgcagcgaccgcaccgagcggcggagggagagatcaacggagaaaacatcgcaatcgttggcgacaaggtcgtactcgcaccacaggagatgggtcgcgttttcctcgagctcgtttggaggttagcggtcgatccgctcggcgtggcgatcgactgttcgtcgtcccgcggcccgggcgctgttgcgcgggggaagcagagatgcgggggcaggtgtctgtcgcggagagagatcgacgagaggatatgctgcggcgagcaaggagcaactagcgaggattaagaaagttctggatgcgtgtggctgtgccggcggccaaatgtgtggtggaaaaccggaacgatcgaagcgagccagtgggacatgaaagcgacgcgaggccaaatgagaagcacgaaaaagacgtagcgcagccataggtgctgttgagctcttggaatcgagggcgctttgcgcaggactaagagcaagataatagtagagctaatttcctgctattagtccatcttaggacccctttgatttggagaataaacataggaattttgaggattccaatcctaaaacaaaggattaaattctatcttatcctttaaaattcctatgaaatggacaatcctatagagattttagaggaaatttagcaagagcttaaatctcttggaaactttcctttgagtctatctctctcatccgattcctgtgttcttcatgcggttcaatcaaacggtcatacatgtgtttttcatgtgttttacaatcctctgttttgcatttgcattcctattagaatcttacgtttttctatttatccttttttttcattcctacgatttaaatgggcacttaaagccaacatatataatagattagcaataaggttgaccacaattttctactcctctctctattgacacggtttccaaaacacaactttgacttgttatttctataaaaa

SEQ ID NO: 335 - DNA, 8370 bp, Oryza sativa
tattctttagatcattccagaatcgtgcctgatcaacaacgaagaaattccgattcacagataactgaatcgatgcatggcaggcagagctctcatctaggatcgcaaccaattgtagcgatcctgatagggatgtgtttcaacggatacaagataaatgtacggactttccgtaaaaacttacagccacttattccatacgatctgagccgcgtattctcgatccgatggtctgcgttgtcccgaaagaagattgcgatccacttggggtgccctttaacggagtacacgtaaatagtaaggtcttttcgttaaaaattaattcaccgcatgatctgaaccgcgaattgccgatctgacggttctcgttggtaccatgggatcactttgaacgactcactaaatagaagggccttttatgaaaaaacgcacgctctgccgccgccgtcatctccgacgctcctccgtggcggccggcggccggcggccaccggcgctgctcgtcgctgccccttcccatggccacgcgaggagagcaccaagctaactatgggtggtcgccgcggcagcatccttttctaatgaaagcgacctcgcccgctctggcgcggcagcgtggagcggcggttgctcgcggcgtgtttgacgaaatgccgcgccgggacgacgacgccatggccggggcatccacctctgggaccgcgcgacgcgacgagtcttctcgcgtctgcagcggaaactccgtggtctccgcatgattcgtgtcttcgtgagtcgtgaccacgggaggggaggcggcatggacttcttcaggccggcgccagcgcacatgtaagaaccgaacgattcgctcatcgcttttgtcatcatctaaccaacgatcgatgaaaagcaatgtttatcctgatggcgctgaaacggacaatgttgccatcagatcatgcttgatttctttttaatttttatttatcgacagcgtgattcatgcagcgtgtgcgaagtacaccagatctcagcaaacttttgtcaaactcaaacacgacgccttgttccaggggtgtcaatataaatagcaaaaaattgggggaccgtaccagcaaaaatctcagattgcgttgagctgaagctgttcgtgtgactcttctacaccttccaggctatccggaatcgggagggtttcccaataggaaagcaactcaggactcaggagcggcgtctgagaggtttcagagatggagaaccagttccaggtgagatctctgtaccctaatccttttctcctgctcttgtttgtgtcctgaccgacctgggatgccgaggacatgttgcgccaagaaaagcttcctttctttcccgggcatgtttcgtctaggttttcttgatcttgtttagggttcgtgttgaataggcggaagttgtacatgcgaaattggaggcggtattatgggattgcgaatctcctccggaaaattgatttagctgctttggatgattggctttgggggtgaaactgtgcttgtaaaatctcagatcagattaggcggtcaattattcgatttgctggtgggtttggtactcgagagcaccccaaagttgggagctttggtatatgtagcatggaacttgctatccagtcctcaacatggtgttctagtcctgtttgagaataatctaaaggttggagttaaacagtacgggatatctgatattttaaatggtacaacatagagtttagaggtccttatttattgaagaaatgtttccactatcaccatcatgtctagatcacccccacttcaataccgttgctctgttgatactagaactctagaagtattgaggccccttaaaggcttcaagcttgctgtcacttggttgacctgatgcagtcttattatataactaattacttcatttataatggtttttccattttttttgcatccacttgctttggagcatttgttgggaggttcttttcctaaggatatctgtgtcctgtcaaccagtcctggagcattactagaattgcatggatttcatcacttctgtttgtttttgcattccttagtcttatgaatgagatgacctgatacaacgtaaattatgttagatgtttaaactagacctcagatagtgggttatacctgtttctacttgttctgaagtatgttgtccattgctaatttaggatggcaaggaggaggtcatcgaagcttggtacatggatgacagtgaagaggaccagaggcttcctcatcatcgtgagcccaaagaattcattcctcttagcaaactttcaggtttgtgcatctattgctcaaacaatatgtttagcttttgtaactaactcttagtagaactagtgccaaattgccaaaaaacttgccagatgttaatgtggtgcacaattgatacaccagagttaggaatattaagctggcgcctgaatgctgatgactgggagaatgatgagaacctcaagaaaatccgtgaggccaggggatactcttacatggtttgcatttcagaacttgttgtgagtttccattttttttgttcgcaaggttaatatgcttttccttgtgcaggatatttgtgatgtgtgtccagaaaagctgccaaactatgaggctaagctgaaaaatttctttgaagaacacttgcatactgatgaagagatacgctattgtcttgagggaagtggtatgcatctttattatactagttgagcacttgataactagtaataacttgcttccagcaataatcatggtggcatgttttgtggttgtcacatacttctttttctcatgctcctctaggatacttcgatgtcagggaccaaaatgatcagtggatccgtgtagcagtgaagaaagggggcatgattgttttgcctgcgggaatgtatcaccgcttcacattggacagtgacaactacatcaaggtatcttttgctttgttcctttgttcccacaaatagttatgttataagcatcaaactgactttgacgtgaacttatgcgttttaagtatattggtgaacagcggtcaccatttttctgtcatttacttaagtaatctgttcatttcctaaacctatgttccatttctatgctcttatcaaataaggaacatcagtccaatatggttttttccttactatgcttctgcaggcaatgcggctctttgtgggagagcctgtctggacgccgtacaaccgtccccatgaccatctgccagctaggtatctgttctttctgttccttgttttcctctttatctctggcttatttttccggttattgttgactcagtggaggttttgcataatttcagaaaggagtatgtcgaaaaaattatcaacaggggtggaactcaagctgtcgaagctcgttaaaggcatatcaagatgtgcttcctagttcggtgttctgttacactctacagatactgaataaactgtgctatcagctgttgcaatgggctcctaccgacatcttacatcatttggcagtattttgcacaaacccgcttaaaatctccctgaaaatacgcacgtcaccatgtcagagtgtttatatacaataatgacacttcagtccacagtcagcaagggactaatgacaatcattgtacttgtggtgtgtgtgatgaaaccacaatgatcaaaccgagtgtctgaatctctgaattgttttttttagcacaatgattgtgtaccaaaccctctgttgctgtgtgcggtggctggctcacctgatggcctttgtgctactcctgtcgtcttcaaagtatctgacggtgctgaccaaaatctttgaaatgatagtgctaatgctgttgattaccgaaaagttggggcacattgatggcagataacctagtactgtgggtttctatggaccagagaactgcaaggaagattgtattgtatgctagtgagattgaacacgttcatgtgtacttttggttgccacttgcccagttgcgagtccggccaacggtggaacaactattttcaggtcagagcagaacgcgctccgatggatcatcaattcatcattccactttttttttgtgaggcagcaaattttgcttgtgtgtgtagtgcgaaagcctcacactagtatatcaaccaatgagtagcaaatgaaaatatcttggacagctagttttcgattggttgcagaatttggggtttcaacaacttgtttctattctttattttggtttaatactccctcattccctaaatgtttgacaccgttgacttttttaaatatgtttgaccgttcgttttattcaaaaacttttgtgatatgtgtaaaactatatgtatacataaaaatatatttaacaataaatcaaatgatagaaaaagaattaacaattacttaaattttttgagtaagacgaacggtcaaacatttttaaaaaagtcaacggcgttgggatggaggtagtaccatataactattgggtaagacctgttatagtttcggaaaaccattacactcaatttaaattcaaactttttatatcgtgtctggtagaatcatttttttttcaccaatgtttgaattcaaatattcctgtttgatttgaatgtttacccaataaactccggtaaagaacaaaaacagcacgtgagtcccacgtgagattgaaaaggaattcagataagctaagaaaaaacccagagagaaaaaaagaacaaacctttttttttctcctgacccctgcaatgaatatcatctagccggacgagatcgtgtgtgccaatcaccgagcgcggcaaacaaattctgtgacccacacgcaaaagcgtcgtcgaggccggatgagattcggatcagaaaaaagaaaaagaaaaaaaaagaaaaaaaaatggcacgagccgtcgatgtcagctatcgattccggcatcccacttgcggccgtgccggcgaacctcagccacactcccaggcttcgccttccggaagcttccgccgatccggccgcggccacgaaccgcgcggtctagaaccttccattcctctcctggccagtacacggttgtttatattgcgccactctcgctgactcgctcgctgccaagctcgccggattcttttcttggattggagcagattggggggtgacgatggagaagatgatgccggggatggtgaaggaggagtggccgccgagctcgccggaggagggggaggcgccgaggcccatggaggggctgcacgaggtcgggccgccgccgttcctgaccaagacgttcgacctggtggccgacccggccaccgacggcgtcgtctcgtggggccgcgcgggcagcagcttcgtcgtctgggacccccacgtcttcgccgccgtcttcctcccacgcttcttcaagcacaacaatttctccagcttcgtccgccagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgcattgttgtggccttctttttgtcatgcactcgtctatgctcaactgcttggtttatggtgatgcctgctgaaaaacctgaattttagctgatgccggctgtacgcggccgctgtgcagacatatctgggtgaagtctgaagaccatacatgtgaattttgtagtaggataaagtgagtgaaaattacgggtgaagtctgaagaccatacatgtgaattttgtagtaggataaaacgagtgaagtctgaagatcatacatgtggattttgcagtaggataaactgagtgaagtctgcagagcatacatgtggattttgtagttggataaagtgagttcagacttcaccccgatgagtttgcagtaggcaggatcaactgagcaagtcgctctggatagatttgttggagaagaattgccgcttgggatctggaacattagctagacgatggaagcagaagcgtgcagtacactactgtagagtgtacaggagggtgattcctggatgctagtacctgattgatgaaagttgtatacgatgattagcttcacaagaatgtggtgtgcacctggttgtgggccttgtggcgacttgactactactagtagtctagccgtctaggggtgtgtttagtttctgaaaaaagttggaagtttgggaaaagttgaaagtttagaaaaaaagttaaaagtttatgtgtgtaggaaagttttggatgtgatgtgatgtgatagaaagttgaaagtttagggtagtttggggtgaactaaactaagcctagtactccctccgtcctataaaaaacgaatctatgaccggatatgacatattatattactatgaatatattctaatatatgtatatccagattcatagtactaagatgtgttatatttggtatttatgggatggagggagaacttcagttgttgtgtacttttatggtcgatgatcatcggtggcgactggcaaccacggcatgaaccaggagaattttgcgc

SEQ ID NO: 336 - DNA, 11525 bp, Oryza sativa
ttacgcgatgtgcggaagcttagcaggctgggccgttttgtgggcctcttttgcttgttctgtgcaaaacaacactaacaacatctccactgcacccatctctcttgcaggctgcagccacccataagtacttcttttataggcaaaatttactaaatgacactaaaaatttgtgtaatttattggtagatatcgtaaaagcgtgtaatttattttttactgtaatgttgtgtttaaaccatgtgattctaggggcattcttgtccttctcaagaatttgtctttacaatcgagttgaaagtgtcatccatcaaacaaccagtttcttaggatgtcttttaaccgtgacataatttttcgatatctatcatcaaactactcaaaatttagacgtcctgtagcagattttacctcttctataatggttgaacctactgttactgcaccaaccagctaaacccatgaatgctgttacgcactattttgataattaaccaactgtttttcatatatttatatttataagctaaattttacttcctccatttcatgttaagtgcaaccatgagttttcgtgtccaactttagtcgttcgtcttatttaaaaaaaatttaattagtatttttgtttatatgagatgataaaacatgaatagtacattatgcgtgacttatgttttttatttttttaaaaaaatcaaataaaacggatgatcaaaattagacacagaaactcatgactgcacttaaaattggatggagggagtaaaacataactatagaactattttttatagtttttgttacagtttattttacaaacctttaaatcagtaaaaacacatacataaaagttttgatatttttttaaggcaatgaacgaggcccaacgaatactctacagaaggatgtacagtacagtaggaggagtctatactctatactacgctccgtacgcacattgtttgcggcagtcttcaagacaacttttttttttttactgccatgaaaggaagcaggcttgcggtgaaagaaagttgtctgccgatgacgatgccaatgccagagactttcgcacagtacagtaatccattgcggtcaactagggcctacggtcaactctgcagggtgccagggtacaggcagatgcagccgaaagccgttcaaaggaaaggaaaaattactacaagccgagcagaaacaaagctctttcaagttcacacttcacactagaggtgtgtttaggtggtgtttgaatccagtgacttaactttaattcacactaatttagagtattaaatatagactacttataaaactaattatataaataaaagctaatttgtgagacaattttttaagcctaattaatccataattagataatgtttattgtagcatcacatatgctaattatagattaattaagttatagattcgtctcacgaattagtccaagattattgatgagttttattaatagtctacgtttaatatttataattagtgtctaaacatccgatgtgatagggactaaaaatttttagtcccatctaaacaggttcttacttcacgccaaaattggaagtttgattgaaattggaatgatgtgacggaaaagctgaaagtttgtgtgtgtagaaaagttttgatgtgatggaaaagttggaactttaaagaaaaagttgggaactaaaccaggcctaggcctagttggcaaaaataaaaattctttgatgtcacatcgaatgtaaaaagtttttagacacaaatgaaaaaaactaatttcataactagcctggaaccgcgagacgaatttattaagcctaattaatccgtcattaccacatgtgagttactgtagcacttatggtttatcatagattgtgtaattagtttttttatctatatttaatactccatgcaagcgtataaagatttgatgtgacatttttaagaaattttttttgaactaaacaatgtctaaaagaaagcccagtcacaatttaaaacttaatttagaactattccaagcatttaaattttgaaaattaattcaaaataattctaagcattttttttcctattttcagccttgaccttaaaatcactaacgcaaagttctttttttcaccttcccaactaatctcttgcttttcacgcgcacagtttttaaattattaaacggtgtgtttttttaaaatatatataaaagtttattttaaaaatgatgttaattgattttttttcagtgttctaagctaatataattaatcacgcattcaaaaggaacacagtttgtcgtaccgggatgtgcagtaactcccaaacacagccgaagagtagaaatatgaaaatcctacccaaaaagcatttctcatcatcagtgctacagtacctatatgtgctattgacggattaattaaatttaataaattcgtttcgcggttttcatgttagttatgaaattagttttttcatttatatccgaaaacctcttccgacatccaatcaaaacgtccgatgtcacaacaaaaattttcttttcgtgtcaccctcatttgtttttctacggtttgtatttggaaggtaaccaatgtgacactgcatcaagcagtcaaatgtcaaataatggaaaatcaatccatttccgtcttctgcatgctcagcaagctgtccttgcctgattggctcgattccctcgggtttcccttgaccacttctgtcggaggcacatgtactccagctgcacggtcgttagacgtctgaagtctgatgtatagacggcgcacgtctccagaccaaaattccaaaccaatccaacagaacatgtgtgtagaaattccaaaccattccaaacctttgttggcctctcggtctccatgttcagactgattaattaccaactgacactagcctaaactctttgacactcgtttcgaactttcgatctcaagtaggataaaaggtaatatgctccgtgagtcattcccaacccaataactaggataatttccatagtattaaataagctaccacctaaaataaaaaataatgtggtaagtgaataaatgagaaaaaaaaagaaaccaaatcttgtatgagatatggtttctacataatatacaagatattatatgagataagtagcattaaatttaagtatgaaaaatagtgtttgtattgaaagagtagtgtcaagtgatagtttctcgatgaggtgagtttatagaaactatatctactgtgggaccggcgttagtcgaagcacactgcacaaaacagtagtatatcaacgcgtaaacaccaatcattatgggcataaaaccgtcataaataaagcacacagcatgtactacagttaagacctactcttagaaaaaaaaaactatagttaagacccctcctgatcattcttgcttcctagataatcagggtgccaacagaaaaagaaccacacgtttctactctcgagtaattgaattcaatcaacaactattggtgttcctgcaaatgaaggcctggaaaatactctcgtgtaattcgctcatgaacacatgtctgtatcacccagatagtgcgagattaaattctagcagaacatggcatcatctactccaccattacattcctatgcaccaactgtttttggtgtagacgcaaaatatcagcgacagacagagaagggaacgtactagtttgtatgtgatcaaacgcatcgtcttcagatcagatcagatcagatcagatgttggatttccagttgtacttacggcgaccaaaaaatatctgatccggcggaccctcgttcagcggctcaggccatcttcggctgttactgttgggaaagagctagctcgttctctccttggctactactagtagacttgcggagtatttccgaaccgctgcgttcaagatggcaacggtgaattcaccatcgggggtcacacccgcgtccccgtcatcgcggtgaaaaaatttcaccgtccccgttccagtcaatcacgacggggctacaatttctccagccccgatcaccacgtggtgaacccgtccccggttaaacaacaaattcatcaacaaatcatataaatgcaatggaacacaaatcagcagtacatcacattgatatttttccaaaataatatactcaacaaactactggtcatatcgacggcgacgaacggcggaggaatcaatggcggcggatggcgtgctggccggaggcggtgggtgccgcgaccacggtctgaggcggcgcgtgcgcgacgacggccggaggcgctggtcggagcgatgacgtccggaggtggcgagcgcgcgtcgacgacggccggagacatcagtcggcgcgacgacggcaagaggcgatgggcggcgcgacaatagccggcggcggcacgcgtgcgtcgacggctgggggcaggaccgcgcccgcacgaggggagacgacggccagcggcgctatgcgcagtgccgcggtggctggggagatatttggagatggggagggttgattagggttagaagatatatatacatggttactgagcttcatttttatgggccaaaacaactgtacagtctagaattggtccctagctacattacatgcgggtcaccgcgggagacggggatggtgaatggtgcaccgtccccgcccccgccatccccgatggtgatgagttttggaccattagattcaccatgggtggtagatatcaaccatccccattctctaatatgtgaattcatcgcggggaatcgatgatcaggtccccattgccatctctattccttacacaagttttccaagacttctctttcgttttccgcgtgcacgcttttcaaaccgttaaattgtacgtttttttaaaaaaagtttctatacaaaagctgctttaaaaaaatcaaattaattcattttttttttaaaaaatatctaatacttaattaatcacctgctaatgaatcacttttttttccgtgcagtggagttagttcccaaccccaagtatcaaacacagccctatatagaactttactgataatcaaatgaatttaattttgtatttttttaaaaaaaataatatttaattaatcatacgcctgattatatatctcgtttggtgtaccgcaatcgtttcacgagccacgtctggttcgaacaaagcctaagtttttaaaagtaaaatactccatcacacaaagactcatttttatccgcttcatttgtccaaaaacacttaatcttcaatacaattaatatattggagtttaaaaaattgatagacaaatgtgttagagtttaaaaaattgaagatcaaatacatcgagtaaactctttatatcggtatatgtgtaaaataggagtaagcaaaaataaaatctttttgggtgaaggtagtacactctaatatcaaattaatacgacttccattgtaaaatatagtattcttgtattttctccaaactaaaatgaaatgtgacatattttataatagaaatctgagtttcatcatatctagaatcaaattactaagatatgtcgtatctgtactaattttttttgaacgaaaaagtactatatataaaagtaagaacgcgtagaaaaaaaatatagggcctcatcttttcgcttatgcttatacttattagtcaaaattaaaaaaattaaccttaaatttagagctgattcgttaggaacgtgtagggcttgtttggtttagtgctgtaccaaaacattggtaatgccaaacttaggcatgttttggtactaccaataatttgctagggtagaattcttactaatgtgtttggattgatatgaattgagagccaattttttttatggtaaagaaagttctagaattataccaattttagcatgggcattaccatctatttgtattaaaccaacccatcatatttactattcaaattgtataaaaaaaataagcatggcacattttaatatcaatctaaagtgacccgtatttttaagtaaagaccgagatattatattttattataaaaaaagtgatccgtatgtaaaagttacccatggctccgctatatgtacaatatggacaagcaagcgaagcaagacaatcagagcaaacacagtagcagtagtatgtaacgttatccgagctactagtagtagtgttccagtacgtgactggctgtgcctttcctagtggaggcccacaccacacccacgaaacgtgtccctgattcccccgcctccaacgaacgacttgaaccttccagaacaaaccaaatccataaaaaaagacacggaaacttctcgcactttcccccacccattctcccacctcccgcacgcaacccaaccctccctccgtccgatctcccgcgcgacgcccatccaaccgccggtcagtcgccgtgacacgaccgacttgctgtgttagcccctctttagattccacgctaaaactttacccccttattaagcgaacatttgaacatatgcatgaagtattaaatataggctaaaataataactaattaacagattacgactaatttgcgagatgaatcttttaagtctaattactctaaaatttaatatggtgctataataaacaattactaataatggattaattaagcttaatgaatttatctcacggtttattgacgaattctataattattttttattaatgtctaaatattttatacgaaagtctatatataatgtctgttgagacacgctaaaattttactaccctaatctgcacacccccatagtttatatctctcccgcctcacccgctcccacctctccttccgtttcctctcattaacttcctctctcgcttcttttctccacgccacgctacccgaaacttccagaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacgtacgcctcgccgccgcgttttcctttctcttttccgttcgatttcgatcagctcgactaatttttgtctcggcctcgccggaatggattggattatacagggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacggttcaaactctacctaaaagttgtgtgttagacccgtctcgtttaatcaatctactctagcaattaactacttctactcctcgatagaaaaagaggcaatcaaccttgggatttacctagtcccaatgtctttgtagtgttcttttttacttgtagtatgtagtactcctactagttttttttttcagattattatcctttgtatatatactgctgctgctagtgagaaggcataaaagatcagatcgagttcacttgctatttctaaccttttgtttggtcatagacggtgtggagatgtgagatttggctgccggattaagatattccaagggggggattagtgatggcgtttgttgtgtaacggggaaaatatcttgcccacacggcgcacctactagaaggtgcgaaagccacttttcttccaagccaaatcgggggttttgattttattgcgatttggacagtgacctgtcctgccagccagccaacggtcgagaccacaggattctagtatgggcatttcgtttcccagttcagtttcgttgttgttgttgttaggagcgagtcaaattagtcaaagacgtcgagtaaatatcatttttaattgacctggttaaaatcatgttagttctaccgaacattgatggttaatttttgagtattttttaagcaacatagaagcaaaacggctgtctgatggttttgtgccattttacactttacagttacccgttattatatgatacagtaaattatagccaaagggaatgaggtacaagttgtgaggtgctactctgatttgagtacttgagaccattttaggcacgactcaaggttggaggtctcaaagttgatacttggcgctccatctgcttgtacaatgcaggtttactataaagatttggggccttattacctcatggatggtctaccaatagctatatcgattcaggctgtttttagttcccttcaaactttaaactttttcgtcacattaaatgtttggacatatgcatgaagcattaaatatgaaaaaaaaagcaattacacagtttacatgtaaattgtgagacgaatcttttggcctaactacatcatgatttgacaatgtgttgctacagtaaatatttgctaatgacggattaattagacttaatagattcatctcacagtttataggcgaaatctctataatttgttttgttattagtctacgtttaatatttcaaatgcgtgtctgtatacgttaaaaaagttttagacggagaactcaacacggcctcaatggagatcgacacagaacattcaaaactggtgggagacaaatacaaaggagtgcccaagaaagatctacgcacactaattctcctgattgtctaggagacctggaacgagagaaacccagcgatattgcagctccgaatctactgagaaagattaagcaatgacttaggctctagtaggagtatagctgctacaggattggagctattacctagtaactttgtatactctatgggtgtgtttggaagataggttaggagaggttgtattttctcctctttatttaaggaaaaaacacaatctcatactttttttttcaaaaattgatactccagcaatgatttaatcttttcttgagctataaacgtgtcctcctcacattgctcatattttttcccttttgaaagttcacgttgtctcacacctacgatccatggctgccatcctcaagtatgcttcatggtggccatgcagacatgatgtacctttaccgtgtacgatgtaacaaagagtgtggagccaagccgagcaaccaggacaagaaagatgtgagcactgtgtcgtttaatcctctctctcgaattctcggagttcattgatcctgacaaaaatgcagttaggctgtgtttggatctaaagttttttttttcaaacttttaacttttctatcgcattaaaacttttttacacacacaaactttcaatttctccgtgacattgttccaatttcaaccgactttcaattttagtgtgaactaaacacatagcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagaaagttaaaagttcggaaaaaaaagttaaaagtttatgtgtgtagaaaagttttcgatgtgatatatgatgtgatggaaagttgagaataaagcggaaactaaacacggccttattaaacttatcgatactaatttactcagattatctcctcttatgaagaaagtagtggggaaattctcgtacatcctgcagattctgaagttggacggcgtgacgagaacacggtgataagagcggcggacatgagacgcggggattccacatttccgcgtctccatgacattgttatggccgacgtgtctacaaccccatcatattttgaattcaggttgtctagcccaccaccttatatagctaatcggaagatccacgggcgtttctcgaccaacattactcctcgatagccgcccatggcaaatgctccaacgccgccaaggtgacaagaacagagctttccattgccaattcgccgttgttcttgcagctacctctggtgcagatcagcgagacgtgacgtccgagaggatcaacggcacgccgaacagcaggaggaagaaccaggtcgatcaatcagtctcagttgtgaccaaacgccggctataatgcagcgcaaagaacagcaacgacgtgccagggatgcccaactcgttgggccaagcacccagcccggtcgcctgagcaagacgctgatgtcagagtactccaacactgaacaaattcaagtaattgagttttgttactctggtgttcaagtaattgagttttgttactctggtgtgtttggttcacgtttaaattggaacgatgtgatgaaaaagttaaaaatttgtgtgtagaaaaattttgatgtgatggaaaagttggaagtttgaagcaaaagttatgaactaaaccaggcctctgatgatagagagttaagggccggaagaaaattattaattgagcggcgaagtgagcgtagcttaactgattatattttttaggtgacctatctgggt

SEQ ID NO: 337 - DNA, 5584 bp, Oryza sativa
caactgggaaaaaaaaatgaaatgtgctttccctataatggaagagggaacctggcttctctatttttaaaaaaaaaactgaaaaaaatccattacgctaacatttttactcaaaatacaggctagagcttgccaaaaatggcataattactaatgaattatcactaaggccaaactcattcatgatgtggggcgaaatggcaagaacaaatcaccttccttccggcgatcttgcaggagcgccgtcccatgcaaagcggctggaacgtcgaaatcctccgcctcgccgcgtgcctctggaacaatctggcgctgccgccagcagagcctctccctgaacacaccaacgcatcaatcgctggatccgtggagacggccagacgggagacgagtgagcgagcgagcgaggactggttaccatggaggacggcggcgctcctgagagcggcggcggaggaggacagcgacgaggccttgtggacgagcgcgcccagagcccgcgcggcggacgccatggcggcggagcgcgcgcaccaggtgctcgacgaattgcccgcttccggcggcgcgggctggcggaggaggagaggagtcagcaggacgcgacgcgagcctggatctggtgggattagcgggggacggctcggatctctccacgccctcttccctcagccgttggatcgaccatgtcctggttggtagccttggctctgacagctgggccaggtgactcgccacgtggcctcctcgtagggcggaagtgtcagctgcaatctgattccgataaaacctgacttgactgagttgacccactactacactactatgactcgtgggaccccacagactcgcagagcgggcacacgcgtcgcccatcggatgcgcgccgcttaagatccaacggtgtaggaggctcgtgggccccacatgtcactggaatattcgcgcaccgtctcgcctcttctcgtccttcctgccgctgttggcgtcgggcattttccatccccttctagactcccgccgaacaatccactccgcccttcatatgcgcgcaccgctcctcccgttgtttccatcgacagaagagagagttcagatcaaacgccgaagcaattcttccgcaagatttcgagtgatcccatctcaatccaagctaaaccgagagattttgatttgttgctgtagattgattgtgtgaggagaggaggagcagccatgaatccggacaacttcacgcacaagaccaacgaggcgctcgtggcggcgcacgagatagcgtcggaggcggggcacgcgcagctgacgccgctgcacctggtggcggcgctggcggcggacaagggcgggatactccggcaggcgatctcgcaggcgtccggcggggacgccggcgcgccggactcgttcgagcgcgtggtgagcggggcgctcaagaagctgccctcgcagtcgccgccgccggacagcgtgccggcgtccacggcgctgatcaaggtcatccgccgcgcgcagtccgcgcagaagaagcgcggggactcccacctcgccgtcgaccagctgctgctgggcctcctggaggactcgctaatctccgactgcctcaaggaggccggcgtgtccgcggcgcgggtgcgcgccgagctcgagaagctccgtggcggggagggccgcaaggtggagtccgcgtccggcgacaccaacttccaggcgctcaagacctacggccgcgacctcgtcgagcaggccggtaagctcgaccccgtcattggccgcgacgaggagatccgccgcgtcgtgcgcatcctgtcgcgccgcacgaagaacaaccccgtactcatcggcgagcccggcgtcggcaagacggccgtcgtggagggcctcgcgcagcgcatcgtgcgcggggacgtgcccagcaacctgctcgacgtccgcctcatcgcgctcgacatgggcgcgctcgtcgccggcgccaagtaccgcggcgagttcgaagaacggctcaaggccgtgctcaaggaggtggaggaggccgagggcaaggtgatcctcttcatcgacgagatacacctcgtcctcggcgccgggaggacggagggctccatggacgcggccaacctgttcaagccaatgctcgcgaggggccagctccggtgcatcggcgccacgacgctggaggagtaccgcaagtacgtcgagaaggacgccgcgttcgagaggcggttccagcaggtgttcgtcgcggagccgagcgtcccggacaccatcagcatcctgcgaggcctcaaggagaagtacgaggggcaccacggtgtgaggatccaggaccgcgcgctcgtcgtcgccgcgcagctctcggcgaggtacatcatgggtaagttgctcctgccgtccttgccattgccattgccaacctacattgtcaagctcgagttcacattcttgtgccatttctgctctgtaattcttcaggacgccacctgcctgacaaagcgatcgacctcgtcgacgaggcctgcgcgaacgtgagggtgcagctggacagccagccagaggagatcgacaacctcgagaggaagaggattcagctggaggtggagcaccacgcgctggagaaggagaaggacaaggcaagcaaggcccggcttgtcgaggtcaagaaagagctggacgatctgagggacaagctgcagccattgacgatgaagtacaggaaggagaaggagaggatcgacgagatcaggaagctgaagcagcgccgcgaggagctccagttcacgctgcaggaggccgagcgccggatggacctcgcccgcgtcgccgacctcaagtacggcgcgctccaggagatcgacgtcgccatcgcgaagctcgagagcgagacgggggagaacctgatgctcaccgagaccgtcggccccgagcagatcgccgaggtggtgagccgctggaccggcatcccggtgacccggctcggccagaacgacaaggagaggctcgtcggcctcgccgacaggctgcaccagagggtggtcggccaggcggaggccgtgagcgccgtcgccgaggcggtgctgaggtcgcgcgccggacttggccggccgcagcagcccaccggctcgttcctcttcctcggtcccaccggcgtcggcaagaccgagctcgccaaggccctcgccgagcagctgttcgacgacgagaacctgctcgtccgcatcgacatgtccgagtacatggagcagcactccgtcgctcgcctcatcggagcaccacctgggtaagtatcaatcccaatgttgttttcacagttcttgcaaccgaatttcgggtgctgacatgggggaaatttctctctctgaatgaagctacgtcggccatgaggaaggtgggcagctgacggagcaagtgcggcggcggccgtacagcgtgatcctgttcgacgaggtcgagaaggcgcacgtcgcggtgttcaacactctgctccaggttctcgacgacgggaggctcaccgacgggcaaggccgcacggtggacttcaggaacaccgtgatcatcatgacctccaacctcggcgccgagcacctcctcgccggcatggtcggcaagaactccatgaaggtcgcccgtgaccttgtcatgcaggaggtatgtatggccttttgctttccacaaccatggattcatttgcaatgcaatgcgatgctgaattgatttcgatattttgtgcaggtgaggaggcacttccgtcctgagctcctgaaccggctcgacgagattgtgatattcgatcccctgtcccacgagcaactcaggaaggtcgcccgtctccagatgaaggacgtcgccgtccggctcgccgagaggggtgtcgccctggccgtcaccgacgccgcgctggacgtcattctgtctctgtcctatgatccggtacgcgacagcatccaactatcaggtcgaagtttttcaaagaaattctcgtcgaatttgattctaactctctctgtgactctggtactacgtacaggtttatggcgcgaggccgatcaggaggtggatcgagaagagggtggtgacgcagctgtccaagatgctgatccaggaggagatcgacgagaactgcacggtgtacatcgacgcggcgccgcacaaggacgagctggcctacagggtggacaaccgcggggggttggtgaacgccgagacggggcagaagtcggacatcctcatccaggtgcccaacggcgccgccaccgggagcgacgccgcgcaggcggtgaagaagatgaggatcatggaggacgaggacggcatggacgaagagtagtaagtagtagagcgcgtatgtgcgtgttgcgcccccgggcagaggcagaggagggcgccgatcgagctgtgtgaatgaatgtggggtgtctccgttgaataagctgtgaaatatggtgtttttccgatgatgcctttttgtgaagttgttgttctgctaagacgactttcttttgtgaaatttctgatgaactgaagaagtgtaaaaacgtttacgttctggttgagttgagttgaaagttcatgtgtttacggatgacaaaatggaactttgttgaggcatgatatgcagtacttgcagggtgcagtttttgttcctcaactggaacgaagttacagatggagcatctactgttgataaattgcccggtaatcacttatgcacgtgtgggtttagggacatgagtttggatagaacatcaaagtgtagcggaatcttgattgcttaccaggcaggtcggcaacgggctgtcgcataaaaaaaaacaatgtacatggctcttcgatctgcgttttgcgaagttccacttaaccttcggattccgctgttggtttgatcatatgcttctgctctctcaggaatcaacacaatctagcaggaatcaacataatcaagaccatcactacgaattttttttaagtagagataataacggggcaaaaaaggaagtggatacgctatgtgagcatgtttgttgcaacaaatatttgatcaactatcgagcaaattatctgatcaactatcgagcaaattgagggaatccattgtactacattgccagttaacttcagaattcaggcaacaaaattgctgaaaaaagatctgaattttgaagctaaattggtttgtcgcaggctggaagtctctactatcagattggatagctgggcataagagcaacatcaaaagggcttcaggtccttggaagccccactgaacatgatgggtttcttctaaaagcgcatccgtcaagcagaaggttatcatcacttgatcagttgcaatatttagatcctgtcaattgaagagaatgaagatattatacagcatatcagctcatatcctacaaatggctttatctatgcaacacaagtacttggggagaaaagcaaaaggaatgttttaacaacaccgtaccaccaaattatcagtttataagctataatgttaggtttatcttttcagtgcacagcacattgtattcatagtcctaagaataggagaaaagatcatttgtgttagaactcaaacatttatgcctat

SEQ ID NO: 338 - DNA, 2848 bp, Oryza sativa
ggttttgcccttaagagcaggtataatagcaagcttaagtcagctataaacatattttaaagagataaaaaaagatagagaagagcagcgggctacagatctgtagtcagctgcagcacggacttcaatacgtaatgtatgtatgataggtgggaccaggtattaatagtacagtaagcaactattgtatgaattgactattacattggctatagatgattttaagttagtagtgggctatactattaaacttgctctaattgttttatgccagagccataattttatcctttcttttgaggaataaattttatactacggagtaacttattacgcgattcacggttgaatatctgtttacttatctttttacttatacttatatttatcaatcaaaatttaaaatttcaactttaaatttgaagttgattttgggggttttgatcaaaattcatttttcagtctttgctttaagatcactaaaaacacgtatatacaagttttattaataaattattcttttttggcaaatatgctgtttgcaaatgtgttataggcttgtagtaacggggtgtgatacaaaatcctttaaacgtccgtatttatcatgctgaatgaataggttggcaagtgtttaaaaaaaaataggttggcaagcagtgggtcgctgattaatcattcgtcgttgtgcagaagcatctcgtcttgcagctacctgattaagtatatgtgattaacactggacaaatctggaacaaaaattaaatccggctggtctttctaaatactccagtttaatacagtacacatcaaatctaagtaggcaatcattgatttcatccagaccagcacttgggagtgtggagactagtctggactgggaagcaaagccttttctagaagggagcagatcaaatcaggagcaccgaaacaaaagtagatgactcgagacgcctcaagaacgtccattgcgcagctcccggacaaatcctataaatatgtgcaccgctcttgtgctgaaacccaccgaggaacacacaacaaacaagacttgcatacgtcccaaactcccaaatcgccctctttgcaatcgcttcttccgttccatttcagtagcccacaacttcgcatcagaaagcgaaagatagagcaaccatgtcgctggtgaggcgcagcaacgtgttcgacccattctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttcaggctgccggagaacgccaaggtggaccaggtgaaggccggactggagaacggcgtgctcactgtcaccgtgcccaaggccgaggtcaagaagcctgaggtgaaggccattgagatctccggttaagctcctgaagatgtgatcggtgagggaagaagtcatgtttggtgtcagtaattcagtatttcagtgtgtgtttgtttggtcgtgcaagtatggtctgctgctggtgtgtcgtacccgttgggagtccgagtggctgagtcggccggtttcatgtattcctttgtgagtacttgtgtaatcgccttcttagttcttgctcgttgaggaataaataaagagcttttcaggttgcaaacatcatgcaaacgtttttgaattccgatgttatatatactgtgttatactagcttttgacaacagttatactcctaggtgtgcggtggtctgatttgaaacttcagccgaagaaatggaatgtgataagagtcgataagtttcaggtcactatatttttaagtaaatttaataaaactcacgatttatataaggtttaagttacaaaaaacaacatcatattatacctagaatgcaacttcaaccataaaacttttaagagatcagttttgacaccttatcgtttagtacattttgaaacgtttagtagatcccaatccgatgcagcaccatcgatctcagcaccatcacgagcatcttcttggcagggctaacaaatttccccatgaaatatctcggactaccactggtggtaggaaggctgaagaaagtccatctccaaccgctgctagacaagtgtcaatcgtgcctggccccctggcaagggaaaatgatgtcagcggccgcaaggatctgtttaaccaaaacagttctcacagcgcagcccatttaccacttaacctccctgaagcttccggatggaaccttagaggacattgataaaataagaaggaaatttctctgggcaggaggggaaaacatttctagggggaaatacaaggtcaactggaaaagagtctgcaggcccaaagacctgggaggactaggaataatggaccttcagcgcttcgcctccgccttgcggcttaggtggctatggtatgaatggacggccccagagaagccttgggtgggaacggcggttccgtgcagtcaggaagatagggagcttttttcggccgcaacaaccataacaatcggcaacggtagaactgctcgcttttgggactccaagtggctagagaaccaaactccttagaaaatcacccagacatctatgtggcctcaaaacgaaagaacagatatgtccatgatgccctgcaggaaagcaactgggtcagagaca

SEQ ID NO: 339 - DNA, 2749 bp, Oryza sativa
taaattgaccgtattaaattcagttagtaagaagggttagaaaacgataggcaaataaacgataaatagcaatagatcaatcacataagacataagatttaatgtggaaaatcctctcaaagcaagagagaaaaagccacgggtgccaggcagcaaatatcttcactataacgggttgaggttacaacgccgaacggcggcttacaagaagtatatatgaaggtgaaacactaaagtgataaggatccgtccgaagctagcctttatacatgtggaaatgaatccttgagacgaattccttttttagcataaatgaatccttcaacctaaacacaataaagaaaaatactttcggtgccaaataacctcttgggctaaatcactataccaactaagtttgagcaaaaagcaatagaaaactagctttgtcatcatttccgcttcgttccggctgaagcctccgacgacgggcctccgcttcgctccgttggaagctagactttatacgtgtgcaaatgaatttagatcacaactcaacaagaaagagaccggaaatttcggtctcatttctgttagttcggttggttttaatttattttgtccacccctaactaacgttaaatcgacgaaaacctactaaaacaacaaataaatgataaaaacagttcgaatgagaggcattacagccttacaggagagtgaattttacaagggtaaatgtctagctcggttaactttagaggataaataaataattttcttaaaaaggaaaaaagagcacatactaattaatgaaaatcataaaacaaggagctccaggctccagtaagcgggagactagtctagaaaagagtgggtcctgctggacagagacaagggaaataagctgatctggaaagaaaagagaacatcagagagtggagatcactcgagatgcttcaagaccaagttctgaagaacctataaatacgcccaccttgcatcgcatctccgcattcaaggcagagctagtagtggtcacatcgccaattcacagtcgaatcaagcaaaccatccaaatcacacccaactcttcttcttcccatcctccagagatccaagcagcttagccatgtcgctggtgaggcgcagcaacgtgttcgaccccttctccctcgacctctgggaccccttcgacagcgtgttccgctccgtcgtcccggccacctccgacaacgacaccgccgccttcgccaacgcccgcatcgactggaaggagacgccggagtcgcacgtcttcaaggccgacctccccggcgtcaagaaggaggaggtgaaggtggaggtggaggaaggcaacgtgctggtgatcagcggccagcgcagcaaggagaaggaggacaagaacgacaagtggcaccgcgtggagcgcagcagcgggcagttcatgcggcggttccggctgccggagaacgccaaggtggaccaggtgaaggccggcatggagaacggcgtgctcaccgtcaccgtgcccaaggccgaggtcaagaagcccgaggtgaaggccattgagatctctggctaaaatggtgaaaacgggagtttgtcaaggtcaaggcgtgtcatgcatgttcactctgaactgtttgcggtgtttcactcgggtttgatggtttttactagtcctatgaactgtgtattcttttgtactctgttgtgagcgcgtttgcacgaagcaataaataaaaataaaatcagcttgtttgtatattgatcatgcatgtgtgctcatgtcgatcgccgcagccacgcaatgcgtgtgcacagctgcacaggtcgaataattagagtgtacacgttgccggcgataactagctaaactccagtggtgcggttatcttctctgcttgcggttttattgatcgttgttctagtgcccttgaagcggaactgcttgcttgtaaggagggtattaatatggcgctccaatggaccttactccccattattgttgtggcggattgcttggtggctgtctctatgatcaggatgcaaaggaggaggcgccaggggcggagccaggattttagatcgatggaggatgcaaaggaggcgtcaaccaggggcagagccaggatattagatcgatggtgtcactatcaatgataacaacttaagtaaaataaaattagtgctaattgataaagtaaaatagaattttcttttcaaaaataattcgacttgtattcatgccaactatctaattggtgaaattaaattataaaagactaaattaaaattgctagatatacatgtgcaagtgaataataatattctttctaggttaataatatttgccgttttggataagaacattgtctcataaaacaactctgaccactaactgtgagttttaggctatcaaacaactttgaccacgagtcaaatattgtgagttttgggctatcaatagttaattaagctgctagctactgtctggctgtccatgctcacataggatggtgtcacaaagcaagttaatttggtgtcactcattgcaaagtaaaaggaataatgaagacaagacacaagccattggtgtcatgtgacaccaatggttgtacactggctccgcccctggcgtcagcgttggctcatcttgtcagagacatcgatactctgttgagaggaagaagggagatcatactgaagaaaattcatcgttctcagaattctgtcagtcatgttttagcaaataaagcccgtactg

SEQ ID NO: 340 - DNA, 11257 bp, Oryza sativa
atatatatatatatatatatatatatatatacacatagtaaatttgtttggtgctccatggtgcccgggcaccattgttgaaattgagtatatacccaatttaaatgagtatgaaactttttcaattacttaggtattaacattaattactttactaactagttcaaagcaagtttgaactgaatttgaacttgattttgttagattttgattctaggtatatagcatccatacatataattagttaggtatgtaatcatggattgtgaaataaagttaaatttgagttgttttgttgataggtataggtatgaatcgaattattataactaggtatatattcataatttgaaaattttgagtgattttgtgtattattagataccatggtgcccgggcaccatggtgccccatatatatatatatatatatatatatatatatatatatatatatatatatatatatatatatatatatattcattaacactaatatgaatgtgagaaatgctagaatgaattatatcgtgaaacggaggaaatatgttttataatctaataacaataaaaatactaatcataaaaaaaattttaaattagacggacgattaaagtttgatacggaaatttatggttgcgcttatctaaattggagtaatatttttgagtgtattgttttctttgaccatcactagcttctaaattattattttttgaacaaactaattaaagccatttggactatatgacaagcaccgcatttcatccacgtggcacacttttaaatatatcaaatttcgcaaatactattatcataataaatatcaagacttcggtctctaacaagcttttgctccagaagcctgtagcggccgtgagttctccttttccaccttcctccttgacccctcttcctcctcggtttcggcggctcgtcgcgaacaacagcaggaatagggatcaaccctcgtctaaggtatgatttttcgtgtaacttggcttaatttcattttctcttagttcttgtgatacagtccgaaatggtcgtcggcgccaactcgatctctgtcctggtgttacgaggtaattcctccgtttcacaacgtaattcgttctaacattttccatattcatattgatactaataaatttagataaatatatatgtctagattaattagcatcaatatgaatataggaaatgttagaatgatttatattgtgaaacagagggagtagttgtcagaggtttaagatagttgttttgtttttagtgaggcccgagatttatctctggtcagtcactttaagcacgtgctaatagacagacatatttctgggtttgcctgcataattgaaaacaaaagaacacggattatctagacgattaacatgttccctaacttgattatttattcatccatttttaaggcaggaatcagatcagcgtggacaacctagctcatgtgtatctagtttatcagaactgaaatgaaatagcccaagttagcccaatttgatggttcgtaagcccatcttctgctcgcttcgttgctaggccgtttctgtcctgccacgtactttcaggcccaaatacggagcccagtttgttggttggatcagttaggctttgtagctggctatgcgccaacctttgtatgatttcacgtatgtagtttaaatcacttaaattgagctacactttataaacactagtttttcataatagtatttagaagtgtatctaaaatctgaataccgacgagtatagatagtaatttacccgtgctaatgccacgacaatatttgttaacaaagaccccccccaaaaaaaatacacatagctagaaaatagataaatttataaagctaggtgtgtaatataacatcacatataccttcttttactatgcaatttgcatacaaatactttcggccaatctcaattttttccccttcagaatgaaactaccagaactttacatctaaccatcttacaaatctgtctccacctgtataactagctaattaagtcgcgctttcgcgcgacatgacctatccttttttatatatgataattagaactaagggcatgtttagattactgccaaaataaacttttccaaaatttggcaatatcaattttttggcaagttgatagtattgtcaaattttgatagaatgtgataaatatgatgttaccaaaatttgcctagtgtgtgaaatttatcgtaaatatttatattagcacctcttctcaactttatatatatattattagcatgtatatattttaattattaatccaagtaatttttgaaaatttattttaaagcattaacttcttaacatttgaagaacctcgttctgtattattgaaagggaccataccacgcttggaaaaaaacattagttttttttctaatattatttttggagtttaattccaagtttttttatgctttcagtattaaaaaacaatttttctatatatgcccctctttagattgtaaatggaccgtaattggtcgcgtcgaaaaaaaaaatcgtcctccattttcgtgtgtggatccttaagaggactacacagaaaaattaattttcacaaatggaccacttaagtggactgcacacgaaaataaacgtattttcataaacgggcctcttaagtggaccgaatgtaaaaatatagttttttttatcccaaccctttcaatctttttcctctcacttaatccctcctctgtatctctatcttttccttctctcatttccctttttattttacttaatccctcctctctctctctctgcctttcctttcctccccttcgagcgcgtggggcacgggaggcggtggcggcgcggccgggagcggacgggaggcggcgcggcggctggtgatgaccggaggtggagcgggcgggaagcggcggcggtgccggctgaaacggcgcggcggctggcgacggcgacgaggaggaggaggcggcccgctgccaggagcggcgccttcctctccacgcgcggcggctgcggatttggtggtgggggatgcgggcggcggcgggctcaggagcggcggtggcggccggtcgcggcggaggcggtatcggaagcggcggcgagcggctcggcggacggcggcgtcgggcgcgacggcggccgcgcgtggaaggcggcgaggggcgacggcgacctgcccccgcccggatccggcggaggcggctgccccctgcccggatctggcggcggcagccgtccctcgccagcatccggcgacggtggcagcgggcggcggcggcgacgtcaccgaccacgaggagggctgcggcggcagcttctagggttttttttaatctgccctctatatttctaaccatccaatcgaaatccaacggctcaggttttcttgcatacgtggcacaatcacagaccgaataaacatcctgcgttcattgatgatgatgatgatgatgattacatccttcacccttgccgtttggaacgtaccagaatatatgagtttaccctgaacagtgaacacttgctgcatagtagtattatccctgcatgagaaatgaccaatcaaagtatttatgtgatttctcttaaaaaaaagtagtattaacgaaagatatcctcacaaagagaaaatagagggggaacaagcaatgttgttgcaatgttgttttttatacacaagagatcattcaacatattttctttttttgtcatgttgcacgttttgcttagcgatgtgtcctttttgtctttaatattcccccttcccgcaatgcaaaagttattttgggtaattggctaaggggagtgtctaggctcacaaaaaaattgattttatttggagctactacgctttgttggtcaatctgacgttgccataatgatagagtttttagccataagaaattgcctaccattatgcgggttatcttcatgggttccaattgctccattcttgatgtatgatgctttcatataaacaacatgatactatgcgtattggtgctacacgcttggaattggtagccagggagcttttattccaatttgtatgacgtagaacctattgaatttcgtgctagaatatatgtaattttgaaaacgttatttcaatcaacccttttattggcggaagttggggctttatcccatcatgtctattttaaattattctgaaacttgttgactgtgtgcttccattttatctgacaaaaatgaaaaatgcagtcagagacgacatgacacgagacttgtacaatgcatataaaacttcggaaaaagtccactttgactcccttaattgtacgccgaatctaattcgtacccctcaaccagaaaaccggataggacgactccccgaactattgaaaccagtgcaatttgactccttctgcggttttgctgatgtgacgctgatattgcggtgttgacccgatcttcgtcccacgtgacgcttatatggcattagaattaaaaaatatcagtgggacccatatgtcattcacagcaaaaaaaaataccgtgggaccgactgacatgtagggtccatatgtcatcctctctccttcccggcggagacggcggcggtgggcaagaggcgggggatccaggcgacattgttgctggaactacgcccatgacggcttcgccgactccgcccccaccctaccccgcgcccgacccctctcttcctctcggacgcaacgccggacgacgatgacgacatggagatagcgaggcggagctggaggggtggcggacgctccagcgcccgcctcccgtacgccgccgatctgactctggtcccgcccgtacgccgtcgtcgccactccggcccccgtctgtcgccgccgccgatccaactcccgctccctgcgtgcgtacggagggggagagaaaagagagagaagggagagagagggaggaggaagaagggaagaaggatgacatgtgggcccctacgcatcagtgggtcccacaatatattttgtgtgtgtgaatgacagatgtgtcttacagacattttttcaattctaatgctacataagtatcacgtgggatgaagatcgggtcaacaccgttgagggagtcaaattgcactggtttcaatagttcggggagtcgtcttatccggttttcttcttgaggggtacgaattagattcggcgtaattaagagagtcatagtggactttttcttaaaacttcctacgcaatttgcttcgctaatttcgcacaggtcataggctagcagcccatataggaaagcccaacgttggcccatttctctcgtgtgtgtacatctatatatattgagaagaaaacctagctaggtcactcaagtcctcccatccagcagctcagccgccacaagccatggccgatgcgagctcggccgccgtcgctgcccccaagccccaactggccgccggcacttgagcaccaagcagggccagctcgacgacgccgtcgccgcccgccaccaagctcgaacagatcagctccagcaatgttcaatccaacgacttttgcattgattgattgattttctctgctcgtgtgattgtgtgattggaatcgactagcttgaaccaattgatagtatccctgtgctgtgcgtgcattgcatgtgtacatattaccaaatctctgttgcatatggatccactcttggatatcggttttcgcttgaatgccgttttcttctgttattttgttgttcctttttttaagctataaaacccaaccttctctttatgatctgtttgttttcaatattgtaattttttttctggaatttgttgttaattataaccttttcattatctcctgagctagcagattgatgatgaaacaatttctccaagcgtttgttacgctgacatccatatatgatggagggctatgttaccatagccttcatagttttcaatctgaaccatctgctgctcaatcattttccccagattttttttacagcgattgtttctccattgctaactgttctgtattgatttgggattcaaattcctttcatggtttttgctcgttttctttacaatctcattcatttgtctgtgcaacatttgggaaaaattgggagaagtgatgatattatatccataccacatttctgcattcactatgatgatcattaacttcatgcactaccatctgatctcccactacacataataaagttatggtacaaggtatataaattgaagttgtgcaatgatggactgattttcatttacacgctgaatttattttgttaattaatgtgcaatctgtgatgcaaataatcccatttgctgaatcactgtgattattgcaatcaaaatcaccatctttcggctgagattgcacattgttattctgcaaaatttatctttgttttaaattaaggtttatgccatttggtatctgacacataatcatttctctgattatgtgtctcgaaacatggcagaaagtgagggggaacggtccttgcgacactggttgctactatatgagcttctagttactatatacccgtttacatttccttgcttttttagtatttctgtttaacttttgtcatgcctatgtgttgtgatgcattagttttgtactgtggagattgtacccctgtcaaaccacttaatgaaattacagataattattagactgaaaatgccgtcttttggctgaatcactctgatcaatcaaaatcaccatatttcagctgagattgcacattgttgttacgcgaaacaattttatctttgttttaaattaaggttcagccatttggtatctgacacataatcatttctctgattacatgtctcgaaacatggcagaaagtaagggggaacggtccttgcgatgctggttgctgctatatgagcttctagttactatatacccgtttacatatcctttgctttcttagtatttctgtttggctttattcattagttatgcctatgtgttgtaatgcattagttttgtactgtggagattgtatgtctatcaaactacttaatgaagttacagataaatattagactgaaagtctaaaatcactgtagcatattgggctaaaaggtatagtttgtttacttggaatctctcgaaagtttgtttgattgctgaatttgtgctccagtttgtttgctgtttcttacatgaagcattacctgtcctgatgttatttatcacttatgagatttgtgtatgcagtttccattttttcagtgcctgttatgcagatgccaagcgtctcattggccggagatttactgatgcttctgtccagagtgatattaagctctggcccttcaaggtcattgctggacctggtgacaagtcaacgattgtggttcagtacaagggtgaagagaagcaggttgcagctgaggtaatattcaaattgtttctgtgatggctacttaggatttatgctatgattttaacttgcattgttgtaatgatgttgttaaagtaaacaagtaacggtagcaagtttgcttatcagcttgttgtttttcagtttttcctgtgagcctatcttttcgttcttttccattataaaaacccatctctctttatggtctgtttgttttctatgttataaatgtttttctgtaatttgttgaccttttcattaaatcttgagctagcagattgatgatgaaacaatttctccaagcgtttgttacgctgatccatatgatggagggctatggtaacatagccttcatagttttcaatctgaaccatctgctggtcaatcattttccccagatttttttacagcgattgtttctccatgcatacagttctgtattgatttgggattgtactaacacttagcataacatacattaatgaattcctttcaaattaagatttctattatagtgctattcaaattccttatatgatttttgctcgttttctttacaaaatctcattcaattttctgtgcaacgtttgggaaaaaagtattatttgggagaagtgatgatattatatccataccacatttctgcatttgctatgatgatcattaaattcatgcactaccatctgatctcccactacacatgataaagttattgttacaaggctatataaattgaagttatgcaatgctggactgattttcatttacaagctgaatttattttgttagtgtgcaatctgtgatgcaaataatcccatttgctgaatcactgtgattattgcaataaaaatcaccatcttttggctgagattgcacattgttctgcaaaacatttttatatttgttttaaattaaggttcatgccatttggtatctgacacataatcatttatctgattatgcgtctcgaaacatggcagaaagcgagggggaacggtccttgcgacactggttgctgctatatgagcttctagttactatatacccgtttacatatcccttgctttcttagtatttctgtttggctttattcattagttatgcctatgtgttgtgatacatagttttgtactgtggagattgtacgtctgtcaaactacttaatgaaattacagattattggaccgaaagtctgaaactactatagtatattagactaaggttatatagtttgtttacttggaattgctccaaagtttgtctgattgctgaatttgtactccgtttgtttgctgtttttcgcatgaaacattaccagtcctgaagatatttatcatacatgaggtttgtgtatgcagtttctgattttttagtgcctcttatgcagatgccaagcgtctcatcggccagagatttactgatgcttctgtccagagtgatattatgctctggcccttcaaggtcatcgctggacctggtgacaagtcaatgattgtggtccagtacaagggtgaagagaagcagtttgcagctgaggagatctcttctatggtcctcatcaagatgcgtgagattgctgaagcttaccttggcaccaccataaaaaaagctgtcgtaacagttcctgcttacttcaactactcacagaggcaggctaccaaggacgctagggtcattgctggcctcaatgtcatgcgtatcatcaatgagcctactgctgctgccattgcctatggtcttgacaagaaggcttccagtgttggtgagaagaacgtcctcatcttcgaccttggtggtggtacctttgatgtctctcttctcaccattgaggagggaggtcaaggccacagctggtgacacgcatcttggtggtgaggactttgacaacagaatggtgaagcactttgttcaggagttcaagaggaagagcaagaaggacatcactggcaacccaaggcctgtcgggaggctgaggacagcttgtgagtgggcgaagaggactctctcccctccacttcccagaccacccaccattgagattgactccctgtacgagggcatcgacttctactcgaacatcacctgcgccaggttcgaggagctgaccatggatctcttcaggaagtgcatgaggggataccaagatggacaaagagcagcgtgcacgatgttcatccttgttggtggctccaccaggattcccagagtgcagcagctcctccaggacttcttcaatggcaaggagctctgcaagaacatcaaccctgatgaggccgtcgcctatggcgccgctgtccaggcccccatcttggtctggagacggccagaggagtgatgacctagaaggagcaggccggtcttctccacctactccgacaaccggcctggtgtgttgatccaggtgtacgagggcgatgggagaggaccatgacaccattgagtaagtgaggagatcgagaagatggtccaggacgcggagaagtacaagtcggaggacgatgagctacatcgaagaacatgcacaaacaccatcaaggtccgagcacccacgcggcggccaagaagatgggaggacgcggtgggagattgagccaagatggacgaggacgtgccgttaaattttggctgatcatggtggttaaattttggctacgttgtaatgaaaaatgcattggttgcttcgttaaagtaatagtactacaattgttctgtttcggttcatccgcatttgccttttgatttttgtttagctgctacttaaatcgcgtttattttgcatacagtatctatctgtcttctccaaagcgttggggtgtgcttttcttccccggtggtattcactattcagagtcttttgtcgtcgtgtctgctctaatatgccatccattgtagggagtggattacgtccccccatcgtgtatctttttctttcaaaatcaatgcaaatagttgttaaaaattctgaaaaatattgacaatgtagagtacaattatatctaatagaaatcgatgcaaatagttgttaaaaattctgaaaaatattgataatgtagagtacaattatatctaatagtccacaaaaaataaagtttaaattcgacctatacatcgagaaccaaaaaagacaaattcagatattaacaatgtgctactatttatacgttgaatttgtctttttcatatctcgatgtgtgagttgaatttggacttaagataatttgtctttttcatatctcgatgtgtgagttgaatttggacttaagattttgtgaagttgtatagatatgttgtataagtgttgtcaaatttttccagaatttttcataacagtttagatgatttttaaacaaacgaggggacatcacctcgagggatcaaacgagaggacatcccctcgagggatccaaatagtttcccatccattgtactaacctccgtcccaagagataaaaaaggtttttttttctatttgtactgctaaaattgttcatattttaagattttttttatatattttgagttggagggacataaaaatacatagtataaactataaagtggtttgaccgggtgttttgaatggtcattgctggattgtgcttccttggtgtggaagcatatgagcaaacgacgagcagatctgatgtcgtcttccattgcatatctcgtctgaacatgaatcgtcattcagacttgagaggtagagcatagtgagagagagagagagagagagagagagagagagagagagagagagagagagaggcgtgaggcatgcaaagcaaagcttttccgtggatccgtccgggcagaggcggtcgcccgctttacccacc

SEQ ID NO: 341 - DNA, 5238 bp, Oryza sativa; identical to SEQ ID NO: 252

SEQ ID NO: 342 - DNA, 5026 bp, Oryza sativa; identical to SEQ ID NO: 251

SEQ ID NO: 343 - DNA, 4052 bp, Oryza sativa
tcctctctcgcgccgtaggggtcttctgtggcgacggtggacgcacctggcccatcgaggcgagcgagggagaggcagcgccaggagtcgagctcgtaggcgcccacggcagcgtacacgaaccacggcgccaggtaggtgtacaacacgagtaggcgccacctcgctgcatccagggcgagccgtgtcaccgtcctcccagctgtgggtagatagagaaggaagaggatgaggacgagcatctcgccgctgcctccttggccctcaccccgccgagcaaagaggagagggaagaagacaggagaaagaaggaagaaaacagaaaaaaagaaaaaggatatggatggaaaacttaacggcagtggcacgatcctagttttgtaaaatttcaatggcacagctacgaatagatgaattgtaatatcatttatttgaataggcaaatttgcaatagcatcgatccaattaacccctaaaataaaatgggagaggattctaatacctcaaggagatgtcccctcgtatatttttttaaaaaaatcaatgtaaatgattgcacaaaattctaaaagaaaataggtaatgtacagtataataacgcctacaacttcgctaaagatcatatttaaattcgatctacacattaagaaatgaaaaacataagatttgaatgggtgttggatttgtcttttttatttcttaatatgtagcttatgttttgtgggtagtataggtatattgtaggaatgttatcaaatttttttgcgaatttttaacaactatttatatggtgtttgaataaatcagggacgtcctctcgagagtttaagactgcgttcgagagtgaagattcgaaaccatctctatcgacctggagtgagggagtacttgaaaacaatctgatcactacactcgatctcgccccgtgccattcaccaccgtaggattatctcgaatgggtaacgaaagcaacatgtctctcattagttgcagctctcgagctccacacaaactagtggcctttggccactgctttgctcttttgacacaacatactcactattttcagaaactgtggctccaggttggcttttcttgcctgctgaaatttgcaaagtgcaggcatttctgtcttcatgccgatttcagagagggcaacaacaacgccatcatcgtcatattactcgttggagttggatccactgttgagtgatctcgcagagaagaagcttagcctgaggagaagcttggcttggctggatgcagagctcaaggatgccaagatcaagcttgcttccaaggaacagttgcttgctcaggaatcagaaaacaggaaggtatgttccactctcctaatcatgacttctcgatgttctgtgaaaaaacaattgcactgaattgatgaaatattagaagtttgctgagtcgagggcgagaagcatggaggaggaggtgaagaagctgcataaatgtttacaggacaaggatgagcagctgcgaacatcaatatgtagcactgaacaggtgatcatcacccccttatactacacttactgtcaatcttccagtgtgatgtgttcaggtaactgttatgttttggtgtaatatttttttttgacctagtagtttcatcaactgcaaatcaaatgggaaattttcatgtcagcagtatttgtcttcctacaaattggatattcttagatcacagatttcagtggcacaagccactgcagaagccagtgcagaatcagccatgttggcacggttgcagtgcttgtccctgtcaggagggcatgagaagatcaattctttgggtgaatgcgagcttcgagtgaagaaggtagaggagcagctagatcttgttcagaagttccttgaagcgaaagagctctcgcaggtcgttatacgcttacaagttacaaattaattacttccttgatccacaaaatacattcatttagtatgtttttatattgaaattttaaattatgcttttattcaatttaaatttgttggtaatatatagttggagaagaatcaaatgacaacggttcatgagctgaagaagaaggtactgaaacttgaatgcaccctcaaagtatcaagagctcagctgcgaaaactacataaggtactatgcttaccacttgcaatattcagggaatgattttcaccttcagaggattactgatcaacatgagtgcaatcacattttttttcatttcctgaaaattaaccatctatcttctctctgctaatctaatcatatatgtagttggaatatcttgcaatcatacatgtttaatcttccttatgtagatggtagagcgaagagataaacctctcaaaaaactacaaagccgattgccgctgaagcagcagaccgcctgcgacaagcagaagttgtgggagagctcaggcttcaggatcatagcctccatgtcaatattggccctggctatgctgtcgaagcgatgaactgaacaagtgatgattgacgtcgtcgtgtatcagttgtctatggcagacgcaaatgttcctgtattggtgtcagggttatgagatagttgatggtatgaatgataaatctgtgtagcatcattaccagttctccgtaccaaatttgacgaaattcagtgtactgtcgtagacttcagcgtggtggaaacttaaaccaatgcactaaatgaacttggggaagaagatcgtggccagcggcggctaaggtgcgccattttcatttctgaatcggccatttattgtgctgatgctgatgatgagattgggtttgaatttgatggacagagagcctccaggtttggctgataaagatgtagaaaaataaacatggtaaaaaattaaattttagaattggacttgtctatttctatttttagcagtttaaaaattaaggctactattttttttaaaaaaaaagagactagaaaattttgaaactaagttaaaaattcatttgtttttctatggctaaacaaacagcgagggtacaaatcttggaataaccgcatggccgattggttgtgcctttgaaatttatatctccttttgagctgtaaaaaccgaatgaaaaaaaatacggcaagaattctatagaaatggtaactgtttatccatttcgtttgtgaaaatggagtgaagaaaacgcctattattgtcgtacgatactctgctccttctccctctcttctttcgctcgacctactagaaatggcaatgggacccgatcactgattccccgcggtaaattcacatattagggatgaggatggttgaaatctatcttttttttttctcgaacgcgcaaaaggattgcacgtcaatatattagaagaatataatgtttgttacatgacgcaatcaatcagaccgacttatgccaagaaaggggagaaaaaagactaaaataaataagagacgaaagggttgaaatctatcctccatggggaatcaaatgtttccaaactaatcaccatcagggatgacgggggcggggatggtgctctatcccccgtccccgccccccgtggtgacccgtattaactgtatgtaggatcaattctagattttcctagacattttggcccataatattaaagcccacttagcaggtatatataacacctaaaccctagtcaactagtcaatctccccaatccctagttccatatcgcaccagcgccaccaggcacgtgcgccgccgcctcctctcacgcgggcgctatcccgtcccaaccgtacgacgcgggcgcgatgtctgccgctgtcgttgcgccgcccggagcctgcagccgtcatcgcgagcgtcgtccgccgccagcgcccttcgtcgcaagtgccctccgccgctagcacgccctccaccgccagcgccgtccaccgccagcatgccgtccgccgccaccgattctccatgccgattgcccattcccctacagatgaatatgttgtttgacggggacgggataaccgcggggataaattcaccacgtagggatcagggccggagaaaatatagccccgtcgtggttgac

SEQ ID NO: 344 - DNA, 5134 bp, Oryza sativa
gagcagtccattaacgcgtaattaatataagtattagctttttttaaaaaaaaatggatcaatatgattttctttaagcaactttcatatagaaattttttttcaaaaaaaacgcatcatttagcagtttgaaaagcatgcgtgcggaaaatgagggagatgggttgggaacactgataaacgaactcagcataaattgaccactcttattctcgacattgtcatcatcaccagctctatcaccgatatttcgaatgtaaaagaatttatgtttttaactcgagacaccacatagttcacatcaatcatgggcgtataacttgtttttatcatgcgactgctattttctattatttaatgaaaatccagaaaggaatagaggccattatatccttcatcgtctgttgccactgcctgcagtagagctttcttaattgcgactctttcaaccttggcttcatgccctatatgggcaagcaatgagactacgctaaaccgacgatgcagcaagaatggattagtgcacacatcaatacaatcaaggaacttctaagttatcggtgtaggcacggaatagagactcattgaaaaaggtgtgggccaccattggttggcatatgctgttgcatatcagcacaaccaggctgatgcttatcagcataagcttttctatcatctcatgctacagtccaaggagccaaccgatgaggtcagtcgtgacaatgggaaggtggcgagagagagaggaagcggggaacaatatttataattttgatgaaattcggtctggattacactggattgaaaacataaaccgtttggtttataaaccgtttggtttatcggtcaaataaaaaaatcaaactaaaattttagataagattttgttcaaattttatcggtttttgttggaactatgatgagggcataatcgtctattcctttccagattttgattccaagagaactgaaaaataggctggaaagagctttctcttccagaaataccccaagctcaattttcttctctacacaaccgaaaggtggagcgttggcgaaggaccaaccaatttcctctctctaatcgccgcggcgggggatagattgggagtgagcgcgtatggcggaggagcagttcctcgccgtcgcggtggacgccgccaagaacgccggcgaggtatgccctctcctgaaccactcgattcctcccttgccccctcctccctgtgcacgattcctcgtgtttttctttttccttgtccgttcttgatttcctggtgcttctccgcagatcatccgcaagggcttctaccagaccaagaacgtggagcacaagggccaggtctctcttccttcttccacggttccaccgatctcatcgcattccttttccccatagctgatggagtttggtttgccctggattggaatttggggtttcttggtgaccgtggctgcattgcaactgcaggtggatttggtgacggagacggacaaggcctgcgaggacctcatcttcaaccacctccggaagcactacccggaccacaagttcatcggcgaggagacgtccgcggcgctcggcgccaccgcggacctcaccgacgacccgacctggatcgtcgaccccctcgatggcaccaccaatttcgtccatgggtaattattagcttctgtttctatccccattataccaccttctttcttttttttaatgaacattgggtatgtcaatcacattgcagcttcccttttgtttgcgtctcgatcggtctcaccgtcgggaaaattcctactgttggagttgtgtacaaccccatcatgaatgaggtaaaagtgacatgtgaagcatttacatcgcaattggattgaaggacataggctatttccttctatgtaccaatatgtaaaaatcacagcttatttgtctctataggatttatattcttattgttcatatgccgacttagttttgtagtctaatttcatgttaccttttcatttagcttttcacagctgttcgtggaaaaggtgccttcctcaatggttctccaatcaaaagtaagtgctatattttggttaattgggtcctgatgtgttgacattcaatagaagcaacatattgaacttagacagtttccttctctgctgagcagcttcatctcaaaacgagctggtgaaggctcttctggtaacagaggtaagtgataccatcaagagtcaattttattacatgtaaagaaatttaatttgtattgatgatgcatatgcgtagaaaaatcaataggatttcatctcaaccatgttgttctaaattattttgttgcttcatttcactaatcagtataagccgtcttctgaatagcttaagatttggccgctactgtctttcctagaaaacatcatcgaacaatgtttgatcgtgttaacgtgcactttgcttgttgaatggtgatatttcacaactacttttctagcagatgtatagcttatgctttactgatgcaaatactgacagcatgtacatgaccatgcatacactcttttgaactagcatggagatttcatctagatatttggaacccccacacctgcatacagacccgaaagaaattcttgaaaatattattattttctgaactttaaagagtttggacacaatctaaccaaaagttaactccatgtgactcaatgtttttgggatttgtgatccattccaacttgatttaattcaatattccacactcaagtaattatgttggttgagatgaccataaccttatcgattaaatactaatctaatcatgtcaactggattttgtggaataccacattatctcttaaaacaatagttgaaatatttatggtaacatattaattgattcttaaacattggctaagttgcccatttcgggcttcctgttggagtgtgatattcttttttttcctggggctgtccaattcatattgatatatcaatatgaatgtataacacatgctacactggatgcaattagtttcttgtgagcctctttcgtacttgatcaatcatcagtgacaaacttcattgattctgaaacttgatttacttacaatggaaatgagagttctagtttctatttcttgaatcattttcatataaaagttttacatcataatattagtgaaaatatttgatcaataaccttgtgccaattgagcaggttggaaccaaaagagataaggccactctggatgatacaacaaacagaatcaacaagttactattcaaggtaagccttataagttatacaccaatattttcatgacatacaattatagttcaacagatcggtgcactaaaatggtatatttcattatttcagattagatctatacggatgtgtggctcgttggccttgaacatgtgtggagttgcctgtggtaggcttgatttgtgttatgagattggatttggtggcccctggtatgattaatttaattactacaaatgcagtgtcttatgaaaaatataaactatctaaacatattttattgtcaattcttcactctagggatgtggccgctggagctctgattcttcgggaagctggtggttttgtttttgatccgtaagttacactgtttagtcaatgtcatagtagaatcaggcagcgtgagtatctattattaattgtttgttccattctggcttgtaggagtggtggggagtttgatctgatggcacgaagaatggcaggatcaaacagctatctgaaggatcaattcatcaaagaattgggagatacaagttgaacaacatattcctcaacatgaagtagaataagaatataagatcgccctgccaattttattggggcaaattttctttctagtggttctgcataaacagcatgcctgttgcggaaaagttttggacgcagtatggcattgtattgtttgaaacttttttttttttggcactactatccggtgttacttcggaaactagtgcatcgaagattcgaagtagcttaatcagaattttgaaccgaatgttcagatggattgtgcaatgtgcatttcccccatgatttcgtctcctatgcacattatgtggaagatgttccaaaataatattatcagttataaccaggggcatgtgtataaacaaatgtgtttcaaaaaaatcctggctataacaaggtagcatgtccaaattcgtagtattaaattcgtagtattaggaaatgttttattttgttcagttttttatattttgggatgtaggaagtagcacagtagtatgatcctaccgatcctagtcttgatgggaattgggaaataatggaatttggttgcaacttgtaagaacgaaggatgctaactaagtactcttgatgggaaatattggaattcggttgcaactaggaagaatgaaggatcgtatacctctgtggcagtggatccagttgacggttgcaagaggaagatgcttagctgtgtggcaaactggcaatggatgctagtagctctgtagcattggttacaattgctcacttttcactagatgttggcagtaccaacagccaagcaaagggaggcaaagttgccagcgttggggatcaggcgtacggtttcttcaaggggccatggcggctgcggcgccgagttcggtggtagccggactcgtgtccgggctagggctggcgcgctcctcgttaacgcccagcgacggccgctctccttccctctcgcccctgcatccgccatggcccgcggccccgcggctcgtctgtaggagcagcggagcccggccccccagggagagagccgtggccgccgccgccgccgccgcaaattctccgcggcagcagcagcagctaggagagcatgagcatgaggaggctgtggcagcggcggccatggagccggagaggagcagtccccatgaggtcaccgtcctttctttctccttggtttggcgattgattgattggttggtcccgtgcaggtgagggaggagatagcgaggtgcttcgatctcgtgcgccgcctcggccgtggcgccgtctacctcggctcctccagggtgccgcccacccatccccattacctccatgccgccgagctctcaagggaggcaagcactttg

SEQ ID NO: 345 - DNA, 3005 bp, Oryza sativa
gacagctcagcgggcggaaagcgacgcgaggagagctccacggcagcaacagcagaaaggggggatcttttccttaatttttctcatcgcggcgtcaggcagatcggcagaacgagaacgtgcggtgaacgggggcacgccgcgccacgccacgcgacgggtcgagaggccgaggacgacgacgggttccaacttccaattcccagctagaacgagagcttgcttagccgacccgagacggcgatgcggcttgccgatggtttggtttaccgctttgccccggttcttcgctttcccgttttccaccccctcccctcctctttcggtcgagcatatctcctccccgcggggtgggctacttggctacttgcccgggtcccgtgtcctaaaaacacaacatatcttacggggaaaaagaccgttccacccacacgtctccacacgcttagggcctcaccttttcgtttatacttatacttaaaatttaaatttttaatattaaatttaaaactgattttaagtctttttattaaaatttatctttcatcttttatttttagatcgttaagaatacatatataaaaattttatttataaattatttttcgtttgtaaatatgtcatttcgtttattcatgaaataagcggaacgatagctccactgtactactcatccagtacacggtcacaggagccagtgagccacggctacccatctggatccagctcctccactcccagcgccgaactgtggccggcagcgagccatgagtggcggcatgtcacgttccgccgtgacgattctaccgtagtactacgcccgtgggagaggcgaggcgaccgacccaacggccgtgcacgccgtttaccgcttttttggctgcggaatccacccgtgaaaccgagggccgcgttgccgccgcgccaacccccccccccccccccctttcccgcgcgacgccaacgaggccaataccggaaataacacgcgcccgcgcggcaggcggggcaggtcgctgcccccacccccacacacgctgcgcctccgcgtccataaaaagcccccccgcctcgccgccattcccgatcaaatcctctcctcgatctctcctgcaatcctcatcacacagcaaacccaaaccgcgagcggaatcctcagcctgctgagagagcctgagaccaagagggggattcttttttggttattgacgatggcgcagcgcgacaagaaggatcaggagccgacggagctcagggcgccggagatcacgctgtgcgccaacagctgcggattcccgggcaacccggccacgcagaacctctgccagaactgcttcttggcggccacggcgtccacctcgtcgccgtcttctttgtcgtcaccggtgctcgacaagcagccgccgaggccggcggcgccgctggttgagcctcaggctcctctcccaccgcctgtggaggagatggcctccgcgctcgcgacggcgccggcgccggtcgccaagacgtcggcggtgaaccggtgctccaggtgccggaagcgtgtcggcctcaccgggttccggtgccggtgcggccacctgttctgcggcgagcaccggtactccgaccgccacggctgcagctacgactacaagtcggcggcgagggacgccatcgccagggacaacccggtggtgcgcgcggccaagatcgttaggttctgagaggcaaacaaaattaaaaaaaaaatctactgttttagcaagaaatggagaaaaaaattgggaattgaaggtgtggatgttattattatgctgttctcttctcgcaattgtttttccctttttattctttttaattgcaaacgggaggataagtggtggaaaaggaatagtgtaacaataatggtgatgtgaggtggttgagggaaaaagaatcgaagaacaaatggattgggtgtgtatttgtctcgcactttctgctccatttttacaaaattattcggcatatggttattgctcaatcattgaaatgaaaggaatggaattgagtagcttgattagcaatcacttggtagctggttgctgccctataaacaatccatccaattccagttccgacacattccgtgttcatctcaaactggaacctttctccacactttgtaaactgcaaattattcatccaaccaagcaactaatcatcaattcgtgcgcgtctctcatgaaccgctaaaaagggagaaaaaaaaagatcagccaacatagtactactacccaagtagaataaacttttcatttttctcaacaaaaagataagtcattttgtgcggagaaattatgtgcgagtagtaaaagatacggcgcgatttgtgcatgaacacgggttatactgtcgtggaggccacacggcctgactcttcacatggccacgtccacatcctctgctcgtgatggccagtcgtcttctttctcgcaagtgttgtggtctcactctgacctgttcttcactcgtctttgattacttctgattatatttttttatttggtctaacacgaactgttagcaatagagtatacgtgatggtaggcgaattgtgttcttgtagatgatgatgattaggattccttaggctgctcgatgtgatgcgcaatcaatagtcaagagttctcgtgatatagttctctcttctcgttaatttggctttgccagttgggcttttctattgtttgtgccgaaactgatcccttgaggtttacattacttaattcttttttgttgttgaaatggagtttagcgtgcttcatgtggcagtacggagaacgggcaaaatggatgagcacatggtattctcatcgaggtctttggtgaggaaagttcaatgttatcttttcttactccctcccaatcaggcaatcatgttcattgttccttgcaaaaaaaaatgttaattgttccaccgttagatcagtatttccttgagattatccacatagttcaaaatgaacattttaattttaaat

SEQ ID NO: 346 - DNA, 3050 bp, Oryza sativa
aaacgtcattagattaagcgagggacgtcgtatcgtaggcatcgagtggttgggtttctaccgcttttgccgcgtgaacgacccatccgttctcgtacgtacgtaacagagaatttagccggttaggccctcacgacccggcgttgcgtgtcgccatcgcgcagctgtgttctgctttgccgggtaggcgttttttccccaactcgtccgtccattcatcctccccggccgatcgacagaacgaacggcaaggcgcggcgtacgaaccaaacgggaacaacgtgcattgctgcttccggcaaagttttttttttcttttataggctcggatgaatggacgggccgcgagcggcaggtaacgtagctactagtagctagtagtagcctcatctagttaggccgtgtgctgggttgtgcaggttaggccgtgttcggcttggttttaggcctcctgggttcctcgaatagaatggcaccgtgcgagttgcgcaaaaattcttttgcgcatgtggagtatatagaagtggctcatttcgattttcaacagattattaattaattgattgattgattgattaatccgttgtgaatctaaaaagaaatattcgttgtcatctgaatcatgcagatcgatcgagttaacagatatggtccgaacctgtcgggcgagttgacagatatctaacggtgggctggccgtcgatcttatcgatcgatgtaacaaccaaaagcaagagagtgtacgtacgtagtacgtgtttctccccggaacgaggaggcggttacccgtacgtcgacgcgaaacggaggaaagaccatttcaaaccgaatcaggagggggttgggtttgcatggcggttggcctcgcgcgcgcgtcttcgtcgcgtcatgcgcgcccggccacgttttcctcacgctcgcgcgcgcgcgcaacctccactaatcaatcgaccacacgtttcgccccgcatgccctctatatagagcggttgagccaacctcgcaaccaaccatatgtgatcagcgacgtacagtacagatcgttcgcaataaagttagacttctcgtctctctttgtgcttgtgcttagttgtccgtgctagaagacggcaatggcgtcgacggatcccatgacccgccgcttcgccgtcgcgtgcggcgtgctcagccagtacgtcaaggccaactcctcgcagccgtcgacggcggcgccggtggctcaaggtgtgagtggcctcatggccgccgccgccgccgccgccgcggcgcctgtggtccaggaacccggatgcgaggtggacggcggggggcagcagttcacgatcttctacgccgggaaggtggtggtgatcgaccgctgcacgccggccatggcggccgagctgatgcggttcgcgtcggcggcgcagggcggcggcggcgcgccagaggcgccgcccgcgctggtggacatgccgatcgcgaggaaggcgtcgctgaagcggttcctggcgaagcgcaaggccacccccgcctccgcgcggtcgtcgtacgtcgtccgtgctgcggcggcggaggaggagcagccgccggcgaagaaagcgaaggcggccgtggagaggcgcgaggattggctcgcgctgggaagccttggacacatgcactcgcgctgatgatcatcgccacgacgtcacgtctgcgatttgagaattgagagctcgatcgattgatcgccatgtggtcacccggtagccgatgctgcaaggccggtcgagttggaagatggttctcgtcgcattaacggccttgagttgatttcgccgagcctgaccttgagttgattaccatggaagtatgaagatttcgtgattagcagttaccctagttatcgcggcgtataattaagcacggtcactgaagcgcaatggccttgagtcggtagatcaggactagagaggggtgtatggatctgacaagtactgtagtatattgtatcccgtttgaattttttttcgattcctatggggactgaattgattaatgatataaaattccttcgactgttctgaaattcttgcatttacacatggtgattttgttctgtgattttagccgtgtttagttcacctccaactatcccaaacttccaactttccatcgcatcacatcacatccaaaactttcctacacacataatcttctaactttttttttcaaacttccaactttccccaaactttcaacttttttcaggaactaaacacaacctttacatagcactcctgagaaattctgctttacacatggtaatttgatccacgatttatagagcactcgtgtgaaatagatctgcgttacgcttggtgatttgttctatgatttatagagcactataattcttctgctgctaggtatgaatgtatgatcggtttctcatatagtcatatgaatgccccgcaaagaaaatacgaatgagctttgtggattttcctttaaaacaacatagtagtaataagtaaataaacatagtttaaaggttagagatactatatgtttctgaaaaaggtgagtttaaactaacttttttcttttagtgtacgcgaaaagaaaaaggtgaatttaccgttcttgatagataccgacttttatagtatagtataaattttgcttgaaggaccgtaaagcgcacaaacgcacatctcaagagattgagccagcactagagacctccaagacattgataggtaaaacgtacagtacttgatagctactgaattttatagcaaatattaaatgtgagcctcattccaaatctataacttaagcccaattgaatggggaatggattctaataactcgagtggatgttctgttgcataaattttgctttcaaattcaatataaatagttgtattttttttttgaaaaaataatgataatatagagcatagtgatatttaccgctccactaaaaatcaagttaaaattcgacctacacattgaggcaaaaaagacaaattcggacgtgaatattattcgtgcgctgaatttgtccttattatatattgatg

SEQ ID NO: 347 - DNA, 4474 bp, Oryza sativa
ttgatatcaatttcaaaatcttcctggcggcccttctttccttatttattttttttagaaaaaaagaaaacaagcttcctggccgccgaacgcatgcagacgtgccctttgaggctggcgtgttcggaaccccttctcccaaccctctcgctagttctctgcgcttatgtttttcaaactgctaaacggtatgtttttttgcaaaaagtttatatgaaaattgtttaaaaaaattaaattaatctattttttttaaaaaaatagctaatacttaattaatcacgcgctaatagactgctccgttttttgtgcggagagaacgagttcccatcctggagatgcaaacacaacctgagacttaatcgagtgcgtgcttatttacttcgctaggctacgacgaaatcacgaaaacccacctactcaatgtatgataatcgaattaacaatcttcatggccaccgaacacatgcaaacgtgcccaatgagacttttgatcaagtgcttacgtgccccaccagggtacaacgaaatacggatgtgtgtctgctcaaggtcaatttccgcgttgattagtcagttcgttaacaacatcgactactctataattaagttaatgattgggtaaagacgcaggaaacggatgcgcatgtctgggaaggactagttcaagatgtcgtcgtcagtcagtcaatttcaaaatcttcctggctatacatttttttagtggctggtccaaaggctggacaacgtcgccacagcagcatgcatacatacatacaactacagcacaaacaaaacacgcagcgagaggcccgacaatcaactcacgccatttttaacatttttcacgccgcggctgctggagaacgattcgctagttccgtgggacaataggtgggctgcagggcggtatatagaatagtcatcagtcgtcagattcatgcatgggtgcgttgcgtttcctataaatacatttggccagatggccatctgcaaatcagcagcttacggcactagttagctactgtgcaagaaccaaacagttaatcgcatacagaatctcaattagctctgtgtttcttacccttggattggcgattgaattgtgtgcgttcggcgatgggaacagccaagttacctgcattgctttggttactagcaggcgtggtgttagcacttgcagttaaccccgctcatggcgccaagactcgccactacgatttcttcgtaagtgatctacttgaattctagcgtgttcactgatggatgccgatgtacaggcatgaatgcacgaaatgagttttgagttttaaccatgcgtgatgccccccctgcagattacggagaccaactacacgaggctctgccacgagaagagcatcctcaccgtgaacgggcagttccccggcccgaccatctacgcgcgcaagggcgacctcgtcatcgtcaacgtccacaacaacgggaacaaaaacatcaccatccactggtaaaccacatccgttttgccacctgctgcagagaagaagagcattatccttggctcgaaacttacggtgttctcgatgattttactgtggcgcaggcacggcgtggaccagccacggaacccgtggtcggacgggccggagttcatcacgcagtgcccgatccggccgggcggcaacttcacctaccaggtgatcctgtccgaggaggagggcacactgtggtggcacgcgcacagtgacttcgaccgcgccaccgtccacggcgccatcgtcatccaccccaagcgcggcaccaccttccccttcaagaagccagacaaggagatacccgtcatccttggtatacacaagccacaacaaactaatcttgttaatttgataatgttccattgcgcaatgcaatgcttcgtacgtgttttgatcttaaccatctctatgatgttctgcaggtgagtggtggaatgacgacatagagcacgtgctcgacaaggcgcagctcctcggcggagacgtggatccgtccaacgccaacaccatcaacgcccagcctggggacatgttcccctgctccagggacgacacgttcaaagtggccgtgcagcagggcaacacgtacctgcttaggatcatcaacgctggactcaccaacgacatgttcttcgccatcgcggggcaccgcctcaccgtggtcgggatcgacgcccgctacaccaagccgctcacagtcgactacatcatgatcgcgcctggccagaccatggacgtgctcctcgaggccaaacgcaccttgggatccaacagccggtattacatggccgcgagaacgtttatcacgttaccgctcgacactatccctttcaacaatagcactgccacggctatcgtggagtacacggacagcgtcaccgcgaggccggtcgggccaccggaattccccgtccagctgccggccatcaaggatgagaacgcggcgatggcgttcgtcacgcagctcagatcattaggcaaccaggaacacccggtgcacgtaccgacacatgtcgatgagcacatgctcatcgacattgacatcaacgttcttccctgcgaccccaccaacatggcagagaagtgcaaagaaggaccccaaggcaaccggttcgcggcgagcctcaacaatgttagcttccagagcccggctatcgacgtcctcgacgcctactactatagctctggccacggcgtgtacgaggaggacttccccaacaagccgacagccttcgtcgacccgcccgtcaacaacggcagtgggcccttgatgacgaagcgtggcaccaaggtgaaggtgctggagtacggcactgtggtagaggtggtgtttcatgacttgtccagcgagaaccaccctatgcatctgcatggcttcgccttctacgtcgtgggacgagggaacggcaccttcgacgagagcagggacccggcgacctacaacctcgttgacccgccgttccagaacacggtctctgtgcccaggtccggctgggccgcaatccgcttccgagcagacaatccaggtgagagttattcagatttcggattatggtctttgatattggtctttatgtacagtttttaatatttttttcgtgtttattttgattgttcaggtgtgtggttcatgcattgccattttgatcgccacgtggtgtgggggatggacactgtgttcatcgtgaaggacggcaagacaccgcaggctcagatgctgcctcgtcctccaaacatgcctcagtgctaatgaccgtggttcaaggaaaataacaagagcatgcatcacaagcaagcggaaatttgtttattttgttgattgatttagtggtttatattttttccttgtttcgatgaaaaggaagaacgcattctgtcttgacttgtaattgttagtcatttcgttctgtcatgtaagtttgggattttatgaatataactaaataatgtttatgtagtggatcgttattatgacgtctttctttataaacacacacatccttgctatcttatctatgacattgtgttacagtactgttttagtttttcgcaaggtggtgtccttcccttcgcttagggtaggatgaaaagctcgtagctcattagctcgctcggctcggatcgttgtatttttgtaatgagtcgagccaacgttttagctcgttagttataagaaaaaaggacaagaaaaaggcccatcttctgtaccctttttttagaactttttctatcgtagttggagttgtctccagtacgttccccaatcccctcgatctattgctgctctctctcctctagttgtctctagccggtcacacactccacccgttgctccaccatgcctgtgcctcaccttcaccggtggccatcgtcttcataggccagctggccgcccgtagaagcaggagctcgtcgagcactcaacactatccacagcacacacctaaccacatttctcctgctccaactttgttgtgatttgtgaccttgccggtgtgccatatgccgccaccttggcaaggcaaatagataactccccatctcctttcgttgcattgccggcatcacctcccatccgcgtgtgttcattcgtcgcccgaggagtacgtcgctccgacgaggtccagccagcaccgccgcgccatagccatgtggccctcctcctgctcgatttgttggtcgtcgtggagtccactgctccgacgaggtctggccggcgctgctatgtggtgctccttcttgactcgtcggccatggagtccgtcgttcgctcgcccttccagatccagctcagctctgggcatgcgtcgtccaaatctagctcgcgagctaaacgagctggctcaagcttacaattgacccgagccgagacagacttttagctcgttaggatagcgagccgagccgagccagctcgttatcttaacgagctagagcgagccgagccgagccagctc

SEQ ID NO: 348 - DNA, 3294 bp, Oryza sativa
atgcttgtgtgcgatcaataatggccgctcaatgtgtcatcgtacggtgacacaccactcatcctttgttgatctgtggtgatcgacttgagttaatcggcaaggcccagcccatggtttgaggtcagggccaggctgaatttggcccagtaattttggtttgagaagcccacttcgtcacagcgtcaggccgaattactggcccatggtgagcccatggcatccattccccatgattgaccttgtctttctctttttctctcgatctcgaaaagatgagcagatactcgtaattaaaccgcaaacatctgccacccatgtaatgataacaatcgttaacaatgccatgcatctcccgaagcttctgtgcctactcatttgagtgcgagaccttcctaacatgtgtccccttaacattgtttactccctttgccgccaaagtggttactacacactccaaacttttgtggcagaagtacactcaaaagcgaaaggtagcagaacacatcaggcatccaaattaacaacaacaccatttacaatcagacctgaacacgttgatcggcgacatcaggcgccgcacatggcaacgacacccgatcgatcaccaagtgtaaaaactaaagccgcatccaacttgtactcgccaaacagccaccgatcgatcgacgtttcgatcgcctgtatcgacacactgatcgatctgatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggtcagcgtcagccaccaccggccggccatcttctccagctccggcgagcttccagttaatttgttgatcacttgattgttcttggtgtgcaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggtacacacaggattaaaagcaattctacctcctttttttttttttttgcggggagcagaggtaccgtgagataaaaaaatacggtaccagttattaaatttacaatagaaaaagtagtaccttcttaagcactgtaaaattgctctttgattagtttctcctcgtcgaacaccattgttgtggatcttgaggagaattgtttgtgtttcaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggtttatcatttcgatgtgtttacattcaccgtatcatcttcccttgtactcgtgatcacagaatttttttaaaaaatactttggatcattcatatttttatacactcgaccataagaggctctcatcggatgccctagatgccctatttattaagccaacgaaaaagctaaaatttaaaatttaaattttaagagaaagctaaaatttaaaatttcaaacttaattttgacattgtaacattgattttgagatatttttaatgtatttttttcagcattggtatttaagtcaacgagaacatatataaaagtttaaccaacaaatttatttttattctctaataaaccgttttggcttattaaaaaaaaaagccaaacgatgaggccctcctaaggggatcaggtgattcccctagtcagccgttggatcgaccatggacggccgagagcaagccagcacttcaccacgcttggcactgccacgaccacaacggtgcatcggttaattgggccgtaacacacttgcagctcttctcagtcgggcctggaacggggattccggtccatatatattgggctgtaacgggattgcggctcatgtgaggcccatatgtactaggccgtaacgggatcgctgctgacgtgtggcccatgtagtttgggcctgaacttccgttgtttgtgcatagggaaaggtcgggaacttctccaaacgaacttagcgcctgcagcttctcctaaaatttttaggtgctaacagctctctcaaacagtccagttttttacctaaattctcaaggttcccaaattttgagaatttgtagttataaaatctgaaaaatgaactagaagcgagaaaaaaaagcgagaaactaggttttctagcttcttcagattcccacaagttagtttttcaacaatagtttctcaaaatcttaaactcccctaaagacctaaacaggcaggctcacagtggggaactggtcgtggattagccttctccaacat

SEQ ID NO: 349 - DNA, 3407 bp, Oryza sativa
attctgtggaggaaatgtcggccgctccagttccctggccgcatcacctatggctcttatggcaaccagctgcaaggcttgccggccacctctccccctctccgcttgcccgcccgctcgaccgggctcgtcgcttgcctcttccccatctgttgccggtagctctgttccctccttttgtcacgaggcgctcagggtggcggcgacggagcctctcaaaacggcgaaggtcttgcgtgctcaccggccgcctctccctcatcgccgacgccctcccaaggagggtagagtagagtagagtagagaagagaaaagaaaagaaaagaatagaagaaagaaaagaaaagagaaaatataagatagaagagatttgggttccacatttttttctttacatgtgggtttcataatttttcatatcatttttctgttgactaggagccacgctagcgaaaccagagatctatactgtctcaggatcttttgtgcacggttttgtagtttaggggtggagatttctgatattgtggactagggacctcagacagacttgacataaagtcgagggatgttaggtgaagttattccttatggagttgggcttcggccgtcccgacatctgaattcgtacaaggatcctagcagcaggagaaatctacaccaaacattgttctggcttcaacggacaagatgcatgatcctatccgtagttcctgaccataatagagcacacgtccttggaattccaatttcgagatccgagtctccgagacaagaacattgcagcagcagaacacgcgagaaaattaagcaaagcgtcgctagtggcacgtgtccgcttaccacgcattcgcacgctcccgggcgacgtacgtgtcactagccccagcctactcacccgaggcacacgtgtccacctcaccggggcacgtgtcgcgccgtcccctctcgctccgccttatatagccgcttctgccatcgccggtgccgagctcactcgtgcactgcgaagctacacttaccactgcaaccactgatcacagagctagaggttcacttaggcgaagcttaattacacagagcgcccatggcgtcgaggcaggacaggagggaggcgcgggccgaggccgacgcgcggcgcgcggcggaggagatcgcgcgggcgcgggacgagcgcgtcatgcaggcggaggtggacgcccggtcggccgcggacgagatcgcccgcgcccgcgccgaccgcggcgccgccacgatgggcgccgacaccgcccaccacgccgccggcggcggcggcatcctggagagcgtgcaggagggcgccaagtcgttcgtgagcgccgtcgggcgcacgttcggcggcgcgagggacaccgccgcggagaagacctcccagacggcggacgccacccgggacaagctcggcgagtacaaggactacaccgccgacaaggcccgcgagaccaacgacagcgtcgcgcggaagacgaacgagacggcggacgcctcccgtgacaagctcggcgagtacaaggactacaccgccgacaagacccgggagaccaaggacgccgtggcgcagaaggcgagcgacgcctccgaggcgaccaagaacaagctgggcgagtacaaggacgcgctggccaggaagacgcgcgacgccaaggacaccaccgcgcagaaggcgacggagttcaaggacggcgtgaaggcgacggcgcaggagacgagggacgccaccgccgacacggcgaggaaggccaaggacgccaccaaggacaccacccagaccgccgccgacaaggccagggagacggccgccacccacgacgacgccaccgacaagtaaactcgccggaacaccatccgcaagcacgtagtgctcctagctatcgataataatgtccacattttttttgttgatgatgcagggggcaagggcagggcctgctcggggcgctggggaacgtgacgggggcgatcaaggagaagctgacggtgagcccggcggcgacgcaggagcatctgggcggcggcgaggagcgcgcggtgaaggagcgcgcggcggagaaggcggcgtcggtgtacttcgaggagaaggaccggctgacgagggagcgcgcggcggagcgggtggacaagtgcgtggagaagtgcgtcgaggggtgccccgacgccacctgcgcccaccgccacggcaagatgtgatcccccatgagcgcggtggacgactaataaaaaaaactcccagcatgttaacctttgtgtttcaagtttcactagctgcttttattttgctttcgttaagtttccactaccgtgtatgttccttctggtaatctaagtgcagtggtgctgaaatctttataaagcccttcagtttaccgcttaccacttttgcttcaaatgtctcgtgtggtttagtgtgcatgttcgttcttttctctggttctggatttgggatattatcgtgggcacgtttccaaatctctatatatgagcctcccagaatgcttttctaaagtaaattttcgaatgctagataatcctgaaaatctcatgagaatctttttttggcgagggagtgctcgtttaagttcgccaatcgccaccgatcggcgcggctcgtagagaacggatagagaagtcgtgggctcttggacttgtggtggtgaactgtcgtctggtgatgcatcctctgccgcacaaaccaacgtgaaaataagacaatcgctgatggcctgatgcccccgagtgaaacgtgattgagctcagcatctctctcaattcgtccatccgaatcgatgctgctgctgccggcataatgcgaaggagcgagatagccagtttagccacgcaccagaataccagacggttcgaagtgagaaaatccgagcaaagtaggactcacatccgtttccgtttacgtttataatgttcccattggatattataagtcatttgatttgattttttttctcggttagtttgatcaaatttataaaacaatatacttatattttttttataaaaacaaacatattatcaaaataatatatttaatattaaatttaatgaaactatctctactattataaaaattaaaaatgtttttgccaatggctcggtaagtcttcgtgtcccgaatctgcctcgcacataatcactatcagtttaactatttatgtgtctctaatccgtatctgattttcctttttccatcgtgtggtcagtccctaacggacttagactcatacacggagccgctctcctcatccgtttccaggcataggggtgtaactacgcatccgtctggaccacctgatccaaacaccctatcacacgagcagcctacctaactaatggcacccgtaatggcacccgtaatagttatctataaactatct

SEQ ID NO: 350 - DNA, 9084 bp, Oryza sativa
aacatctataataattagttgtaacttctttgaagtaaagaccggaatggattctattggtgaattacaaagcatgatccccaatatctgctgctcgggacgcccatcaacacgctatcaagattggatggcctacatcgacatgtcggtaagtgacaaaacttcccatacctaacccctgtgtactaaggcctttttttaaagaactcgatcactgtggtattcctccattgactacaagagaagatccaaagccaccgaaaagagggatcagatccaaccttagaaacttttaaacacattcgcaactccatagtaacttagcttctaaaccgctgagcaatgaaagaaccccataggagtagggtattacgctcagtatgacccggacatgtataactgcttttcacctcatttactcacgtgattactcttgttctgcaccctcgctccctagcccgaacttacatggagaggagaggagggtctatcgattccgtgctcgaggtgatctttctgcgacaaattccattatctatccactttgcctataaccctggcgatggaagcgccggtgttgtcgacctcccatggtctgtcaccatggaggccatatccaagtgatccgagtcatcttcatcatggtggtggctagcttagctactgctactgaagaggagaacgtctaaagaaatggggatcatgattaggggtattttaatccataaaaatatacggtagaaaagacgattcaaagcatatctcatacgtataatgtgacgtggatctaattttagatttgtcacggtggtacggttttaattatgtgaatagcatagattttaaaagttatatgacatatctattttttttattaaaaagatcagccgtcctgtccatgtgagcaacaaaaaaaaaaaaaaacttcagcgcaaaggatgaacggccgagatttgacttgggctaaaccccagtagaaacacccccattttattgcttctctctttgctccgctaccgttttccctttcccggtgaccgccgccgtcgcggcgccaccccctcacccatggcgagcttgccggaggcacccgtaccaccggagagcgcacgcatgggttcacccccgccatcccattccccttctcctcctcctctccaaggagacccctccctaccaaccgacgctcctccaccggagccatccccccaaccccaccatgccaccccgatcccgccgccgtctccaggtcaggccaccgaggggtggcccagggcggaagaaccgcaacctccgatcggtgggacccccggtgcggcgggcccgccggcgccgccttcgttcttcccctcgctggagctgggtacctcggcggcgccacctgcgctcgaagccgcggcggcgggggcggggcagcccggctccccttcgccgtgtcctcccgctgagccggcggccgagttctaccccgggtcggcggcgtcatccccttcttcctcctcgtacgaaaccgcggaggatgactcgccggcgtcgccgccgcccactcctccgccactggtcttatgcgcctcgccggattcatcctacaccgagtcctcccctacgcgcgatcgcttcggcgacgaggagggctcgcacgccgcgcccgagccgccgccgccgccgacgccattggagggcgggccagatgcatcctccgccgagcccgcggcaatggcgtcccgtgcgcgcgaacccatgggctcgcgcaccgcacctgaaccgccgacgccgccattggagagcgggcaggaggggtttcagcagcagcagccgcatccaccgcctacaactcatccggagtgtgatagctcggagcctgcggagctgccgcttcctcccactagtccggctgaaatcgcatacacatcgccagattcagtcgaggtcgatgtagtagcggtgtcgccagaggaagctcctggttcaacggttgcaatggaggtaatgtacggggagactgatacctcagctgtcagtgtgtctccggtattggggagtgcggagacagatgcagccgagatcgatgtaatagcagggatgcaagaagaagctcctggttcaacggttgcaatggaggttatgtacagggagaatgataccgcagcagtcagcgtgtctccggtattggagagtagggaaccagatgtggccgagggcgatgtagtatcaggtgtgcaagaagctcatggttcaaagttttccatggaagtaatgtacagggaaactgatgccgcagcagtcagtgtgtctcctgtattggagagtggggaaccagataaagccgagaacgatgcagtagaagagatgcaagaagaagctcatggttcaaggtttgccatggaggcaacgtacggggagcctgatgcctcagcagttagtgtgtctccagtattggagagtgtggagccagatgtaactgagattgatgtagtatcagagatacaagaagaagctcctgattcaacgcttgccatggaggtaacgtctggagagactgataccgcagcagttagcgcgtttccggtattggatggtggggatccagatgcagctgagaaaaatgtagtagcagggatgcaagaagaagaagcacctgattcaacgcttgccatagaggtaacgtctggggagactgatacggcagcagttagtgtgtctccggtattggagggtgtggatccagatgcagccgagatagatgtagtagcagggatgcaagaagaagctcctggttcaacgcttgccatggaagtaacgtacagggagactgatgccacagcagccagtgtgtctccagtattggacagtggggatccagatgcagctgaggttgatgtagtagtagggatgcaagaacaagctgctggttcagcgcttgccatgttggtaacttacggggagactgatacctcagcagtcagtgtatctccagtactggagagtggggagccagatgcagcccagattgatgtagtagcagggatgcaagaagaagctcctggttcaatgttggccatggaggtaacgtacagggaggttgatgctgcaacagtcagtgtgtctccggtattggagagtgtggagccagatgcagccaagatcgatgtagtagcaaggatgcaagaagaagctcctggttcaaagcttgccatggaggtaatgtacggggagactggtaccgcagcagtcagtgtgcctctggtattggagagtagggaagaggggtcacttcaagaatcaatgcagagaccatcttctcccacaatgaacattgagcaagagtcaatgcagagaccattttctcccacaattggcactgagacaagttcgccagagatggctcctgctggatctgagaactgtaaagtatcatggttgccgttgccccctcctacaccacttggcgaatcaatgccctccttgccagtcgcagctgcccccaaggttttattggtgatgccggaggaagcggttgagtcagtcccttcatcggaagctctggatgttgaaaaacctgcctccatcacacaggctgagcccagctcacctaatacgccaccgccaggatttgagaattttaagtcgtcatggttgccgctacccacgactcctcccccagttgaaaccactgatgtcttgccagatgtggtggttaccaaggcagtggaagcacccattgaggaagtgtctaggccattgccagctttggaggtgacaaacatggagtcagacactgtcctcagtatcttgcccacaacagtcttgccaacagaagggactgagggactactgcaacaaccactattgagacccccttctccagtggtgcaatctgaaccatgtttgcaaaatgagatggcacctccagggttcgagaattttaagtcatcatctgaaccatgttcagcagaggagatagcacctccagggtccgataatttcaaatcatcatctgaaccatgtttaccagaggagatggcacctccagggtttgaaaattttaagtcatcatctgaaccatgttcacaagaggagatggcacctccagggtttgagaattttaagtcatcatggccaccacttcccactctgccccaaactgtaccagatgcagccgcagcggatgctttggcagcaacagtggaagaagcagctgggccaccacctgcattggagttggaggcaatggatgtggacatggatgccatacatccaccaccgctgccttttgacagtggagtggagtcattgcaaaagccactgccaagagcaccttctcccataatgcaagaagcgccctgttcaccagatagggcaccgccagggtttgaaacctataagtcatcacagttactgctaccatctccatctctggcacaaaccacaaatgtgcgacaagatcaatcggtaactgaacctgtgtctgtgatagaggaagcccctcagctactgcactcagtggaggtaatgggtgtacatatggatgcagtacctccattgctaccatcatctgaaagtggagcagatgggctatctccgcagcaattcgcgcaacctcctcctgcagaaaaggatacaacaacctgtttgccagatatggtgcattcaggatgtgacaattcagagccctctcagcttctgtcactgcctgctgttatttctccagttcagaccccagatggcttggctgatgttcctgccattgacagggttgcagtggcattggaagaatcgcctcagcgaccgcttgtatcaggggaaatggaagctggcacagtgcccattcggtcatcaccactgaagaatatttctgaggggtcactgccacaactagaatcagagtcacattctcctacatcacaggctgcagatagcttactagatgcatctgactcaaagtctgtggctgtggcctcagaggagatgtctcagctaccacttgcatcgcaggcaactactacagaccttgtcagtacaactgcaatgcagccacaatctgagggtatagtggatgagtcattgcagcctcagcatccaccctcttctaccgcacatgattcaccttgtttacaggactctgtgccattggtgccaccaccaccttccccttacctaaataaaggttagtatattgcatctcacttcctctaattccatgtctatataactgctattgtttgtgttgacttagtatttgtgatgagtttgggggtctttggaaggtgaaaatgagtcagtgtgagattggatcaaacaccatgcagaggctctgagatgaccaagtttctcaggaaggtctatttcattgataccctgacttgagtacataggacgtccacgtacatggctcactaagctaaagaaacatcttatcctaaatatgattctcttaccactaacaggaaacacatttctatcttatctattctaacctcttaacttggcttccttgatgttcaaggacaactggacaacctggccagccttgcgtgctcatgctactgggtcgtgtttggagttctacgaacagttttctttccattgattaatcatgtaccaatcatatgcccatcttagactatataagtttcctataatttgtgaaaaaagttggcttgttttttgtgattctcagtctttgatatgattttgaaagaagaatgctcatgcaaactgtggctagcagatataaatttaatgaactagttgcgggaatcagcattaagtccttaaagtttaccaagcatgtaatgtgctttcattcattcaaaaaagcatgtaatatgctcacttatatctccattgatcccctatttgtgtatacctggtccctcttaagacagtttcagccaaaatgatgaagtttgattgcaattgtgaaatatagtactaacttttttttagagcaatagatgaaaggaatatactatgcttctgtgtaccttctctttggatgttatccaatccctcaatatcaattcatacatagttgtgaaccaaagaagtcagcttttcacccataaataaatctggggctagtatataagtaatccggtgtaattctctctctctctctctgagcataagtaacctctgttgctaacttgtacagaagtaggtcaaatggtatgtggaagctgccgtattcttcttgcttattttagaggtgctggttatgttcactgtacttgttgccagacaatgaactatgtattggaaggtgcgtactatttctcatttgcccaacagtgttttacttttgttatgccccatataatttttattttgtctttcaacacctatagatatcagccatcttgtatcttacttctgtggaaatacttactgaatactgaacatgctttttctcaaaaatttgccttctgctactgtctaaattatgtgtaagaagtatggttggttacatatttcaacattggaccactcaatagagaactggagaattttgcccttgcctttataatactatttgttcatgcacaccctctaaagctttttcatgcaacacttctgcaaaatatggatgccatttgcgcaaaatttatctcgtctttgtctttccttttgaagcacggctgtccttaatatttccatgtattatagcttttaccaaatactgatgtaccgatgtgtgtatatatgcatcttcttacccttgcatgggttttccccctatgtttgttgcagctcatgaagttggtaaggtgcattgtggacactgtgcgacattattgatgtatccttttggtgcgcctgctgttaagtgctcgttgtgcctctttgtcactgaaattggagtaagtgaactatggcttgtgataaatttacttgctatatgtgcttatttgtgataaatatgttgaaaaagaaggtaatgctacattgaaaaaaagagagagagaactgattatgtactgtgcatgttggtcgagttggtttactttctaatgaatatgactgccttagattctagatttcccatgcatccggttggctatatgagctaaatcactaatcctgacaggcattatttgctatgtaagcatgttgtactgagacctattgtttatcaaatattaaggtgatactacataaacttcaatatttgctctaaaaggctagaaatccccatattaatcagatagagggagggaggttaaccagatagatatatggtagatggaaaggagggatctgaagtctgaagcatgttctgagcatgactcaatatgctcctttaataaaatgtcgtggctcaggtgcttcatatataatagacatggtttgctttatctgaatcccagtcaacacatgaagcttttatcttcctccttgtctcagataatcatgccgtgcactatgatagatctgaagcactacgaactgtctttgactgtgactccactttgatgccttcagctttggttgcctgcaatcctttgctgttcccacgctttcattcagtagatttcttgatacttagactgtcgttgcagtgcataattgttcagctatttgccaatacattgatctccttcaattctttgttccttttgttccaggagcggaatgttcgccgtcggttatcaatcgagcaacccacaagaactaactcatcagggctagctgaagcctgatcagttctggtcccatgtacccatcggattccaagaaagcttcaaatgctaatgtggatgaaaggaacagaatgttcgcccttcgtcatgaggtgtgggcatgaaagttcaagatggtatggacaagccaaagtgtacaaagatagcgttttttttttcattgatgtagacaggaaaggtgaccttgttagtacgactagatctcctttgaaagggaaaataaaagaaaaatagttcgattcaatctggaggtgatatgcgtatgtcatatgaatgataacagagtagttttcagatggttctttcgcggtgaccatcatgttgccccctgacgtgttgaggcttgagaattagccatgctgctaatcgtgctttaggccatcattgctgtagacacttttgcagggattgctcagacttagtttcagagtccggtctgtggtatgggcaagaattgagctgcgaaattttttttgaaaacatctggaaatatactcaatgtggataatggaaagtttcagcttaaccaaagctctctctagaacaatttgatattttatttgattcctgcaaatgggcacaaccctcagtttctgacttgatattaaggtaaaatctcatctaaacagtaattttgtcctcggttaagctttttttagtttagcataaaacaaagtagtttatcgcatactctagctaaacgcgaaaaccatgcgagcataattaattgagttttaattatttcaaacttaagaaaatagatttatatgatattttaaagcaacctccatcagtttagcagcttgaaaaacttgctaacacaaaccaagataaaatcggtaatcagagaattagattgagaagactatggctcctcagttctcaacatgtgggccgaattctttactgtgcctaactaaatgggccgattgcgcaatcggctaaggaaaacgaaggctcacgtctcgtcccgacgacgtgcggccgggaagcgagcgagcgagcggagaccccctctcggctcgcccatggagttcggcagcggcggacgcgacgcccgcgcgcggcggcagctgcaggcggccgggcgcgccgcggcgtacctcggcggcggcttcctcctcctctccgccgcgtcctccgccgccgtccgctccctccgctccctctccgacgccaaccaggtaccacactacaacacacccaaacccttgtcgctcagtttgccgcctccgcctccgccgccgtcgctgccctgacctgaactgggctgcgctgctgttgcgcgcagaggaaattcgcggcgccgtgtggcgcctgcgaggggaaggggacctacgcgtgcaggctctgcaggggcagctcgacgatcgagtggtct

SEQ ID NO: 351 - DNA, 2750 bp, Oryza sativa
tcgtatccattccgtgatctggatctttaattgttggaaacttctcaagctcttctgccaagccttgattaatgaactacaaaatccctcgaattcattctctcgtttccattttagagcatcttaatcttaagtttcctatttatcaaagaaaaattcctcttacgggctatttatagatttacaagcctaacaacaaaccctggggtttggcttagataggcttttacattcctgtcccattgatatggatgtttatagggatattcttgtctttagcccaccttctcaacctactgagcggatacgggtcaactattgggctggccctttctcaggggtctttttaggtagcttttattgtcctctccacaggtgtccactattaggttgtcggccttggactccgcgggttttcccaactccatagtgtttcactatgctttgtcgtgctccaccgttcttcgttaccatctgcttcggcgtgtcggctgaagggcctcatggcctacctccaacacaccatgtacttaattctaagcaaattttaaaaatcttgactattatacttcaatcctattatgtgtatgaaataggatgagcttataaatatctgttgaactggacccatattaagcaccttattagattaacatctttggtgtgaacacgttatcatctagcgagtaatgcctattggctgttgctagctcatccttgcaatgaagtttccaaagacagacacgattaaaggtcgacaagtatgctagccagctgcatattaaccaggcatttttatcaggaaaacattaactcgcattgattcatttgatattcttggatctgtaaataatttctttccacaacttgctgattgttgcgatctgatcttccactataaaagcaccatattcctctttctttgatctcatatcaatctaaccatttctcatcaatctacaggtgcattcttgcaagaaagtggtgaatcgtgaaggccatggctcgcaacaaggtgaagctgcagcggatcatcaatgatgcgaagcggcgggcaacattcaagaagcggctcaagggcttgatgaagaaggcaagcgagctggcaacactatgcaatgtggacacatgcctcatggtgtatggtgagggtgaggcgcaagcaacggtggtttggccgtcggagtcggaggtgatgagagttctcgagcgcttcaagaccttgccacagctggacaaatataagaagatgaccgacctggagggcttcatccaggagcgcatcaacaagttccaagagcagttagacaaggtgaggcgtgatgccgatgaaagtgagaccaagctactcctcattgaagctctcgaaggccgccgcccaggccttgaggggatcaccattgagcaacttaccagccttggctggcttgtagatgcacgcctcaacatcgtcaatgatcaactccagaagctccacgagcagggcctcctaccagcgtctatttcactgccaaccatgggggtactgccttacaccacggcgggctacactgttgcgcaagaggcaccaatccagagggggggatggctcatgggtgttgtaaggggcattggctcattgggctatagtttgttcagaggtagcggcagaagcaacactgctggacccagtggtgacatggtgcaacctttcaacattggcgcaggatcctcattggccaaccagggtatttcattccctcccaagtaaggaggggctcattgccatttgcatgcctttccagcatgttaagggtgggcttcttctaaaatgatgttttctagagaaaccatggtcaactatcaagtttggagggtctctttcactcctttatttacaacccaaatatctcattcctttttttatcccagaatcccatttccattttcagtcctaatatccatttttcctcttttagatccccataaactattcttgttgtttgcttcatgtacttgtggtatcttattactagctaaatgcttaaacaatgaaattcctctcttttatatattttgggactttttgtataactgtactcatgtatgcttaaacagtgaaattcctctcttttataagctatgagaaaatggatgagtgagtaaattaaaaaaaagtctatgttcaacccaagaaagatcttatgtgcaaggaaaataacttttttcagttcgacctgtactaccatatgaaataggtgaaagaagaagcgtagcaaaactataggatctcttgctataagaggaatcttttctagcaatatttattttcctaaagagccggacacgatttttctgccaccctttgcattatgcggatttcaggtgaccgaccataggtgcactatatttggtatgcagcctcctacaactgacataattaaaatatgctcgtataagtgctttacggtgcacatatactttattacgacaaaatattgtcccaacgaacatggcaaggactccctcctccatgggagagaagcaaagcctcctccgtttacggtgactccggccatcagatccaccatcataacccaatgccacctagccactatcttctcgataccccatcgcctctactacccaccacctcctccccaccaagtagcttcaacagtactatcactttgtcgcctcctccccattgctgccacccaccattgggcctttctccaccctgacccacctctaaaaaaagaaactccccc

SEQ ID NO: 352 - DNA, 4755 bp, Oryza sativa
aactttcagtaaagcgtcagtctgtttttacttaacacgtcagttctccatccacttttgccgttccctttttaacctaaaaggcgttatacttgatgctgttgttactactttggtcacgactcacgacttaccaacctttttcagggtattctcaactccaataaaaacggcgaaaactacacgttgaagtactagcagggcaacgaatcgctcacgacaccctgcacaacccgacggaaaggttattccacggcacgagtcacgctcacgcgacacgcagcatcacgccaggttctcaacccgctgtggacacacgggcgcatacgcgaccggtcaatcaaacgacaccaacgcgcgcgtccgcaccaaagcagtcgcgcggcaaacggacggcgtatcaccggggagtgaaaacggtcggaatggtagcatctcctttaaaaaattgatcctctcgatcgactagtaattaattatacttatcatttaaactatttagtattgatgtaaaaaaataaaagaaacaaaaaattataaatagctaaaaacgatacaatcaaatgtgacacctcttatacagaaaagatgttcggttgatcggaaatttccacgaacatttttacccataacccaccagctgaacaccgggggatcggccggcccccaacccaacccgacggaccgcaccgcgtccggcttcgtccgcctccgtcggtccgtccccatcgcccaccccggaaatccacgcaccacacccagtacaccactagcatctcttcccccccgttgacacgcgtgagcccgtgacccccccgcgtcgccaatcagtttcacggttggtgcgtggcgtggctgccgcatgtgccgtttgaccgttgaaaacgccctcccccgccgtccgatcgccacgggctccccccatcctcgccgtccgctgtacccgccgacgaaacgcacgcgcgaaaacgggtacagggtggtgcagagtctacgggggcttcgctggctttcttgccaccttccttcctcatccggaccgaggactccgtgctcgatcggggagagagccactagcagcagcagcgatcacaaattgtgccaattcacaaaccgccgcccccttccctttttaatagctgccttcgcctctcgtcccctctccctcatcgccttgctgtctctgcgaatcgagagagagtcagataaggtcgttaattaggtttgtcaattcggctgcttgcggcgagagaagaggaggagggattagggatggacggggcgccggtggcggagttcaggccgacgatgacgcacggcggccggtacctgctctacgacatcttcgggaacaagttcgaggtgacgaacaagtaccagccgcccatcatgcccattggccgcggcgcctacgggatcgtctggtacgcacacgccgattcctcttttccctgcctgccctagatttcttgccatgttaatcgatccttcgtcagttccttttgattgattgatacgcgtcgatgagtggttgagaggatggagtaattgggaccaattactaatcccctgtttttagagcagggatgattaatttgattctgcagctgagctgagcaggtttttagttagttattatcagcgtagtggttgactggttggcatgtctattcggagtactttttggtgctttgtttttctaatttctcttctgaattccgtgtgctggtgcctacagctccgtgatgaactttgagacgagggagatggtggcgataaagaagatcgccaacgcgttcaacaacgacatggacgccaagcgcacgctccgggagatcaagctcctcaggcacctcgaccacgagaacgtaagctcctattaggctataactagtagtggaactgaagactacgtggttaattacgcagcggcgtgtacctgaatttggtaatctgtcactaactgctacaacaacacgcagatcataggcatcagggatgtgatcccgccgccgatccctcaggcgttcaacgacgtctacatcgccacggagctcatggacaccgacctccatcacatcatccgctccaaccaagaactgtcagaagagcactgccaggtgagtgaactgtgagcgaatgattttttttttcatatatcgatcaatcacacaatcaatcgatagctgcagaaacatcaattcgatcttcctcatgtcacgtatgtatgattgcggccgtgttgttgcagtatttcctgtaccagatcctgcgggggctcaagtacatccactcggcgaacgtgatccaccgcgacctgaagccgagcaacctgctgctgaacgccaactgcgacctcaagatctgcgacttcgggctggcgcggccgtcgtcggagagcgacatgatgacggagtacgtggtcacccggtggtaccgcgcgccggagctgctgctcaactccaccgactactccgccgccatcgacgtctggtccgtcggctgcatcttcatggagctcatcaaccgccagccgctcttccccggcagggaccacatgcaccagatgcgcctcatcaccgaggtgagtgaattaatcagcgtagacactcacacgctgaattatgctacctgttcttgggtctcatcgtgttgggtccatgatcaggtgatcgggacgccgacggacgacgagctggggttcatacggaacgaggacgcgaggaagtacatgaggcacctgccgcagtacccgcgccggacgttcgcgagcatgttcccgcgggtgcagcccgccgcgctcgacctcatcgagaggatgctcaccttcaacccgctgcagagaatcacaggtgcgtgcagagggctaacccaactcgtgcttgctgctctgcttctaaactactaaaattagtacccaaaattacaagtactaatttactagctgagtgtgtactgtgtacagtaccctgttcagtatgctactgcatgtgtgctagtatagcactagtattttctatcgcactgcttctttgactggcgtatatagccgccggtgtttgacccatccccaactatttttatgtttacttgccgtgaacagtcggtctcttgatctcgtcactttaaagggaacccgtcttttagctgtctttggggctaccaacgattttgcatgttgctcaagtgacgataaaagactgtgttactttactgtgtagtagtgcagaagtagaataggtagcacgtttgcagcctctgtcggttagagttcagtagaccttagttttgaaacactagacaatagcagagtggtttagaaggatgacagaagatttgtgcttaagaactatatctcactgacatcgttcttgacatgcagttgaggaggcgctcgatcatccttacctagagagattgcacgacatcgccgatgagcccatctgcctggagcccttctccttcgacttcgagcagaaggctctaaacgaggaccaaatgaagcagctgatcttcaacgaagcgatcgagatgaacccaaacatccggtactagattgaatcaccatggaaatgagatcccgtctatacctgctttgtacatatgatcaagattgagagccgggtagactgaacattgcatttgtttgtttgttgatgttcgaaacccacattctctgcaagttgtggctgctttgtatgatatatggtactatgttcgaataaaagggtttggaactttggattatgatattatactttgcgagcagattgatttctgtattgccaaaaccaaacgtattacgacagcagcgatccctttcgatagtgaaactacgaggggcggcaggaccaactactgaaggcgtattttgtctgaactctgaatcaggacagtttcttcgaactgaaaatcctaacagatcccaaatgatattaccactagacagttgggttatttttgtttctgggcctgccttgcaagtcggacgaaatggtcaaaaaagcttcgaaagggtccgatccttggctcctttcggttccttttttgcctgaaactgaaaggaccaacatgactccttgtctcttggctccttgtgctgcgccccacacttccttgagccccactcgtgcccatattgtgttgaccgagtgctggccggcgccggccggactggagcccatctgttgaggttgagggcattcatgtttcatcaagttagcaccaaacaaatggggttgccatgattaattattataccaaccccatctgggaaataagaaatggtttgccaaattgccatgatcattgatgatatcaacaccatctgggaaataatttgcgttgtacggccccaactcttctgatagacaccatggaagagctgactgaacaaaatccccaaaacgatctcaatggtcaagccatgttttgccaagtccatccaatgatgggtgggtttagttcacatcaaaattaaaagtttggttgaaattgaaacgatatgacagaaaagttgaaagtttacgtgtatagggaaagttttgatgtgatggaaaagttgaaagtttgttgaaaaattttgaaattaaactcagccgatgtcctgtcccaataaaaaacgaatttcgtaggtaggattgtttttttttgaactgatggggtaggcatgtacagcaacacggtcaggcagtcagcccgtgaagcactcaaaagtcattccaggcggaattagaacgaactaaaaatgaagtg

SEQ ID NO: 353 - DNA, 6370 bp, Oryza sativa
cttccaacctgttatttttgttcttttataacagcaagtttaaaagtgtagctcaccactagctccaaatcatctatatttaatttaatagctaattcatactatagccacctatgctgcactattaattttttttgccccacatatcatacataatatattgtatcttagaatccgttctacaattcgcttataaatatattagtccgctgcttttctcccttgtcggttattttacctcttctaacgagaaattctctcatggcctggccggctggcaccccaccacgttcagctgcaggaggagacggagatatctaatccttttttgcaagaccaacctcgcaaacgcttctatttgcgttgcttgtgaaaatcaacctgcgttgtcttgtgctcgcttgcttccgtttgacgcggtagctgaccagcctatgatatactcctacagccatacagataatggtagcagtatcaccacaagaatgtcccatctttcgtgtgtaaggcacgttagtctcaggaggaaaatgacggcactcattgacgataaattaacttgtgggtttagcttaactgttgctttgtgcgaacaaatcacgcgctacaatattaagggagaacatatgatgatagtgtagggtctaaaacttagtccccgttcgaatcctccgaagacgaagattaaaaacaggcacacaaaataaaaaatccattaacacgtgattaatgaagttttaattaaaccgagacaaaatctttatctttgtgagaaaaaagaacggggcctaatattccacgaaacgggatagattcgcgtgcaaatggtctccttttgcgtacaacccctcggattctctctcatattgacacaataacacaaatcaagccccctgacatttcggaaatcaacaaaaaaatcaggtccccgttgaagaaaccaacaaaagaacagaaaaaccccacacataaaacacgcgacaaccaccaccaccaccttcccccaacctccgatttccaaatccagttgtcttcttcttcccccgagccgcggccgcgttgccagctcagcttcgaacccccccccatttctctccgcttctccttctcctcccctcgcactcgcctccccaattttaaactcccttctctctctctctcgtcgtcgtcgtccaccgccgcaaaggggtctcgtctctctcgggggcgatggcggcgtcgtcgtcgtcgtcgtcgtcgatggcgtcgccgagggggaggtcgatccgggagacggtgctggagacggtggcggcgtaccaccagcagcagaggatgaggcgcaagttcaggaagagcctctcctacgcgggggagctgtcgtcggcggggcgcgcgcgaggggagggcggggcgtcctcgtcggcgtccaccacctcgctgtgtggccccgacgaggacgacgagcccttctgggaggaggaggagggcaccgtcgagctcgtccagctcggcgccaaccgggctaagaacgtgctcatcctcatgagcgacaccggcggcggccaccgcgcctccgccgaggctatcaaggacgccttccgcatcgagttcggcgacgattaccgggtgcgcggcctcctttttttttttttgctgctgtcgtctcgtgtgaaatcggcatggtagcgtaggctggaatctggccattgggaacacaagggttttgatttgttgtgctcgggattggcgttgtggcaggtcttcgtcaaggatctgtgcaaggatcacgcggggtggccgctgaacaacatggagagctcgtacaagttcatggtgaagcatgtgcagctatggaaggtggccttccacaccacatcgccgagatgggtccattgcttctacctcgccgcgctcgcctcattctatgccaagtacgccggatacttccctttcacggctcagcaatgtttttttaaaaaaaaaatcttactagaatgtttcattgtttcactgacagctttggcgatttgtgtttttcgtagttacgaattgttgttttttttttctgttgtttgctgcttccttggattgctaatcgctcatctaattgcagatttttgcaatggttcagcagttttgtcattatcgactaggcttataatttactctagagaagttttattagtgctagatattagcccgtgatgttacaggattagttttatattgccaattcttgagtgcaatcttcaactgtgaggttcttctttgacttgggatgctaaaatatctgttctgaatccatcgtaccacatagtgcgagtagtttgcttgaaatgcaaatctgaatatatggtaatattgagccgagatatgcaaccatgttggatctgttgaaccagagggttggagacaggaccagagagcatttcagaaaattcaattcctgccctgtgcatctacccaacatgcccacttggtcatcactcatatgctttcagaattgccagtctgtcctcgcataaaattgtttccaggtcatgatccacatattatgcatcataatagcacatgcaaactgttcatttgttggatcgctgtcagttctgtctaattccatgcttcagcaatctctgccaaccaattgacagtatagtcaatttaatatgtccgttcaagttttggatctattccgatgttgccattgattatatttgttgttagcgttctatgatcgaaattgcttcgagaaggcatcaaactaatgtaaaacagttcatttatagctctaacttgtggacccatgatcttaagctcatcgacccattatgtgtgtgagactttttctttacatcaagatggtacatggaacaccttttctgaatagcttattgtttgtgggtgaaggaaggttgaggctggactcaagaagtacaaaccagatattataattagtgtccaccccctcatgcaacacattcctctatgggtactcaaatggcaagggctacaaaatagagtggtctttgtcactgtcatcacagacctcaacacttgtcaccctacatggtacgtggaggctatccataagaaaaaacctggttatcttcttctgcaaaaacaattgtttctgttcaaaccattgaattaatcaatcggaaacattacaggttccatgctgatgtcaatagatgttactgcccatcggaagaagttgccaagagagcagcactggatgacctacaaccttctcaaatccgtgtgtttggccttccgattcggccatcattctgccgagccgttcttgttaaggtatgtgctccttatttaacttcaggactgttattccgatgcctgcgaattttttgtttcatatttgatctctcaaaaggtagatattcagtcgtggtattttacttgatctttcaataggtagatattcagtcgtggtattttatttgatcttgcagaatgtataggttatttatgcttttttatttaacatgcttaatgaatgctcttatcatggatttgtgctttgattaattgcaagcatgcataccccaaaagcattgctttaaatttaggatgtccattgactatattttaaaggaaaaatgacaaatttatgatagtgtggctgtacaatgatacacatcttaatacaaatgtgtagtatgcttttctatccactcaagtgttactttttttttaaaccaactcaccaggatgatttgaggaaggaacttgaattggatcctgagctgcctgcagtattgctgatgggaggtggagagggcatgggtcctgtcaagaagaccgcaaaagcccttggagagtcgttgtttgacaaggagcttggaaaaccaattggacagttaattgtcatttgtggtcggaacaaaacgctgagctcctcattgcaggctcttgaatggaaaataccaattaaggtatatgatagaaacgtgtgtttataataattctttttaagatgcagactgcttatcctcctatgttgaaacacatgttccttatcgacttcttttaacaaaaggttaggggatttgagacccagatggagaaatggatgggggcttgtgattgcattataacaaaggtatatccatgacattctatgattgttagcacgttatttcatacaaagatctctgtgtcattcttaaatcttaaatgttttttatgtttttatttgtctcaataggctggaccaggtaccatcgccgaagccttgattagagggttgcctatcatccttaatgacttcatacctggacaggttagggtctactaactttccgcggttattataaaagaacggtacgaatgtacatctatgttttatatggttattgactttgtggaccatacatatttaatactacaagggtgaatctcatgaaagttttatacgttaaataaaaaagatgtgtatgtgttttagaacttatttgtagcgtcagtgacactaatgttatgcagtgcacaaaataaatgattttttatcaagtgcgatatacagtatgtagcagttatatgatcacccagtggacatcatctaatgtaagtttgttctgcatggcaggaagttggcaatgtcccttatgttgtggacaatggtgctggtgtcttctccaaaagttctagggaaactgctaaacttgttgcccgctggtttggtccagattctgatgaactgaagaggatgtcagaaaaagcgttaaaactggctcagccagaagcggtgtttgatattgtcagagacatccatgagctatctcgggagcaaggggtgatttcacagatatccagttccttgacatcatcctttttcataccatcgccagaaaccacacctatacaacttatgtgaaaaatccgtgtatagctagaactgcattctttgacctcgtgaaatttgcctttgtcctacaatgtcctgaaaaagaaaaatatgtcaatggatttagctggtttgtttcatctgtctcacggcgttgggatgaggtaagcaggatttcgactgcttttcagtttgtggtctctcatggtagttatgggcttgtttgactgacagctgctcttgtgtaatatccatattcggtttttgttaaaatcattcgttcatatgattttttttaaaaaatcctgtcgtcctttgttcagagggaccagcgatgggctgcaaattgtacactgttagttgatgttggaaagtttaaacctctcgacttgtaacatatccattcatgtaagatccatcgtgactgtaaagtgtatgagacaatgacaaattgtgctagtgagagagtcatgtgcttgttgaaggacagtgagtgatctatcaattgagaattcttacctgcaccgtaaggagctaatgctggcctgcaacaatagaatgttcttttttttttgtctggccggccgcagttctgctttgctcactgagccatcagccatgccaaaacaattgttcgcagtgcttaccccatttaaaccaaaaaaaaaaaaacaatgtgttgttggagctgaccgtctgagatgcacgatgttgcaagagacaaacctaaaaactggatgttgaaacctacaattggagagagaccggacggtaagtgtggacatcgctctcacgacgcagcctaaacaagcaaaagcaaaacctgaacccaacggaatggatggatggatgggctgtgctgccttgtgcatctgcaactatattggtccgggccgagaagaacgcacttacgagtgaccgagcaagagcaggacgaggagtgagaggggccggaaggttttcctcacaatgatgaaggtccaccctttacaagacaaaagtggccatgatgcacgacgcctacataaaggaaaatcctttttcaggtatctgatgatgacgaatgatcagcgatgcactcatctgcctgaatgagatcttttcgagcctcaccatttgcctacaaataattagcagccgttaaatttttaagatatttttaatgtattattttcagcatttgccttaggggcacatatatacatttttttctgataaattatattttaatcactaataaaccgttttgacatataatcagctcggcaaggtcttcatctctgacgctctttcttcctggtagccattctatttcctttgatgtgttcttttctagtggtaatctaagaaattttttaatgatccacataaaacagtgcgaaggtttctatttatattagcaaaaaaatattacaagattacaactctaaaaggctctaatcatgaaaaggaaaagaaaacacaccaccacgtgctagtgacttcttagggcaagtactataagagcaggtacaatagcagctg

SEQ ID NO: 354 - DNA, 6037 bp, Oryza sativa
atataaagtgagaaaattattacaaaattgaatagctaaattactatttatgttttagatttgtctatttttttctcgatatatgacttggatttagactctaattttctgagaatattatactgctgttatattttctaaaaaagaatactattatcttctatttatattattttataagataactaggggtattacaaatactttgtccttttaggtataccatctcgaaaaagagcatatatgtatatacacaccagctgaggtaatacaagataacaccgacggtccaaatgaggaaacccatagtcttagggggtgtttgggagagagtggctaccttaaacaaatgcaaaaggtagagaagaaacaactttttatcctccaacaacttcatttctatatctagacagccaaacctcccccaaaacagaaacctaaaagaagaaaggaaactaaaacgaaactttttttcaaaaaaataaactatatatgaatctcttagaaactattctaaattcatttttgactttacaatatttatcattcgttctactcttcaattatttatcattcgttctactcttaaataattatcgtaaatcattctgtcattcagctattcttagatgctttatccgttctatattatattttgactttttaagttaaagacttggataagtctgtaagaatagcaatatttttaataaaagcatattattaaaatatattcaatgttatatttaatgtaactggtttgacatagtagatattactactttttataaatttaattaaatttaaatagatttataactatgaaagattaaaacgacttataatacggcgatggaagagtaggagcagatggacggagcacccactgctgcgggcgtgaggtgtcgctgtcatccacagccgtagctccacgccatggctgagtcactcgctcgctcgcctaggataaacccgttcatagtctctctctcgctgacgccccggccccacctccagcttccccgggctataaatccacctcgcccttcttcttcctcctcctcagctcaggcagcagcagaaagcaacgccaatacgccattgccgtgctcctcgacctgcatgcacctctgttcttggcgttgagatacatagaggcttggggtgggtgtttaagaactaagaccggagttaattagcacccctgtggctaccatcgatctgtctaaagagtgattagatcgagatgaccatcaccattgagcagcctcaccttggtgagctcatgatccttttctctctctctcttgatttcttgattccagtccgtgaggaagaaaaggttcagcaatgttcctggatggatggatggatcgtggaactaattaaggttctaagttctgacatggttcgcttgcagatgctatcgccgaccggaaggtcgccggcggcggcggcggcgacaacgcggcggagctcgtgctcgacggcggcttcgtcgtgccggactccaacgccttcggcaacgccttcaggtcagctacatattcctgcataggaaaaaaacagagcatcatgcaaaaacagagcaaaacagagtgtcaactatggttaaaaatattatcccctcagaagaaaaaatatttaaaatatttctagtggattagggaatttaattaatcatgtagtatttttttaaatatggtgaaggttattgtttctctttgcaaaaaacagagtgggcagcaagttttttttcaagtggacatgtgcaaataatcatatattttgcatatggaatgtcttcttttttctcctttgcaaaaacagaggttggtattacttgctccctctaaaataagccaacatcgtattaagatatgatatattttagtacaacgttatatttagatttgttatattagaatgattggcttatttttaggacaatgcgagcaggctgacaagacagacatgatattttcgtacgaaattagtaaactagaacatgggcacaactcgaaatgaaagagatgtgtggccattcttgaaacttgtggttgtgcattcaaatcgtacatacctctctctcaagccacaatacatgtttgtcccattacttcaagttgtctttccatgattagccgtttggtttagtttttgttgaaacgtccaaacccaggttttgtttttttttcagataaaactggacaagaagaagatgaatttgactacttaaacgtaaactcaattttgctgaccaaagtggcaagctacttactggtcaaataaaataaaataaagacttatcttttcttgtacgatttcaaaggtttctgcgtgtctatgcacagtgaatgtcccacgtggcatctgtggctgcattaacatggccttttgcctattccttttttgcacgttatcattttcgcttcttcaggaattctgtacttcaatttgatgtttctttaaaaagtccaacacgtggacaaataaaacactacctgtgttcgaaaaataaaaaccttatggtcataatctagaaattgaaatctttttcaacggtggtagtaaaagatatttcttaaaaaaaaggaattaaccggaataatatggtgatgttttaaatctccaggaattatgaggccgagtctgagaggaaggagacggtggaggagttctaccgggtcaaccacatcaaccagacatatgatttcgtaagtgcaaattctgtatctaataatctttttttaaaaaaatacactcataatatcctaaacgacaagtaaaaaagaacgggagctttaatatatgagatttaccattattttggtgcattgtaacattgcaggtgaggcggatgcgggaggagtacggtagggtggacaagacggagatggggatctgggagtgcatcgagctgctcaacgagttcatcgacgacagcgacccggacctcgacatgccgcagatcgagcacctcctccagaccgccgaggccatccgcaaggatttccccgacgaggactggctccacctcactggcctcatccacggtaaattaaactattttataaccgccacaaaaaccgtcactgtaattgcacatccaccgcgtcgccgcaatgaactgataggcaggcctcacacgatacaccgggtaggatttgttggtgtaagagcaggtacaatagcaggctattagccagctataaatatattttaatgagataaacgatgagagagaagagtagtgggctacagatctgtagccagctgcagcacggacttcaagacgcaatgtgtgtatgacaggtgataccatatattaatagtatagtaagcaactattgaatgaattggctattagattagctatagatgaattggagctagtagtgggctatactattaaacttgctctaaggtagtaataatagtatatatctaggactcatccagtcactagcaggtaggccatacgataaataaagatgaataattagatatgatggagtgatacagtatcagtgacggttcgtaacaacctctttggaattactcggctaaaggaagaaagaaatgaaatggcaatacagtggggcacacttgtgacgtgtaacatgttctcttttctttttcagatctgggcaaggtgctgctgcatcccagctttggggagctcccacagtggtcagtcgtcggtaagaaacaaacaacagaagcaaacagcttattgccatctcactgaaacttcttcagattcagctaggaacaatagctgaacatccatccatctctgaatctgaatgtctttgacctttcaggtgacaccttccccgtcggctgcgcattcgacgaatgcaacgtccacttcaaggtaaccaatgaatcatctagcaaactgttcaagacaaatcaaaagcgtagatggatcaagcagtgagctagtggtctaagactgaaactgaaaatattttgtctgaaaatgtgcagtacttcaaggagaaccctgactacctgaacccaaagctcaacaccaagtttggggcctactccgagggctgtggccttgacaatgttctcatgtcctggggccatgacgactacatgtacctggtaaaacacacggttcatcgtgtcgattcatcaccaattgcataccatggagcagagaaatcttcagttctagtactgaggttgtagttttctctgaaatgttgatgtgtttcttgttcttgttcatctcaggttgccaaggagaacaagaccactcttccttctgcaggcttgttcatcatcagatatcattcattctaccgtaagtgcgcgcgacagtcttctttttttcaattttgtcagaattacaagttttaagtaagttttagctaaattttgctatctttgtccatgattcagccctgcacaagcatggagcctacatgcatctgatgaacgatgaggacaaggagaacctcaaatggctgcgtgtgttcaagtaagccaccagattgatcaccctgcatcttaatgtatatagtatgaaaatgtactgaacatgaatggttttcttctgcagcaaatacgacctgtacagcaagagcaatgagaggatagacgttgagaaggtgaagccctactacatgtcactcatcgaaaaggtatgatcgattttgcagcgaatactgaagcttgaaacagacttctttttgtcctaaaacctgaagaaatgatcttctttttctctctgaattctctcgcagtatttcccggccaagttgagatggtgaagaagagggagagaacataaaaaaaattggtcgaaattatcctgtaatatgatgtaattgcaggagttcagttggctgtacaagtatgtagtagtacgtgtacacattttgtatgttaagagcagaatttgttgggagccatgcacgtggaataaaagttgccggtgattgttctttgtaaatgagctcttgtaggtgggatctgaacatgaaattgcattcgaaaagaagggttgaaatttgcaaagaggcgtgcagatttttcgtgtgtacgaggaaagatgagatgaactgagcatctgagccattatctggatgggccttttggggtgtgaggaaatgggcctaagttaaagatggcctgagctgttttgatgccttcttggcaaggggaaaaagtacaccgaaggtcccttaacttgttgtccagttacaaaatcgtcctctaatcatagtaccatagtaccagatagtaccagatatatgacatccttcaacttacaaaaccatttattttaggtcccttggtgcttttcaccctggttttgtctgatgtggcagctgagttggcgtggaacccatgtagaccccgcatgtcagaacgccacatcatcatcctctcttatttcttgtcttttttctcttttcttttatttcttcaattctcctctcttctcgatgcagccggcgccagatggggagaggcggtcatcgaggccagccagggagccccaggcttggcagagagggcacgggcatggcgccggcgggttggggtggtcgtagaaggggcacaccgccgccgccccctcccgcggatgttcccgcgcccgacgacgacgacccggcaccggagaacatggcggcggcggccgagccgaggaagaagctgtcctgcatggctccagcagcggcggcggcggcccccgccgctgggtcttgggcgcccgacatcatgtgatggtgagcgccgcgttggcggcggcggcagggacggacgggccgcccaactccactccgccagtcgccactcctttcccccggccaccgttcctctgcctagtgggcggcggccggcgggggagcccgcgcaccgctcctccccccgccgtccgcccgcgcgatgaatttggcttttttttcgttttcgtaaaccctgctccagagtacaagagagcaaaatgggcctttttctggtcgaaatgaggagcttcgtgtttctgagatttgcgaattgcttttaagtc

SEQ ID NO: 355 - DNA, 4617 bp, Oryza sativa
tagacagccagtagcttttccaagattctgttttttcaggcccagttcatctggccacagagaggcccatcatcacgtaacgaaatgtaacccgactaggccttatggcccaaaaagtcgtaagaacggctaagccttatccaaaattccgaagcttatcacgaaacggacaataaggtatacaccctaatcccaaaaaccattgaactcaaaaggggaataaaatatcgactgggaggttttttctgacggttgtatcacaggatcacacagtattactagtgtattactgcagcgttttcagatcataaacagattctggcggcaccatacacgagaatacgagattaagtaatcacaagatcagcttggaagcaaggaagaaaaagaaaagagcaccgacacggcatttctctcgcatgcgcgtttgcgtatcagtgagtgcgcatttgggtcccgtcactcgcaaccaaagaaagattagtcgaagcaaggtgcagatatcttggataccggagagccggttgaccctagaaagaggagccaagatcatcagatctgccgggtttccggacgcatcaggattagcacatggaatatcctatgttatgcgtgattacaatgggcagcgcaatgcctcgccttggttggttgcctgcatctacagtctggacagatgacagtccgaagcggcttcattgtgacaaaaaagaagaagcaatctttggtttcttggatcagggaaagtggaaagcataaactggaacagaaggccaggcggaaataaactggacaagaagaaaaggcgtatgtaacgtactaacgtgcatgtttttttcctcattcaaagatttcccctcgacttctcattcaaacaaagcaaacatagcgttttctaaaatttatttattttaataatattctcccatgattagaaggggattaaaagaaaatctcttccgttgacagaaaccacatctctactgtagttatctgaattctgaaagcctgaacctctcgtcgtgtctcgtactctcgttcccctcccctcgcgtcgcctctccacttcgtctctataaagtcccacccaattctcgattcccaatccagcgcagcacaaagccctcctccttccaccgcagctgcgctacctacctccaagagggctggtccgctggtcgtggagaaggaagagagatcttccaggctgatccctcctattggtacggaagccctaaactcatcggagctttgccgcggccgcgagcgatcaaatcgaaatctttctttctttgttctttgatgctccaacctagtgtcggatttgattttgactgttgcaatggcagctttctccttcccgagcccgcttgaggatccccgccggagtagggattagggaggggagaacaggaggcggcgattcaccatgaaggcgctcattcttgttggaggcttcggcactcgccttcggcctttgacgctcagtttcccaaagcctcttgttgatttcgcgaacaagcccatgattctgcatcaggtaataagtggtttcgctagtactctgatggagtaataagagtacttatttgcagtgccaatggatgaattgggcacaagttaattatagtacagtattctttaccaacagtccaacaatggcactggcctctccatgaaaggagggagagggtgctaaactggtcagagaacattaatactatttgatttgtttattactcccacataaacatggtgtaacaactaaaaatccatggtaggttgcacttggatgtgattgaatgcacctttttactattcaattgtttctttccttagttatcaatttggttacatgattttggaaaactcttttggtatcacaccaaattttctctgtcctcgaaaattccaatcggttatcaagagtacttgatttatatccaaaatgttggctccagcaaacatgagcatgaggattgaggagagtaatgagctctgaattaaaagttttccgatttatgcagattgaggccttgaaagaagttggagtaacagaagttgttttagccatcaactaccgaccggaggtaaaaaggagataatcttttactgttgtctcatggtataagtataactaacttcacattctaattggtttgctctgatccgtcttttaggtaatgctcaatttcctgaaggactttgaggataagcttggcatcacaatcacgtgttcccaagagactgagcccttgggaactgctggccctcttgctctagcaagggacaagcttgtggatggatctggtgagccattctttgtcctcaacagtgacgtcataagtgaatacccttttgctgagctcataaaatttcacaagagccatggtggtgaggcaacgattatggtcaccaaggtagatcctttctttgaccactctcttgaattgtaaacttgtgtactgtgtatactgactattatttcaatataggtggacgaaccatcaaaatatggtgttgtggttatggaggaggtcactggaatggtggaaaaatttgttgagaaaccaaaaatatttgtaggcaacaagatcaatgcgggaatttacttgttgaatccatctgtcctggaccgcatcgagctgaagccaacttcaattgagaaagaggtctttcctcgaattgcatctgatgcaaagctctttgctctggtccttccaggtttttggatggatgttggccaaccaagggattacattacaggcttgcgcctttatctggattcacttaggaagagatcaaccaacaggttagccactggagcacacattgttgggaatgtgctagttcacgagagtgccaagattggcgaaggctgtctgattggtcctgatgttgctatcggtcctggatgcgtcgtggaggatggtgtgaggctttcccgttgcacggtgatgcgtggcgtgcacattaagaagcatgcttgcatatcaaacagcattattggatggcactcaactgttggacaatgggcacggatagaaaatatgactatcctgggagaggacgtacatgtaggtgatgaggtctataccaacggcggtgttgttctcccgcacaaagagatcaagtcaagcatcctgaagcctgagattgtcatgtgaactaaccctccttttatgttatggtatactcaagttcttttaatgcagtatctttagtttatacctgtgatccttccaagatgttgacctagcatgtgtgttactcacattctgaaaactgcttctcaatgagaattcagtgtgccatatttgattgtaccttcatttggaccatccagtaaagttctcaaccctgcaccaagaggaccagaagaaactctttttcctataaaagaagaggatcagccttgtactttgttctttttgaaacaaatatatactgctatatggaacagacccatgatgtattgcacaatttgtagcaaatgatgcaaagtggataataataaggatcaggcagatccatataaactataggccaattatttgtacaagctcatcgcaaaaactagaaaaagaaaaaataaaagtagaactactggtatgtaagtatgaaacggcaatttgctcatgctgctgtgctgagcttcgcagttgcggttgtgatttgtggtggtgatttcgatctgtactggcaattcaagccttgtcattttctgtataccgatgagtgatggtttatggatctgaagttcttcagtatctcaatcaataaaccaaatgagctagtggagcaactgaagccaacgagatgagaaaccatcctaggccatgcttcttgttcttccatcagcctcagtcttgcaagccattgtgaggacgagagtgttccatattattttctactccacaaaatagctccctgaaatgggtagccatatacatatggccaagagaaacgttggaagcgaatatgcatcggaccttttcttggttgggacaagacacaagtacctaccatgttgtcctctcaaaaagaaagaaaaaaaactatcatgtgttgcaataagggctgggatgactcaaaatcatgtggactggaggcttagtgaattaaaaaccacgtcactctcggatacagtccttgtcgttgggtcatttagatagaacatgtttcatctcaatgcgcctatctgatgacattacaagtttacccgtccttaattcagttaaccattgtttcggtagagaaaatttcgtttgtttggtgaaaattatgcagtaaaaagcttcatctgtatcgtttagtaattaatgtagaagtacaagtttaagaggttatagtgcctcattgcattaaattcagagaggggttggaaacaatcgacgataactttgcaccaatggaaacaaaaaaaaacaaacccaaaagaaaaatgacgatgagaaggaaacgtgcttgagcatatggaacataaattttctgcagatgttccattcaattagtttctcggaaacagagttcatggagcttgtatgacatttcagaacttctgttgtgttgtcgtcttcaaaaattagttcgtatacagagaagggatcaaacaga

SEQ ID NO: 356 - DNA, 2848 bp, Oryza sativa
atagttaattgtagatatacattccattattaattaatacataatttactcatcgttatcatatagtttatgggagcttgtgctgcagctggttataaatctgtagttcgtttttcttttttttacataagtacaaataaaatgtgacaacttatacagtccgctaatatcgtcttattgtactcactcaaataaaactactgcggatgagtactaagtactacctccgtcccagaatttttgtcactttaagtttttgtttgtcaattttgatctttcgtcttatttaaaaaattatgaaattattattttttttagatttgctttattatcaaaagtactttaagtatgacttctctgtttttatatttgcactaatttttcaaataagacgaatgatcaacactacaataaaaaagttaaagcgtctactaatttaaaacagaggtagtactacactattcagctacagcgacccaaatgacgtccacgtgtaaatatcttcgctccgcgcggcagaagcttctcagccaatcggacgagcgagcaccttagacagtgacccatcaacacttggccaacgccaagtcggacccaacacgccaacaaaaacgaatttctcccttaccacacgacaatttccccgtctcttcctgcctctagctagtttttagcctccacggaagcaccaacgtcgcccactgaccgcgccgtcatcccggacgtacgcgcgcacacgccacgtaaatcgtactgcctaaaccaggcctaattgccatgcctccaaactactcctgttcacaattcaagtcgtcgcgactcgcgaccctcctttttttttttctagatctggggcaccggtgtggactaaaaaacgcggcatatgcacgcgggcggctatggcgacgacgacgacgaccgcatctctctcgccttgccgtgaagcttcgaaatttaactctttcccgcgtggatggccgcatatatatgcacgcaatggctcgttcaccacaattcgcaagcaacgtccgtgcaagtagtgctccattattctagcaaagaaggcaagcagaattcatccgcttaaggatcagaaccagatcgatcagttcgatatatcgatcgacaatggttgttgcatcagcagcatcgccgtgcgagtccagtgcgttgttcgcgacgttcgaccacgacggcgacggcaggatctccgcggcggagctgcggctgtgcatgaagacgacgctcggggaggaggtgtcggacgaggaggcggggcagctggtggcgtcggtggacgcggacggcgacgggctgctgtgcgaggcggagttcgtgcggctggtgcaggcggcggaggtggaggaggaagacgagcggcggggcaccggcctccgggaggcgttcggcatgtacgagatggaaggggaagggtgcatcacgccgacgagcctcaggcggatgctgcgccggctgggctccgaccaggacatcgacgactgccgcgccatgatctgcaggttcgatctcaacggcgacggcgtcctcagcttcgacgagttcaagatcatgatgaacgcctaaaccagctgctatctgctgatccctccgctagctccatcagagcgcgcgcatccatcgatctgcagtacaagtagtgttcttgcagcgtgtcgtgtatatacacataggtgctgtaaatcatgctcagttcacttgattggtttaggtgtttatacatcattcatttcatttgttaataatgggatttatacatagtaaattcatttcatttgttgatggatctgtaaatgcttcatggatttattaaggaagatgatttgtaaatttgaatatatatatatatatatatatatatatatatatatatatatatatatatatatatatatatatatatatatatatatatagtaaatttgtttggtgctccatggtgcccgggcaccattgttgaaattgagtatatacccaattcaaatgagtatgaatctttttcaattacttaggtattaacattaaccactttactaactagttcaaagcaagtttgaactgaatttgaacttgtttttgttagattttaattctaggtatatagcatccatacatataattagttaggtatgtaatcatggattgtgaaataaagttaaatttgagttgttttgttgataggtataggtataaatcgaattattataactaggtatatactcacaatttgaaaattttgaaaaatttgagtgattttgtgcatttgataccatggtgcccgggcaccatggtgctccatatgagtgtcctatatatatatatatatatatatatatatatatatatatatatatatatatagcaagttattgccaaattcgaaaactaccgagtctttcccataaaggacggtccgaccgccattgtgtggccaccgaacaatgacatgtggtcaaaccgcaggtgctcgggcggtcagactttaagcatagagttcgagtccatttagttatttatcgtgttttcttgtttgatattaagatttctcgagttctagttgatttttaagtctaattgaacatggcaagagctataaagaagtaagaccacccctcctataaatataaggctccggcttctcccgtgtcgggccgacggactattgggccgccaaatgggccgcacgtatctatcatagaagaaggccccgagtttgggctagattaaaatcagtatttcctctctcacagtaattttaagcatctttctattttttagaaatagcattagtaccatttttatgactgcttattaatttctagctaaattg

SEQ ID NO: 357 - DNA, 2758 bp, Oryza sativa
ttcttactgtcatctatcctctctgcttgaaacagggcatatgccttagagtggaaataacataggatgatggaaaaggttgttcgtaagtgtcatgaatgcagcagtttagcatatttataaataacatttttttaaaaaaacgtatttatgaacaatcaaggttgaattgatcgactatcatccatgcaaatttcatgtattttccactcttattgaccttatcaatgggccatacctttctgaagtaaaccctcacgcagaaaatacttggctgtagtcgtacagccttgaaggttacagaggaaaccaagataacataaagaatgtacttgaataaaatagaaatactcagatgttatttttaattgttccatcagtacatactgcactatccttaaaaaatgccaaggcatattgaacaaaatgcttctttatctaaaacttaattgttttgatgcaacagaaacggtgagaaggtacatagaaggcccatttcttgccgctaggcagttgcagaagtcattggtagatataaaatgacgtataattgcattttcatattagatattctaacttaaataacgttgctggtgtaatgagaagaagggaagagaagtcaactacgcattgttgcttttgcagaaagcaatcacattttgacacagacgtgaagaagaactctgttcagaaaaattattcaagcaagtaatttcggtgtgtaatctatttccattaggcctcaattcacattagaaaatttacttgtaagaaactgccaccaagtagtagaagttgtagccatagtaaatccaataacactcgccatcaatatggagactaaaatttgtgagaaaccaaaatcaaaatcaaaatcaaatgctctacaaaaagcttcactgtcaaataatggccattggacgagagataacttgtattgactaattccagacagcctaatagcctatatcattgggacacgtagcaacgccgtggtaatatacgcttctttgccggccggcctcgatccagtcctataagaagcgaggaggacccgaaggctatgcattgcgctcatcatctcaaaagctcttcttcttctccttagttgatttcatcttcagttgcttgagcttaattacagactgagagaagatgtcttgcagctgtggatctagctgcagctgcggctcaaactgctcctgcgggtaattttcactgtaactttgctgacttgttcttgatttatagggcaatcttttcattattaatattctctaaatatgcagagtaatcgttgttgcagagttaattcttgtggtaactgattgatgttgattttgttgcagaaagaagtaccctgacctggaagagaagagcagcagcaccaaggccaccgtcgtgctgggtgtggcgccggagaagaaggcgcagcagtttgaggcggccgcagagtccggcgagaccgcccatggctgcagctgcggttccagctgcaggtgcaacccttgcaactgctaagatgcctgcctgcatctaccatctatcatgtgtgcgtgtgaattgtgatgcagaaaaataaagaagcttggccatttgggttggtgcttgaccaatatatatggggtgtgtgtgtgtgtgtgatgggttaatcgatgtgctatgttattggtttcactattcacgtactatgcttgtaatggtgtatccacagatgaagtgatgaatatattaaactggtttggctattatttcctatgtatatgtattttgtaccttcaatagtggctcattacgaaattagtccaataattcagtttaatatttacccggttacctgttactcgtaatagtaataatatactcatacattataacattgtaacataccaagctcataaattagaaatgagctacaagtatgactggggataaaaacgttggatacgagtaccacgctgcgcgtggtgagagaaaatgtaaagactacatttttttaactgcagtagtgcagttaatctgtttattagtactattattatgcaagcaagacacatctcacctcaaagaaaaagggaaaaaaaagcagagagaaaaagtactacagttggaaacccaatctaacggctattcttgcccccaccaccgccgccgccgcctccatccgcctcgcctgacctaggcacacgctccgccgccgccgccgttgcccgcgcagcgcattctccattcccttctctcgcggagccccaatcacacgagagaaaccgccttcccctaaaccccggcggcggcggcggcgaacatcggatcgtggacgaggcctcctccaccgaaaccaaacccctttgccgaggtctacctccgccctccgctcccttcgcctctcttgtgtttaatttgtccacaatctccactacaagatccaactctgtttgattcttctggattttactcctcttgattgcctagggttcgtgtacgtctttctctccttaggctaatattagactgattcggtggttttagcaatctagggtttgacggtgaatagaggttcaaatttgggcgttttcccatcctataatctttagttattccaggtctcataatctagggtttcaatggatctcaagggaataatacagggtttgatgtcggcatgtattcaagggaaataccacctctgtttcatcacaacctattttgatgcgtcatgttgaactgaatctggctggcttgacgtatgtgtggatgg

SEQ ID NO: 358 - DNA, 4240 bp, Oryza sativa
acctgagagcacccgcaatggtaaagtaaggtgctctctataaaatatatacatctcaacaatagactagactaatagtaaatcatcccaatagtatgtctacatggatatctatagctctctcatccattacctcgtttttctctatagactatctccaagttattagatagttttactctctctctcttcatttaatctctttcaagtaggaaaatatactgatatggatatcttatagagagtctatagataactattgtggatgccctgatattttataatatactccagctaccacctacgactggagtgtagaaccatggtgatgcacagacgcactgtactagaggtgtacacgcatgtttgcgataataccactacttgtccgtaccggtgtactacactaccgatagtatacgtactagtatttgtgatttgtgcagcagcaattattgtgcccatttgccacagatgctccaatactgctagtagtagtaagtagtagtatacgctagtggcagtatatctgtaccatcatcagttgtgtattccatggctataaggtatacgtagttactccgtatctcttttcccaccggaactagaagctgaggtagctcccaactggctgacagaaatggacccaggtgggccccagcggcagaggcccgcgtaggcagacggcgcgagcgcgtgtagcgcgcgcgagtgagctgtacgcctgtacagctggacgagtcaacgggtcaaacccaccgcaaaagtcccccgagtctctccaacccgtgtacgtacgtacgcgggcgattaaattagcggcgtggttaattaatcctaatcgcatgattatccctaattaaccacgatgggggttaatcgcctaaacttttggcttttaaagaagaagaagggaaaaaaaaacttcaaaaaaggcgtaaactaatctccccggttgcggcgttctcccccacatggtcctttctttccaagtcgtccagcccagcctacccgcctctttcttctttcttcttcttcctcctcgcgctcctcccgtctatataaaccccgacacctccctccccgtctcccgccagtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcaggtaggatcgcgatctcgatcgatcgagctcccaattccaccataaattacatgcacgcacacatcgatcaattccatgagctgagtgtccgtacatgcttagcctgatgagcaattataggacgcaaagtaccagtcgctcttgcatctacatgctgatttctggaaacacagatagctacgagtctaccctgagttctctagcagccaaccagctaagctagaagctatagtgagtgagagggaaaggggagagaatttttagtggttagcagcgtagctagcattgttcatagggatatttttagttgctcatccctcccccgttacatcatccatcctgccgtcgtcgtatgcgtataactgcattagtatataattgattagttgctgcatactatgttttagcaatggtgtactacatgtgaatattttgatgtgacgtgaagagaaaaattaatcttggtttttggttgttgtcatgcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccgccgccgccgggcagcagcagcagcaggaaggcggcaccgacacgccgcccctgtcgtggcagcacggcggctccgacgggctctacgagtcgccggagctcccggcgcccgatgccagctgctggccagccgagtactgcgcggcggccggcggcgcgcagtcgggcggcacgcctgcaccggagctgtcgagcaccacggccgggtcgtcgtcgctgtccacggactccggcgccggggcgcagcccagctggcccacgcaggccgacggcgccgagtggttcaccaccgcctgcgacgcctccagcgccaccggcggcgtggccatgcgcgacacggagctggagctggcccagccgccgtgccagggcgggcagacgtggacgacgtccgagtcgtcgctgcctggcctcaccttccccgacctcgccgtcgcggacttcgagatcggcggcttcgacgtcgatagcttctggacgagcatggaggacgaccagctgtggtgccccacccaggccgccgtgtgaaaagtcagcacggccgccatgggaatccgccgcggcgagcgagcgcgcgcgcgcgcgacacccgcgggtgcacaaccgccggggacgcgtagcggagcggagaagcggattagaagaaggagagaagctatctgggggattagaacaagattaatcgcctcacgatgccatttttggactcctagctcccagactattctaactccagttcttttccgtttctttctccttttttacttcctagggtaaaaaaaaagaagttaaagtgtagccgttatactagtgttgatgctgctgttactaaagtttgtccgttaaattttactcattctttttgagtaaatacagtactgccactactgtatgtacgagctgaactctgtaggattgacaggattactgtacacttctagaaaccggtaataaaagcaaagctccgacgtcaagtcttgattaattactacactttgcatgctccagtgtcgagccgagtggtacactagtacacaatatccccggcccatttctcgccgctaattgtgatcctcgcgcactcgatccttctccctttttttctgtgttttttgttgcagtggctggcttggttatcattacgctgatcgcgaccgcgagcgagcgttttgcgagagatcgcttcgatttgtttatgccgacacggatgttttctaccgcgagaattcggtgcagatcgatcgcgtgcgctgttacatcggatcgatcgatcgacacggctcgctctccccagatgtgatgatccgcgtggccttctgcgtgacactacacacgttgttttcgcaactcatcacctcgtcaggttcagataatttagacgagacgaggggaggggtgagagtgacgattaacgttagcattagcagagcaggagtgatcagctctgaaagccctgaaacccaagtggatgtcgagcagatatgcttttaaattgcaagcactaaaaaccatccgcacggcacgcgcatggcgagcgagtgagctctactgctactgcttgctgctactacgctcactacgacactcttgcatgcgactgagctgtgggcccagccagccaagcggcgttgcatgcatcacctcaaaacacagataaggaaaagggaattaaaagggagtgaaaatggagagcgagagtgtgtgttctctaaaagaataaaaggggagctagcgtgaattgtttacatcttgatctttttaaaaacctttttatgaatagattgtagggaaaaaacgtattaacaaatgaatcatttttaggtaccaacctcattagcaccgagatccaatggctccgccaacggcattatatcgaacccaacccccctccccccctggccctctcaacgggcggattcatagttggggcttaagggccagatctgccctccaacctatcagccactgcaagcaagaatgcaatactg

SEQ ID NO: 359 - DNA, 3171 bp, Oryza sativa
tgtagccccccattgtcagcacatatatattttctttatcttctatttccatatgcaccacatgtttatttcttgtttttcacaccatcgtaattcaaacataaatataacacttaaggccatattttcggacatggaaatggcatatctagtttatagtactatcaacgccatgttccagcagtgttgtgctagggttgcttacttcaagcggtgccgggacggaggaggggcgatgacacggtacgggagatagtgtgcttggtggcacaaggatagaggagctcgctatcggtgtgaaaccttatgaaggaggttggcgacttgtgaacaatggatgttgaggagagttgcggtcttcttattttagggctttagtgttgtatttctttccttgtcttcaaaaattatttaggagctatgtttaggatattactcaagttaagtctagaatcatttattgaatccctcgtaccatgataatagtatggtgcgcaagaaggaaggaagccactagtacatcatttgtatatggttcacaataagattataaatatgtactctagcacacatgtttaaatgttttcgtcttttagaatataagagctctgctcagtttagcatttatgtagtcatttgaaattatatcgtagcacacgacattctagctacagtgttggattaatctacaccatccgatctccaatctcacagctagtactccactatacaaaccgacactcgtggggtacgtcactgcaatactgcatcctccattcctccgatgcatcatgcctgtaccctacaacgtacaagtcgcacaaacaaaaatcccccttgattaaagaaaaacgaacaaagcaacacggactcgatcagagccaataaaaaaacaatgaagaaatccccatgcgtctatgcgaggctgcgacgaagctgccccaattgaccacgttcgctgtagccgcgccccgcgcataaataccccgccgcttcccccctcccattccgcagcatcacacagacgacgcagcatcagcaacacacacacacaccgagcaatcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccggtacttttcaagccactgtccaatactagtttactaatcttttgccttggatacgcgaaagattttgtctcggatttgtttattggttaattaactcgatttgtggcgaatgattcagatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcgatggcctcctccgcggatcacaacaccacggacagtttcacctcggaggaggagttccagatcgacgacagcttctggtcggagacgctggcaatgacggtggacagcaccgactccgggatggagatgagcggcggcgatcctctcggcgcgggcggtgcctcgccgtcgtcgagcaacgacgacgacatggacgacttctggctcaagctgttcatccaggccggtggcatgcagaatttgccccagatttaatttaggcagagaattggcctcttgggtcgatctcttgttcatttttcttaccaccactattctttgaatctttggagctgtgtaaatctttacaaagcggagagattgatgggaaacgaaagaaggcaatattatctttcatggcggtgttcattggagaaaaaaatgaggtcgatcgtgagtaggtgaaagtaagatgtctgcgccgcagtagtgataggcgcagatacgtactttggtcaaaacttttgacccctcaaatttcttgtgtcgaaagagaaaggcgaaatgatccaaaattccaaatagatagatgcctcacgagatccctttacgaaagagcaaaatttcaatacttggacgcaccatacgctagagtttgaaaaatctaacatattcggatctatttgatacaggcctaactcctactagatttttatgaatatattaatgttataacctagaataaggtggttttaaagtcataacactttagtctaaatataaataaaatggcttgctcaaacaacaccagtatatcagctatatatatccaactccaagaacaaaaaataccaccaatatatctacagctagctaagtcatggctttatctccaactactaaatacaactagtactagtcatcaatccatgtcgtatatgggccatagtcatgcatctgtcttctatatgcatttactaaatttttctatggtatcagatcatagtgtttagcatttcctgacaaaaaaatgtagaataaaacatgtacacatgcaactaaacattaataaagtttcaagtggtactacttcattattcttcgggctaattaaaagtttgcattcgagcgtttagatcatggtcaagtggaaaggtagctttgtcgatgcaaattaattacgagaaacatgtttacagtattcagagttagggatttctatccattatctaataaaattaataaaagatatgaaagcgtgcacatatattttgaagttgcaatataccagagataggcgtttagcaactcagcaagacgactatgacggtatgcgcgccagcgccggtccgccgcccactgcgctcgcacacgctgcccggccgtcctcggtttgccgcccgatcgtgtagggtcg

SEQ ID NO: 360 - DNA, 7700 bp, Oryza sativa
caccgcgagccgttaggggttcaaacttccggcccacaacggtaactgtcgacgtttgcgaccgcggccccttctggcatctagaacccgaaccggggcactcgcaacccgacggcgccgtcaactaaccatggcacgaccgtcgcgtccgctacacgtttcctttcgtctccaactcgtattgctcctctttttttttgtattccacccctctatttccgtaaatcatactatcccatgtgttactgtactactatacggtaggggaaatctcgtttttttcatgcattttgcattgtactaacagcacaattgtgagagttcgtgctgaacatgtccagggttcatattcctaatggaaatcacgattttcatgaaaatagaccgattttcatggaaatagaatatttggggttggttccataacaaaaaccattcgatttcatggttaagcttttcaaacaatcaaactaaaatttaattattttgataacatttttctcatttttgtcttttttgttagtttaccggtagttttcgtgaaaactggatatactgctcgtgctagagaaagttttcagtccgataaagggattgtgaagcctgccctaaacacatgaaaaatgtaaaattcaactttgatttttttgcaagaatccttttccttttttttgggtgcttttcttttgtatagcactgtaccgtatacaacactgaatacaacaatgtaggccgagtttagttccaaacttttttttcaacttccaattttttcatcacatcaaaactttcttacacacataaactttcaactttttcatcacataattacaatttcaaccaaattttcaattttagcttgaactaaacacacccgcaatattagaaatttttttctcgcctccttatctaataaggacaaatctgagggacctattcggaaaaaagagatgggttaataatttattcctctcgctcgtcttccccttccccatcgcttcaacgggcgaggttttttgaaagcatcatcctctctctctcctcccccatcgactacccccgacacccaacggaagccgtagaaggagagagaggggaaaagcttgctattttataccctcatctagggttccgagcccaccggctctctccccccttgctggcttcgcgccatctctcccgccaccgcctccccccctccccccctccgcctccgatagattcgcgctcgccctcctgacccacggattcggttcccacgaaaccgctcgatctgggggatctgctagattcgtaaggcggcgtttcgatcgatctgttcgggggtttctgccgtggggaattttgatctataaagttagttttttgattttgtttcttttttgctttttggtggcggtttcgctgtgttaggtttgtggtggtggtggtggtggtgaggatgtgcttgtgccgttagatgggggccatggcgatggtggagcaggaggggtgcgtcgagaaccggcagcccctggcggcgtcgagctcgtcagtttccgacggaagcagctatggcggcggcggcggcgggctcgcgcagatgtcgccgccggtgtctagctcggcgaattccatctccggtcttaggtaaggaagttctttgcccgattcccctcagttgggatcctattatgggagggatctaggaaggtccgttggttagtacctaagttcgtgtggtagttgagaaaaatggggccttcgtggatggctccccgatggttgtgtggttttatcgctggcaatttgccctgtctgtgattccacgagcggttgtttgtgcgtttgagaaaaaatcttgccacgaggagtgctaccttggcggatatgtggcaccgagagtgttgtggtggctgtttgagtgataaatttggtgtttttttggtatccatttgatgagatacttttttatattcagacatgactttgagtgtgttatgatggatatactgatatgaaggcgttttccttttgggatggctgttgatgttttcatttctgtaattaatttgcttgccttactttaaagtgtgtatattgatgtaatttggataaaaatatgttcacttggaacactaaattggtccggttacatgcagcagtagttgtttaaactggaaatgtgttttttatgccatgacccaaggttttattagatttaatatgcttgggctacagcattggagataccatttacttgtaaccttgatgtgtatattttttgttctgactgctgcgctaaaatatggtactggtgcactatagaaatagttgttttaatgaataaacagtatttttttgttaggccctgtttggaacgtttaccctttgtgtaagattcctgagttcaaaacagggcctgaatagttgcagttacaactaaccgccatttttgtttcccacttttaatttcttgatgatgaattgaatggtgttagtagggttaagcagtatttttttcatggaaatctttcttgttcatgaaaggctccacacatgggaaatttacattgtcgaactatagccttaatgttcttccctatgtaggtctctcaaccaacaattgctgtttttttgggtcatcttatgctagtgtatttagatataccttgtgccttctcggacctaatatgctattgtgccctgaacagaaaatctttcactttatttttgctgataatctttatcttatgttaggcggacaagcgggccaataaggagagcaaagggtggctggacaccagaggaggtcaacacctcactctctattgtacttcataaatactccataagtcctattaaatgcaatacatacctacatttgttacacatatatgctagtttggtttgtatatgtattttggcatattcagtggtaatatcatgcactggaaaagttcttagttaatctttttccattcctgtttttctaaggttcttattttatccgattttatttcatatatgtttttattgttattcatggtctgaccattgattttttgtttgaatcaaatcttctattttcctgcttgaacgacatttccatgttgattcagttacacaatcactgttactaattggtcttaacttatcgcaacaggacgagacattgaggaaggcagttgaggcttataagggtagaaactggaagaaaataggtccggctctcaattccactgcaccagtgtataacttgggcagtcagttatccttgagatgatgctatcattttgttgaaaacaacctgtcaggaggattgcaaatgcctaatggtttgattccattaatatcggcccatttgcatataaatatgcgtatacaaatatgatctcagcaaactaatacatttttgcgtagattatatttgtataaatatatataagtatgcaacctatagtaatattggtgatcttgtagttgaaatagctgtttttttacctttttaatgttgtagtacttcattatatcagttgctccacgtgtactggcatacagcatgccatattatttttccatatctgtatgccaagtacattgagctcatagaatgtatctgtatgcagccgaatgttttccatacagaacagaggtacaatgcttgcatcgatggcaaaaggttcttaatcctgaacttatcaaaggtccttggactcaagaggtttgtcatgtagctgactttgctttgatggtaagcgttgacattatatcttctaattgttatattaatgccatgttttctgcaggaagatgatcaaattattgatcttgtaaagaagtatggaccaacaaaatggtctgtcatagctaaggcattacctggccgtatagggaagcaatgtcgagagaggtaatatttttatatcatggctgtattgttaccaggattcagctcactgttattaataaaacttttaaatttccagttatttttttcacatatgcatttatttccctttacatgagacattaggaaacttttgtaattgcaagaaagaactttaaattttaggatgctcatagttgctacaaaagctcaggatcccgtctattatgaaatatgaattaattaaggccttgttcggttaatccctgtgatggagggattggaggggatttattccacacctattgtggtgtggaattattccccctcaatccccttcaatcctcttcaactctaaaccgaacaaggcctaagaaatgcactacttactgaaagaactgtgaaaataattggctaataattatgctacagtatctcatagctgaattcaaactgttgtccgcatataatttactttctttatggcttcaatagtatttgttatgaaaaaagtgcttaagtttggcatgatacaatacattatacggagctaagtatgaagtcatacaatcttaggtggcacaatcatctaaatccagaaataaggaaagatgcttggactactgaggaggaacaggcactcataaatgctcatcggatttatgggaataaatgggcagagatagcaaaagttcttcctggaaggtacgtttataaagcttacttccctcggaattttttgctttcattagttcatcgagctaggtcaaaatcacgctgccctcgatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatgttgctttttccaggactgataattctataaagaatcattggaatagttctctcagaaagaagcaagatatgtacaataccagcaataatatggtagttccgaaactgcttgttcatgataagttcaaggataaaccaaagctgatggctatggagggtcatcttgatttgaacaaggcacccattatcaattcaaaagaccaacctggaacagctcatcggtctaattgctcagggtttctatctcgttcctcattaccaactgctcagccacttacttcccgtgaggcatctgtagttgatggttccgctgtcactttagtggcgcaagctctggaaagtgattctgtccgtggtaagggcttggaaattgattctgttcatgagaaaggtcttgaggttaactcggcacctgatcataccgggaactcttggaccattcaactagaagctgcaccatccaaaggtgaagcagaattatctttgaagaatgaggcacgctctcttggtccactttgttaccagatccctaacatggaagatgtagtccctgtgagttcctcactcttttctgaccatcttactgggaaccatacatctgaacattgtggggatgatatattgtcacctgctggctgcactactccccctccaacaaagggaaaattaacaagccagcttagtgttgattcaattttgaagagtgctgctaacagttttccaggtactccttcaatattaaaaagaagaaaacgggataaatcaacacctgtttcagctagtgagatgaagatcagtggatcaaatactgatagattttacactcccatggggatggaacctgctacagctacaccagagtcattcaaaactacatcttttttgtcattgggttctcttgatggttctgtaaagagctttgatgtttcaccacaataccgggcaaggtcaaaaagaatggctctcacgaaaacagttgagaaacagctggatttttcatcagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggatgtaacctaatcttggaaaatgcaggtatgctgttacaaaaatcttgaaaacccctgctttacaattgagatgcattatacttttcatagccagtctacaaattctacctggtttatctgatccatgttggtagttgggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatgatatgattcagctgtattactggccctgtttgggtgagcttaatttagagaaactggaatatgtttctagattctaattctatatctatagtaactatacatatcagaatatgtatgaaaaattagactatgtaagaagggtgtgttcacactaaaattggaagtttggttaaaattggaacgatgtgatggaaaaattggaagtttgtgtgtgtaagagttttgatgtgatgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactcc

SEQ ID NO: 361 - DNA, 3869 bp, Oryza sativa
ggaaaaaaaatgtatgggaataatgttagaaaatggaaatgataaatggaaacaaaaacgaaaatgacattgttgttgttttcgtattttactgtatttttacgaagattacttttttatagtatggtgattaccatatttctaaataccctaatatctatgatcaatgtatttatttgatccgtagctttagaggtccgtcaacctctcaaccaaatccttaacttgagttcatagctaaaagagagacaatttgtaatctacctagtgcaagcttaaatttatttggtatattatatagttatgtaagctaaatatgtgattttgcagtccatttttttaaacatttattatcccaatcgatgtcgagatgtttccgtgtgtattcaattttcgatattgtttttcgtttaacatttatatccaatttctagaaaatatatggttactaaaatggttgaagttgtttttcgactttttttttatcgcatagaggaaccagttcctgtaacttaccgctctctatgtccatgtcaactatccatgttagatagcagcgtatgttagagaagttccttttatgcataggccgtgtttagttcagcgcaaagtttggattttggttgaaattgaagataatgtgactgaaaagttatatgtgtatgacaagttgatgtgatggaaaatgactgaagattggatctaaactttgtatctaaacacagccatagagccatacatggtgtgcagtgtgcacacgcatgtgcgagtgcgagcgatctttttgcagttaaaagtacattataggtcctaatcatatagtcaccctatcaaagaaagaagctctttaaggtggtgaaaaaataatgcgaggaaaaaaacagagagaaatttatttgccccccttgcagagctgccacctttccacgaagttgccaaaattgacccattggagcacgtttttgccaaggcgcccccctctcggccacaccacgataaataccccccggacgcctccccgttccaaccttactctgcagcctcggagcagccgcctcccttccaagaacacacaacgcaagaggagcagagcagttcagatcagagcagggaaggagcaagcacaatggggagggctccgtgctgcgagaagatggggctcaagaagggtccatggacgccggaggaggacaaggtcctcgtcgcccacatccagcgccacggccacggcaactggcgcgccctgcccaagcaagccggtgagtgacagcggctcgtgttcggttcaggtcgtgtacctttggcggcgccggtgaagcaaagctaaaatgggttttgatgtcgcagggctgctgcgttgcggcaagagctgccggctccggtggatcaactacctgcggccggacatcaagcggggcaacttctccaaggaggaggaggacaccatcatccatctccacgagctgcttggcaacaggtacacacgctgctctgctcctccttaattgcagacttatctgatctgatccccccaaatttcgctgctcctggtttggagcaatgattgttgcttgcttatgtgcttcaaatgctatgagagggaggtttattccttttttatttatttagttattattagttatttattaccattgtggaggggcatatactgatatgttatcctcctgggccacctgctctcgatgcaaatagagagaaaatatattgctagtcgtaggccacttttctgtagctaattacatcactgatgatgcgcgagatgtgctaaaagattccatcttgtttggctcttccggtgaccccccttgaattcagcgctgcaaaaacatgcgctttgcattaaacaaccgcatgtgatcccgacgagggaatcaaatcacgcgatgatagcaaagctctaaatcaaaatgaagtcatctgaaatagccaaacaattttttttttttgacaaaatgaaacatgaacttgggcactgatccgctctgaattctgtgctacgcaggtggtccgcaattgccgccaggttgcccgggaggacggacaacgagatcaagaacgtgtggcacacccacctcaagaagcgcctcgatgcgccggctcagggcggtcatgtcgcggcgagcggcggcaagaagcacaagaagccgaagagcgcgaagaagccagccgccgccgccgccgcgccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctagagaaagagagagaattttaccgtttcttcggttaattgatttgttttttctctctctgccgccatcttgcaccggagggacatagctaacagacaagagtgtccatgagcgaatcatcaagcaggaagaacgcgaatcatgcgatgcgatgcgatgagatgcacccagtagctttgatagttaattttctttttttacctccttcctgtatgtatagaaacagaagagatcagtgatcgaaacctgagatcctttctcacaatgtgcaaactggatcatcagaaaacgggctctgcgtttctcatttgattaattaaattcaacttgcacgctaatcctactagtgttctgttctttattttcccagagggtacagtcactcgtgttcggttacgaaatcacatcatcacgtactgaaaccagtgtacgggttcttgtctcgtgatctgttcctctcctgtgcacgcatgacgcagttgagacgaaacgctagccacttgtttataagaaaaatgaaatcctgggaaaaaaaaaaaccctgtgtaaagggaccgctaaactgaaataagatttctttcgcgtagtttacagttaagcaatggcactggtagatctggctgtcctctcaatgattctgcatctcctttatttgatcttggaaaaaaaagtaaacgaagaacatgcagtgtgctgtttcacacgaacatgtatgtgatgacgtttttctgttccagcctgtgtaatttatgtttaagctgtggaaacagtattcaactatacaggcaagcgcatgcgtttgtttatgtgggagttcagatactgtattgtcgattgtatcttttgagctgttccagatgagtaatatacactgctcattatcaccgacagtttgatgagcatcacagcagtttgtccatagacaattatcttgatattaaaaaagctacttcctagataagagattctcattgttctaaaaggatttgtgaaaacttcccaattgtttgtcaagtccaaggagttgcccgggtcgacaaatagagtgaagaggatggattttacccatttggtccagggttcatctataatgagaagacagtgtgggcaaaatgtatcacttggtgtacttaatggttttgtgggaacttccatttggaacgagaccttgtctaaattgataaagcacatttgccaattaactctcaacagtttttattattcttagttaaatgtatattccattgagcaggttttgtgcatgtttttcttgttttcttaattctgttcacattatcttcaagacttcaacccttcatggtggaatcccaattattg

SEQ ID NO: 362 - DNA, 3596 bp, Oryza sativa
cggccccacgacacgagcttgagtacttgatgccgctgccgccacctagcctcaatggcttgcgggaaggcgtcaacggcgcggcgagccccaccggctggcttctcccccttacctccctccctttcctccctctcctactcaagctggtgtctccccgtcatcggatccatcacaacagctgcccataaactagctttgcccttgccaccaacaccggcccatcaccctcctccatccccatggctccagtgccgccgccaccacctcatcatctgcccgtgtccaccgcccaccgtcggcccgcgtcatccctctaagctcagtgatctccctcctcttcccctagccccccctctcctcatccaaccctcaccctaacacgggaccctaaaccttaactcttctaccttcgttggggttgctgaagctggcggagctagggaagaaggtgttgtcagagcttgaggaggagaactgggatcgccggagcatgaatcataaagcaagtatcaaggttagtaatttgtaagattttggctccccaaatctatcgtcagctatttagctattttttattgattattttaaggtgacatgaggatatggtgagagggatgaaaatactttcccttaaatgtatcgatcgatggctaggaaatatgaagtattttctctatctcaaaataagttaatttagtatgggatgcgacatctgttagtactacttcctctgtcaaaactaacctcatattaggatgtaaacatttgtatgtccagatttgttgcactagtatgtatgacgttgactgtttttttaaggacggagggggtacgtactactagctagctagatgccgacggatgatgatggattggaaaggcaagtaagctggagtaggtggtactagctagctaggtgtgccacgcactcgcactgcacggagtagtactgctgctgcagagaggcgcacgacgactataaaaggagagtgcaggtatcttcctatagtagctagctaattgtattatactagcttgcttgttcaattcaatcgagcagtagctaattgcatagtgatcgatcgatctgtatagatggtggtggccggcaagaagcagggacggcattctttttctgcatcatcatcgtcgtcttcgtcttcttcttgttcagtagtgcagctgggtcatcatcagcgcccacagggtgaggaccctctcatcggcatcaaagcagcagcagcaggaggaggaggaataatgagaaagggcccgtggacggagcaggaggacgtgcagttggtttggttcgtgcggctgctgggcgaacggcggtgggatttcttagcaaaggtgtcaggtttgcgcggcggcgggtgatgagcatatgcgtgcgtgcatctaatctatcgattaattgttgatgatgtcgatcagatggatggatgcatgcatatgccgtacatagtagatttgatgatagtaactgacataaatataatgtatgcgtgcgatcaacgctggttgttggatcgtccgtcgtgtgtatgggtggtgtgtggctgatgcaggtttgcagcgcagcgggaagagctgccgtctccggtgggtgaactacctgcatccagggctgaagcgagggaggatgagccccgaggaggagaggatggtggtgcagctccacgccaagctcggcaacaggtggtctcgcatcgccaagagcattcctggccgcaccgacaacgagatcaagaactactggcgcacccacctgcgcaagctcaagctcaaacagcaaaagcagcagcagtccgacgaccaccacaacgacaacgacgacgacgacgaccgcaactcctcctcctcttcgtcctcctccaacagcaacagcaacctgcagcagcagccgcagccagaggatgagtcgtcggccagtggcagcctgcaggcccaacatcatgaggaccagcaccaactgttccttcatcctctctggaacgacgacatcatcgtcgacgtcgactgctggagcagcagcaccaacgtcgtcgctccgccgccgatgcccgcctcgccgctctgggatatcgatgacgccttcttctgctcggattattcgctacctctctggggatagtatatatcatccatcagccgccaagacgatgacgactacatcaactcgatcgatcgatgcctcctaatcatgtgggagtactcagctcatctcaattgttacatccttgctacagctgctaattactgtaattactagcttgcatatagggatcgacggaggaattaatatatacatgttagtaactcgttctatagcgcaacttgcagttgcatctcaatctctgatcagtactatataaatatatatatatgtaacagctgctagctatagctagctgcgtacacatccatatgaatgtgtgtgtgttcatgcttgtactgcctcttgtagtatatgcacatatacgtgcaagtgcaacagacggctgctggctgatatattttgatcagcgcgccacgtgcacgtgcatacgtttcttcatttctggcaaattcatatgtatcatgttatacactgaactgaatactgtattatgcttcacgtaccattttgtatatatacatatcagataataattttatggtggcttggtatggtaccgagtggaattaacagatgatcatcgttattcttttcgcacgcgcgcgaagcaagcatattagggcagtagagaatctgaatttcgcaaatagcttgcttacacagaatctgaataaatgcattcatgagatgcaaagccaggctgattgaattgatacccgcccgccgcgtgaatcttaataattgtgtctgtacatgcagatgcatgagcaacatgcatattgcctcctacctgaaaactgtggagcgattgcaactgatacgtactatatcaatccaagatgctgcgtactacgtgctatatacagaacaacaagattaggaggacagctatctaaatagctactgttgccacccggccggcgattagctatacaagcaagagaagatcagaggccggacaggtacgtgttccttttccaaattccatctcaactgtagtcggcctgaatgagcgagatagatagtagatggagggaattgggtgatgtgtattagctagctagctgaaggtcagccactgccactgcccctgcaagttggagaggaaaagagaggccccaattcaactgcttccaagctagatagcttctgataagccacctggtttttattcttttcttttcttttctttctttctttctctccggccggccggcctttaaaaaggagatcgatcatatcgatgacgatccaacaagatgaagagctagctagctagaaggtgccaagattaaagtggtagagcatatagatatcgccgtacgtgataaggagccagcagcagcttggtacctttgtgcaacttgcctaatttgctgtaattctctcatattacctagcattatcctgatgattagtttactccaactagctagatagtgcttcatcaccatgtagctagcttgcttgc

SEQ ID NO: 363 - DNA, 4822 bp, Oryza sativa
acatttttttatggagggagtatttcaattgcagccatgattttccgtgtctaactttaaccgtctgttttatttaattttttttaaaaaaataaaaacataagtcaggagtaaagtattgtttatattttatcatctcataaaaaaaactaattacaaaatttttttaaataagatggacgatcaaattatgatcgcacttaaaataaaacggagggagtagaagagaaaaagctcaataattcgtgtagtaccccgaaagccagccgaggtgacatcaccgcagttctgctcatagtttgatccaaaacagttttagagtttgttctcactactaagttcaaccccccaagatattttcattctttgcttgccaaaaatcatcagcagaaaaaaacatgaactgcttgttaattcgatctataccaaccgaagtttacctgaaactctgataactgcagcctatcatgctccaccagctgccagggcaattatggtactatctccagagcacgcacacagtaaatagcagcctaacatccttcgatcttatcgtcggcaaaacacacacgcatagagtggataggatcacaggaacatgccatcgattcgtgaagacccacgaaagcgcacggttttactcctacacccacatactagtagtagtagcggtagcagtacggtacatgtggctagtactagcagtaatgcttggtccggagcagcgagccgtgtggttgctgcagtgtgcgagtagccaactagtggcaaccagacacatggacaagtagcagcgaagcaggcgaaggaaggggcaagtgagtgccgtgaagcagcgagagccacaagaatcgagcggcttccggggctctctacaggattgaggcgaaaagtgcaaagccggaaagggagagagagaaaaaagcgtagaaaaatccgatccgacgtggcgccctggcctgtgccctttttctcctctctcctgcctcctcttggtctcatttccccttcctgccttgcctcctcgtctccttctctgctgctctccaagctcttcctgcttccatcaggttgtctcgagaaagattggagtttttggtggtttgggttgtgcggttcttgcttttgttggcgcaagcgcatggctggttctgggacatagtgagctgagatagagttcttgtgttcggtggagtttggctttggtgaatcttcgattcaagtctggagatggcgcgttttcaggtaatgaatccttctatcagtctatctggtggcaaattttgttctttggagtccacttttcatggcagaaagattggatttttttcccccaataagatgccacagtaataaatcttttgttggaaaaagggagcaaagcaagcagctgctattctcatgttgctgaaattgacttctccatctctcttttgtaggaaaccaaggcgaggaatgatcaaggacctgttgctgatcatgttgggcaccaaaacctcatggaaaacctcacagatcctctggattccagtggcatggacatgatggacgaagcgcgaattcctaaggtaaatcctcctccttgcaaatcacagcaaaagggggcaaatttcgtgcagttaagatcttgtaacaccaagctcacgctgtgggtcttgccttgcaggcgcggaagccatacacgataacgaagcaaagggagaaatggaccgaggacgaacataagctgttcttggaagccctgcagctccatggccgagcctggcgacgcatccaaggtactaattttaccgctgcaagaagctgcaacggtgaagcacagtttctggtttggtaagaattttactgacaaaggatacctcgctccggttgcagagcacataggcaccaagactgccgtgcagatcaggagccacgcacagaagttcttctccaaggtctcacagccttctcgtgcacaaaaaattccctaaatgacttgaaaaacctccatggattgtgttgcttgcaaggtgatgtaagttgctcaatcatggagagcaggctgctttgcaatccatgctgccacactcgagaccatgtttcctgaccgttatctgctttgcactccggctgcaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggtatattcttaggagacaaaatatagtatcctctgcaaggcatatgttctttatatcgtgcaggaatatataagctatttgctcaagtcaataattcttcaccttgtcagcatggtctttaattttatatatgttggaacttgaaattctggttatgccttgatgtatccttgcacaacatgatatatagttggtgccttctaaatcctgaatcctgatagtaaatatgcatttcaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcaacagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataaatttttggagcctcgtagatcactgcaactatagatgcttgctactaatattttgttcacagatgagtaggaactgatgtactgcaggaggggctgctttcctgttacaagaggcagattgaaaccgcgttagtactccacaaaacagggagtggccgtggttcttgtctggccatgtacagttcaaatattctatgtttccattttcctcgtcgtgtgtttgtaatttcgctcccattgcgggagcgttcagaggtcaatggctgtcatgcaatgacaagtattttgatagagttgtagaagggttgtactgatgtaaattatacagtaacttattatctgtaagacaataacaggcgagctaaagaaaacaacgttggaaagctttgttcagtacttgttttgacgtgaaagtgcaaccaaattctgcttgcatattgccatatgctacagtggtacttgggctgatttttgctgaattaggacataggacacatcttttcaaatttctacatgcgactcaatatgttatcactatatcaattgcacaggtgttctacggaattcctcaatgaagtgaattttaggatggttggtatcctggcaccggaaaaggcactcgcttgcttttgttgcttgtattggcaaatacacaataaaattcagacatagcgtttgactagatctaattaccatgtcaagtgaaaccgctaaatgtaccaagaatgcatcatcatctgagaagtttggcatcacaaataattgaaaattcagtatcatccgttaggatgagatttcaagggggacagagtctaagcctggaatacccaaggctgatattagcattgcgtaaggaaatgtacaaatcaaaaatcaaatgaaaccttttcctgataccacaggaaaggcgatagctgtgacaaggaaagacttgccatgtttgttttcaagtgttaaggtactattagtaaagtagatgtgcagtaactcattcatcccaaggtgaattcagtaattgggcaacgtttggaacctagttaattcagagttcggacctttgccttgcaacctccacaaagatcactctcccatccaggaactgcacaaagatgcagagaaattgcaaatatcagtatattagctttaccctttcatcagaagaatcagagacaaacagatgaaactcagccaaaaggaaacaaaattcagaagtgcctttttttccctcttcttaccttgccttgcatcccttccatggcgttcttggattcctcctcactggcataagacaggaaagcgaagcctctcggccgcttcgctactctttccatcacaagattaactgcagcagcacacggcagaatcaaatcaagcccaagaattttctgaatca

SEQ ID NO: 364 - DNA, 3485 bp, Oryza sativa
tggtaggctttcccattatattctggcaaaaactttgcttccatttttctattgacgacgatgagttcgccgattccggccgggccggctcagcttttctccttcggctagcgtttggacgcacacttttgagagaatcgaaacacggagagaagtgctccgatgcatgacacctccttttccacgtacttaacgccaaagggaaacaatgatatgcagtgaacacaaagggattgaccctgcccaggatcatcaatacacgttgaggcttcttcgtgtgtgaaagcatggctaactcgtctggtcaaaggcaaaattgctgctatcctaaaacaaatagtactaggataaataaatgaaagggctaatataacactcgcacacacgcgagacgacaaaatggagagctagcacacacgatagggacggctcgacggtaggggaggaggaataatgcaggcaggatgttactatggccacgtttagttggttagtgtgacaaaaaatttttaaaagtatacagacatacataatatatatttaaagtattaaaggtagactaataacaaaataaattacagatttcacatataaactgtgaggtgaatttattaagtttaattaatccttcattagcaaatgtttactgtagcatcacattgtcaaatcatggcgtaattagactcaaaagattcgtttcgcaatttacatgcaaactgtgcaattggtttttttccatatttaatgcttcatatatgtattcaaatatttgatgtgacggaattttttaaagtttaaattcaaatatttgatgtgacggaattttttaaagtttgaagggaaataaacacggcctatggcgcaaaattgtactacaaactccctttcgcgagacgagagaatgcaacgccgtgccgctctggcggctggggcccaaccgcgaaaggcaatccatccctctctctccccgtcgcgtaaggccgctataaatcaacccgtcgcgggttgcattgcatcggtcggtctcggtcgctgccgtccctgtgcttggagtagacacgagccggtgacgcgcatatcgtcttctgctcgagatcgatcgatcgatcgcttggttggttgctgcgactgcgagggaggccgcgggtggtgaggaggattgtgcaaaaaaaatggggcgcgcgccgtgctgcgacaaggcgagcgtgaagcgggggccgtggtcgccggaggaggacgagcagctgcggagctacgtccagagccacggcatcggcggcaactggatcgcgctcccgcagaaagcaggtcggtattagtgcactgctcgtcgtcgtcgatgctagccggtgatgaaacgccatgtttgtatgtgaattctgatgtctgcgtgttctcttgtgtgattcagggctcaaccgctgcggcaagagctgcaggctccggtggctcaactacctgaggccggacatcaagcacggcggctacaccgagcaggaggaccacatcatctgctcgctctacaactcgattggaagcaggtgatgatttaagccggagatgaatatttcttttttctttcactgatcctgttctgagttcttgaactgactctgtttgcgtgcgttgccaggtggtccatcatcgcgtcgaagctccccggccggactgacaacgacgtcaagaactactggaacaccaagctcaagaagaaagccatgggcgccgtgcagccgcgcgccgccgcctcggcgccgagccaatgcacgtcgtcagcgatggcgccggcgctctcgccggcctcctcgtccgtcaccagctcgagcggcgacgcctgcttcgccgccgccgccaccaccaccaccaccatgtacccgccaccgacgacgccgccgcagcagcagttcatccgcttcgacgcaccacccgcggcggcggcggcggcatccccgaccgacctcgcgcccgtgccaccaccggccaccgtcacggcggacggcgacggcggctgggcgtccgacgccttgtccctcgacgacgtgttcctcggcgagctcacggccggcgagccgctgttcccttacgccgagctgttcagcggcttcgccggcgcggcgccggacagcaaggccaccttggagctctcggcgtgctacttcccgaacatggcggagatgtgggcggcctccgaccacgcctacgccaagccacagggtctctgcaacaccctgacataggaggacacgctaaaacctccattgaattcttgcgtagctgcgaacgcaacggcgatcgatcgatgcgtcgccacttgctactagcataattcttgctctcttttttttttcaatttttttctcttcttcgagtggcccattctctagctggcgttttctcgtgtattatgagtgatcgattattacatgtaaattaatccatagatgtatctgcactgatccaaattctccagcgattacgcttgtcagttcgtacgcgatccatccgttggcttggctctccggtacaccggacaagttagcgcgtcccgaaaacgatacgcccctgtctgtctccctctcgccgagccgaagtcacttcacatgtacagtgtcacagtgacaaatctgacgagacgaaatgttaggtgaggcacaagaggttcagaagaacaacgtgtgcgagacatggaccagttctcgtgcggcgcgcacgcacagtgtcatggacttgacccgttccggttttcgagggccaatggggaggagaggcgtgtggacggttttctgtcacgttacacgtaggagtattttttttcctctcattttgtttttgatttttgcccggtggcaagttgatcctgatcgtatggcctagggggcctatgggccgtggatcacatggtaattgggtgtcattgtttatttgggtagtctcacttggggcatggatagtgtctctttgtaaagtgattgaagacttcaagtgcacgacaaggacgagcctagttgaccctggaaatggagggaggatcggtttcgaagaagcttccttgacaattgtcatgctcgtgatgggctctatacatatgatcagaggagacctctagttaaaagtctctctaactaattactccaaaaaaaagtctctctaactttgctcattgtgggtttatcaatgtctaggcaaattaaaaccatcaataataacatgttaacagtacttaccttgttggattttactagcttagtgtacgccagggatccacacattttccaggtcttcgtggtcggcatgagaaaatccggcaaaagccaagtagaacaaggccaaaggatgggaaaaagccagtgcaatcctccactgtagttttatttggaaagtagatgaatatggattttttttataaaaaacaaacttttatttacatttgaaaacaaaccccaaaataacttattttacaaataaaccatttgtggagaaaacaa

SEQ ID NO: 365 - DNA, 7636 bp, Oryza sativa
tcagacaaaaataatttatgttcaaacttctatattagtgttattagcgattttgaaagacgatactagaaaatagattaagaagaaaaaaaatcttaaaatcaacttaaaatataaccttttaaattcaaattttggctaagctcagtaagttaacatgtagacgatgagaggatataaaattttacatggttttactactaagccgttggattgcgatcggacgacgactctcatgcatctggcttgttgagcagtggagaattggagatttttttacaaacattgtactgtgatctgggctgggtggcagccagattggtgggagtagattccatttcaccatgcatcttctcaagaaaattcctagcacagttttgtgctacagcagcagcaaaaaaaataatgcagatgatggctcatccatgcacggccattgtaccagcacagtgtaaagaaataaaaattggcaacaagaggcaaccatctcatctcatctggactcacctagagtatggatcatctcccctgtccatgcatgcatgcatgctgcaagaaaatgcatatacaaacattcagaaaattatatttgatattgatattcatttgcctcccatctccctctccaacagtgccatctctgatcacacccacactgtgaagtgaagtcagtcatctccaagagaagcaaaagcaaatgcaaagccttcacctctcacctcacatccattgctgcatggaccatggcaccaatgcaccatgcacatctccagcatctccatctccatgagtccatgtgcattcaagcttagcagcagcagcagcagcagctgtatgtgtgggtgtggccatggtgctttctttgcattgcattgcattgcaatgcatgcactgtttgctgcagctgctgcagctgcagtgactagtctagctctctccatctctttctttctctgcttctttgtttctttctctgtctataaatacagaggcctctcctttccacccagcccttttcctctcctcctcccgtcttttccaccaccaccaccctcgcgtgccctaatttctcgctgctccttgtcccccacctcctttacttgagcttgctcaccactgcctccatatacagagagtcttctctgtatttctctctctcagtgggaggctcacaagaatctttcagctcacatctcactgtccttgcctttctctagctaggtactactactgctagtactaaccactgctcgtgttcttgggacttcttcttcttcttgttcttgttcttaaaatcatttggggttttgagctccagggaggtccaagaacagagcagcaggatggtgcagtggcgtttctgtaagtgaatcctactaccttcagtttcttgagcagtttcagtagtgtagagcttatgatgtaatgcagcaggtgccatgtgtgttgtgctctgaagaaagctgttctgtgggttgctttgttactatgttttttgtgttcatgtttcttggtctgtatggctctacatgttgggtgtttttggtcagattttgtctctcctatatctgctagtctgtttttctgcaatagatctttctgttagatttcttgtcttgtagggaagttggtagaggatgtgctctcagggtaaggattgattgtcagtttgcttagttctttcttttgattcaccagttgggatttagttagtatggatagataatctgctaggttggggttaaatgttgcctctgatatggtgagtgaaactacttttgtggattttgtatggattgtggttagtgggtgaaatttgtgttcttgattgaaacatctacctagttcttgaatcttcaatggcagcattattgtactgattgttgtatggtccaataatgtatttagggggattctacttactgctagtctgctcccagatatgaagatttgattctgttttttttcctcttcaaatgtttcttttttataattagttgaaatatgctattatccagagtacttttgggggtttatggattgtttcctcctactcaagagaggtaaacaaagtaacttcttcagtacagattttccagagatgccatttcttcttcatcattcctcctttgattacttcatgattgtttttacctgcttctcagcccatatcccttggaacattcacttccatgaaaattaccacctaaggaaaaaaaaacaaaatggtcagtaattgagaacttgctatattagttacctgaaagatagtaacacccagcaacacagatccatgtttcagtatacttgtggtataggagtagtatagtatagtatacccccacactgctttcaatttgtcagtactactactgtggtagtaacatctagccaaggaggatacaacggtccaatccaatcagatcaacaaacaacaacacattgatttctttggcctactaccatgctttcaacattctttcattttgtttcttcttggttaatgcttgaatttctagatgaaatggatggcacaagaccactcttgaggaatcctaagtttcctataaatcccttttataaatacttttttttagaaacaactgttttgtctcaacttaaaaaaaataaaatcaaaagcatattgcttgcaagaattcagaagatgttctaggtgaaattcttgcagattttattgcatttctctctcatgagtccttcattacaattaggtgaaaactaaagaggtgccatattaaatagagtgaatttattgcaaattaaattggttttcgatttgtcaaatttgctcgagacacctaaccaactaacccttattgtccaaatcaaaattccatctcgtgcgcaattagccctggccatagctttaattcgtcattagtaggcaaccagtgggggctccaaatggtcctagaatcatcacttttactttggatttgcttctgcctcttgcacattcccttattttgtagccttcttgagggtattaggtaggtgttttggcagattatctccccattgatcagctcccaattaatgccagatggtgacactgctaaagatggaagacaagcttgcgagaaaacagtggtagccttattatttcctctcacaagaattgtgcccacaacttgtcctgacatctgtgaatttgtctgtatgttgatagtaatagctggatgaatcatgggtgcttaacaatgctcttacttaccaatagtgtttatggtcggttggcccttgcaacctccaaagaaccaattggagcaattcagccttctcttttttttttctctctctgtcattttctgtgctttaactgttatctgaacgagtagttaactgtataatgtcaaaggaataatcttgcacaaatttagtaccaatgttgttgtagaggagcatgtataagctttatctgtggtactgtggtagtaagtaggatgtgtagagtgtgcaggtcacagttatggatcactgaacaaataaattaactcccctgcttttgacaccccaaactgaaacatataaatgctgcaatgaataaagcaactaactttacactatcacagccctagcttctgttctggccagtttcttgctccctccagacggtaatcactttactctgtatcaacatttgcatttaaactggttgtggttgactggttgtttgactagattagcacaactagaaaccatgccaagccattcctgatctgcagtgtgtcgtttctttcttctgaactgaagatttgatcttttctgtttgcaaagttcatgcttacacacttactacacttgaaatctgtaagataagtgctctacattgaactaaaaatacgtaaattttttgtacatgatctgatttctcatgtgcttgttttcctcttagctaatgacttttatcttttctgttgtagaaattagaatccatgctcatttaccattgtaagatgaaatcctacattgagccaaaaatctaactttcttttctttttgtttgtacatgacctcgtcctctatttggatgaagatttcacctttgctactaatagacgagccttgcaaacaggctaaagaaatgatcttttttttttatttgagtaaatttcagaaatctacaactatttgggtcaaaactatcaatttgctacacgtcatactcatgcatacatgccaagttcacacgcacgcacaactggttacagttgcagaacttgcagtttaatgataaaatcgtttgatatagttacaacagttttgcgaaatgttcgccttaatcttatagaaaagcgatacctttgaccaaataactacagctttctgaaatttactcctttatatatattttgcatcacgagaaacaattttaatcacttaggtggatatctactcatttgttgcatgtgaacaaaatgaatatgaaaaaaaaaataaaaagaataattaatacacgtatattcacagatgaatttgttttttttgttataacttgtatatttcatattaatctatctcgttaatttttttatattatttatttgacatgcaataaatggacgaacatccacccgagcgattacaatcctctccaccaacatacaagtttaaattcaacttctataaattgtaacaaaaataacaaatttaactccaataagtatatgcatattcacaaatgaatttattaattttgttataacttgtagaagtcgaatttaaaattgcatgtttgtggggtgatatatttcatattaatctatcttatcaacttttctgaattttttttcaataaacgggcgaacatccaaccgagcgattacaatcctctctcttggtagctaactaaagaagtgatcttcttcttcttcttcttcatcttgcatgacttctcacgacaatggcggcgcgcgggtgcaggagagcagcatgagtactcgcaccaccgagctgggatggtcggcgatggcgaacaccgatgcagccgccgccgatgagggagaggcagcggtggcggcctgaggaagacgccatcctcctcgcctacgtccgccagtatgggccccgggagtggagcctcgtgtcccagcggatgaaccgccccctccaccgcgacgccaagtcctgcctcgagcgctggaagaactacctccgcccggggatcaagaaaggttcgctcaccgacgacgagcagcgcctcgtcatccgcctccaggccaagcacggcaacaagtggaagaagatcgccgccgaggtccccggccggacggcgaagcggctgggcaagtggtgggaggtgttcaaggagaagcagcagcgggagctccgggatcgggatcgccggcgactcccgccgccgctggacggcgacgagcgcggctgcgccggcgggcgatacgactggctcctcgaggacttcgccgacaagctcgtcaacgaccaccaccgccgaatgatggctgccccgatcctcccgccgtggatgtcgtcgtcgccgtcgtcttcttcctcgccgtcggtgacgcttagcctcgcgtcggcggcggtggcgccggcgcctgcggcgccgccgccgacgtggggtggtggtggaggaggggaggtggtggtggcggagttgatggagtgttgcaggtgcttgaaatcttttgctccctacgtttttaaatatttaatactctttgatttttctaaaaaaaaatatttaaccgctcattttattttttaaaaaattaattattaattttgttcctatcatttcattcatttacttatatttattaaatatacttatatgtatactacatatagttttacatatttcacaaaaatttttaataaaacaaatatttaaacatataattaaaaagttaacggcgttaaatgggggatttcttcatctcattcgtcttctttgacccactatcatcgattggatctcctcttttatgtgtcgtcgcttgactcgcatctattgttgcagggagatggaggaagggcagagggcgtgggcggcgcacaggaaggaggcggcgtggaggatgaagagggtggagatgcagctggagacggagagggcgtgccggcggcgggaggcgacggaggagttcgaggcgaagatgagggcgctgagggaggagcaggcagctgcggtggagcgggtggaggcggagtaccgggagaagatggccggcctccgccgcgacgcggaggccaaggagcagaagatggcggagcagtgggcggccaagcacgcccgcctcgccaagttcctcgaccaggtcgccgcctgccgccgctggccgcccgtagagatcaacggcggcggcggcggcggccccggcggcggccggtgagccgccggacggtggcgctgcatgcatgcgtagttggacacctcgctttcttgcttcttcttctcgtgtcctttttacaactgttggaattcacttctctctagaaatatgtaatcttttgagtctcttttgatcattccaagtttcctactagtagctctattgaataataaatggaccaccaaattgcaaaccaaaatggttacaaaagaatatcttgagcagcagtagattgcaatggaaataagtttttttactctgtggttttgtgttgggatagtgcatgggccaaatgagtcgcatcacgatgaaatggttctgtaggatctttgaaacaaaatttctcgcaacaacactatctgcaacgaattcgaataagattcagtggaattgaaccagacgattgtttttaaagcgcctttggaatacaggaattttttggcatagttgaattctcgtgaaattccagcaaactttcttcattccaacgacggtcttatgtttatttttttacatgcacaagcatatcagggagtaataagcaagagaaaataacaacataagttacaaaatccattttctagttttaatataggtcataataaaacgagttacctgctaggcagggaaataaagaatgggacaaaacatcataatctagtatataggagtataatagaacaacttgaacatggtaaggtggtacccatcatcacaaatggtacgatgttaaatgatatcgactgctcattcccaacttgcgtgtggtcatcgcaaaccgtttccttttcagtcaaacaaacacatttacgcgccaacatcactcatgcaattatgcatacatctttcatcagggggggacctaactaaactagaccctacctagatatgaattatactctataatagaattgtagtagaaccctatcaggatatatgacgctacatagaattgtaaatttgaactagcctgagctggctgactgatctccagagaacacacttccactggacagtgccgctgatcctgactgggaagggcccaacccgcggttcctctggatctgcctaagcctgaatatgtcccgcggcattgctcggctctgcactgttgtcgacgtatcatcctcctcttgtgctcgcccccctgcacacaagttgatgattatcaggtcctatagttgatccaattgtatcatatatctgtaggtagatcataaaagtttgtctaggatagcttgaagataagagacggt

SEQ ID NO: 366 - DNA, 5048 bp, Oryza sativa
aacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatatctggacttggtttcatggtttgttaccatagtacgattttggaccatgtcagagcaggtacaattctagattataaaccatcgataatataataaacacatatcgataatataaatgagaagagatgagaagagataagagtagcgagttacagatttatagacagctgcagcgtagactataagacatagtgtgtgtatgacaggtggaatcaggtggtagatgtgacaaatatagtacaatgaatctggacaaacatttgtctagattcattgtattacgatgcttcacatccacccaaaatctcttatattatgggacgaatgaagtatatgtttatagggtactacctccgtcctaaaatataagcaactagttgggtggccaacgcaattacgcggctagcacccaaacaaaattatatattttcttagtatgattttacttaaaatttattaaatagctatatcattgtcttaagactttgaaagactaaaccttatcatcatcgtgtttctaattatatagtttttaaaagtcataccagttgctaccccttgtgtcatcttcttctttatttgcttgctcgatctaccattatttctattcattctttttggaacctttaaaaattggattttatagtttttagagtttattgtcaagttggatttcatttttataatttctaaatgtcccgtcaaacgttgccattatactcctctacggcccgtccactgtctcttctctttattgtcattgagattttaaaaatcgaacataattatcgtttgggttcattttttactttctagaagtccagccaaaccgtcagcagctttgccattgtactcctctacggctcgcccgctgcctcccttctttattgtcattgagattttaaaatcaaacattattatcattgttttttttttatttttttagaagttccaaaccttta

SEQ ID NO: 367 - DNA, 4089 bp, Oryza sativa
ccgaatattaactaatctcgtattgggttcttatatggactcttctctcaatatcccttatttttaattccgaatttaagttattttaaaattgtactcctatttggactctccttttattttctaatttcggtttttattttatttttatttcgaattttggttaatctcgtattgggttcttatatggattcttctttcaatattgcttattttaaattccgaatttcagcaaattttgaattgtatttctacttgtactctccttttctttttctccgattaatgtgggaatttctagtctccacaacgaacgtggtgactcctttcaaagctgttttaataatataataaatttactttgaatatatatatatatatataataaatttattttagaatgaagatagtagacgattgaaatatatatttgtgtggctctcatcttattaccttcatttgcatttacttatgaattctttgccactaattaaattttatataagagttagaattgactttttgaattatttgctactaactttaataacatcaagaattatgaagccatagagagtactatgaacaatatcacggttaacctacttttataatgtgatatcttctatatttttcttttttgaaaaaagataaatagtgaaactttgcaaataaatagtaatccgatgacaaaaaatgcaacgatcaaaggaggtagcaagtacaaacctatgtcaaactgaacttacgactaaatcgcttgcacgctgaaatttcaagttatttaatctcacatggttaaagtgtcaaatgtggtccagtctttggtactcacatcacgccacctactaataactagttaattgtctattgtgcccctagttagctctcgttaatcaattgcattgtagtaatccatccatgcacccaccacccacctctctttctcccgaacagcaagaagatgagccaagcccatggcgtctataaaagagagccctaccccctccatctcaaaaatttcaatccttcctcttccttagcttattagcttccttccttcactagtgccagttttcctcctacctaatctaagctagccaggtcgtcatcttcttccttcagctcacgctgaccaaacaccatctgttattctgtttgtttgtttttttaaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccgtcaagtgccccgtgccaatcatcgccgaggtcaacatctacaagtgcaacccatgggaccttcctggtaactaactaactaatcaccatacatatatatactatccatgtatcaattaaactcgatcaaattaatgccttcaaactgaccaaatttaactttgggctttgaaaatggatatgggatgttgcaggtaaggctttgttcggcgagaacgaatggtacttcttcagcccgagggaccgcaagtaccccaacggcgctcgccccaaccgcgccgccggctcggggtactggaaggccaccggcaccgacaagtccatcctctccactccgaccagcgacaacatcggcgtcaagaaggccctcgtcttctacaagggcaagcctcccaagggcgtcaagaccgactggatcatgcacgagtaccgtctcaccggcacatcagctaacagcaccaccaccacaaagcagcgtagagcgtcatccatgaccatgagggtgagattaattacttaactaatttagttttctcttcgtcgtacgtcttgtttgaaagctacttgttgtttggcataaagaaggagcaacgtgcatgttgctcttagttaactcagtacaaagtcaaatgagttgatgttgattgagcttgttttattcttggtatatattttattttttagaaaagggttaaagtttgcacgcttctaattattgtttactgcatttgtgattgtccatcagctggacgactgggtgctgtgcagaatccacaagaagagcaacgacttcaattcctctgaccaacacgaccaagaacccgaggaatcaaccgtcgaacagcttgaagacatccatgacaacaactcctctgaacaacctccagctccagctgacatgaacaaccaacagtcagatttccagcccatgacggcgatgagcatgagcaagtcatgctccctcaccgatctcctcaacaccatcgactgcgccgcgctctcgcagtttctcctcgacggctcatccgacgccatcgctgagcctcctgctcctcccagccccctaatatacacaacacctcatccaaattaccaaacactaaactataacattaacagcaacagcagcatgccacacgccttcgagtcacgcctagatcatcacgatggttacgttaacaattataatgttaatggcctgaggaggaagagaatgatggcgtgtagtgcaacttcctttgatgatggcagcagcagcaatgactttgtgcatgccgttgtcaagaaaccgcagctgctgccaagtgattcgaggggtagtggttttggaggaggttactgcaaccagcagctttcagagactgcgactggctttcagtttcagaacggcaatctgctgagccatccatttcctctgaacaatcatctgcagatgcagtagtaggcgtctagatcccgtttaccgatcgatctgaagagaggtgaattaatttcaacgaatgaaactacagattcagagaggaagatactgattgttccatttgtgatttattttgaggagttgcatgggcagatagacaaacagacggaattcttgatgtaaccgatgcaaggaaagattcagatttcttcctatggcattaatttgtgagtttttttttgttttcattttcatgtacaagaatgtaaattataaatggtaatatcgtgcaagctagtactcaagccaatttatatgataatctttatgcatgtttcttaattattctggtatcaagcacacgaaagaaacatgctactttgtcgttgattcattggaccttacaaattaaacaatttgttcttgtctgaatgtgctgatatataattggtcttgtactatgcaaaggactagttggtgggctagctagcatttgcatcttcaaagtttcaatccttatccattttgaaaggattagataaactttacagttgaggtcggaatatacctttgcctgctcaagattcctttcgagtagattgagatggctctgatcatcggcgccaaacgagtgccctgcagctaggagtagcttgcataacaccacttgtacatatagtacgctgatcaattgtactttcaaacaacaatactgactaaattcttgctcaatttgtcaaatacttcaggacaaaccagctgcttcatcaactaatctctacgactccaaccaaaatgacaaattaatggtcgtcttgtccacaattcagtactgaggaagaactgtgcttcagattgctagaccaatatccgaaaacgcaatggcgcctacttaattaacacgcgtcatcagcgacctaattaaacaatcaaaacagcattgtttatgtcgttcaaggacaacggaaagacggcggcagagcacgttgctcaacggagtggttgatcaagcgtgcaaatagcatgacatcttcccactagataagcccaaattaaactaagttgattctctccacttgcttaaccacgtctccctattggagacagcgatttgtttattcttctgaccctaacaattcatcgtgtgtcctggtctacctctacggctctagctagctagcaacaaccttcaatctctcccatagattggattaattagtaagcaatcaccaagaaacagctagctaaagcatgatgattaagtcacgctcacacatgcatgttagagaggctgcttataattggtgcttgtgcactagtttaggtgaaggattaggatagg

SEQ ID NO: 368 - DNA, 4084 bp, Oryza sativa
ggcttatctcctgggagattctccttttaagggtttaagtacccctgattctaatcaggttcagggcaaatgattatacgtactactgtacaatccctgcagaaaattacgcacaaagaccaaatatcaaggtttgctatggactgaatatatcttttgtttgcgcctggacgtcggtagctaccccagatattaattaattatttgaattagtgattttgtaccaaatgatcgaaccagctcatgcttagcatgaagctaataaattctcccgtttattgcagtactcgaatacaaatagtaggtgtactactcgccatggagtctgctctaattcgttctcaaaagcttctggagacgaaggattggtttggtcgctttctcggttgctgctcggctcgcgtgtcgcatatgacgctttacttaatgctgctagtagtactcataatttccattaattaagactcatttaattagtaatgcaccaaatccttaaatccagccagatcagatcaaagtcatcctagggtaaaacactctgatctgatggatcactagccactaaattaatccggtgattgatcatgtgtggaagcaagttttggctcgttacaaggtactattacataacactacgctgtcctgtatagctatctcatctatctcttcccatgcatttttcacctactagctagtactccatccgttttaaaatgtttgacaccgttgactttttagcacatgtttgaccgttcgtcttattcaaaaatttttgtgaaatatgtaaaactatatgtgtacatgaaagtatatttaacaataaatcgaatgatatgaaaagaataaataactacttaaattttttgaataagacgaatggttaaacacgtactaaaaagtcaacggtgtcaaacattttgaaatggagggagtagtaacctgtgatgagtttccttcatcacccacgtctctttctactaaaaagaccatcatgtagctcgcctctagtatttaaggggcaccaccacccctcccactttatttcctctatacaacgatttcctcttgtcaccctgaatctacttctgctgcaaaaggtaattagcatatcctaactatttatcacctcatccctcaagtgtgttcttctactttcttagatgtactttttaaacttttctgtgcataaacatctcatgtgctgattctttttgtgtgttctatgtgcttgcataccatgtccgtttggttcgattcgattttttaagcatccgtgtggtttgtttttgttctagcttagctagctagctagcaaagaggtgtcatggatacataccagctttaatttgatttggtttgctctacctttaaaagtgtgtgaatcatctccggtcctagtttatgcatatctgtgtgcatatgtacaaatgtttcaggacaggagttggcataacagctaacaaatcttacatatatagcagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatgtaagcaacctctcctctacttaattacctctgcaatctgcatgcagtgatgaactgatgattgatatatacatggatcattggattggctagctagctaacatctgttgatgctgcgatggaattattggcagctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaaggtacacgaacgcacgtacgccgcgtgcgtgtgtttggttgtgaccagtttgatcgatcgatcgatcgatcgattgagcaggccggactgacacgccgtgggtttttcttgttggtgcgtagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagagttgcttaatttagctctttctaaaaagctagcagagactaatagctaactgtgatctcatcctgaacctaaaagtttgacctgctgtgtgatatagtagctggtaccatcagctatagctaatctagcatttaaagcatgattcggtttggtccatgactagcacatctcaaccatcgtacacaaagctctaatccccaattagtgatcagctagtagctccattgtccttgggcgatcacatcacatcgcaacccttacacagtgcacatgacacaacagtggcccccggctagctatctatgcagcttagcttaggttggcacacacaagaacacacaacgccctacatgtcaccaatttggttcccatgccttgtctctacgcaggcatggggcccctaatgatatgagcaagcacttgtcatatgaatgtgtgggacccaccctgattgatggtggcttctccatagagctagcccatatgttgttttcaatcaaaatcctgagaaattaaatataattatatgtggcagctaacaggggccagttaggtcaactaatcaaagctcctgcattttgcctccctgccatgagctagcaaatgctgcaaggacaactgtgctgcttctagtagatctcttatgcctactagtcctgaattatagagaaaaaaaactcttctgctgtaacccaaaaaaaaaaaccatgtagggcagctcgcatagattttatatgagtacgatctccttttgtttagtgtgtctcgtatctttggacatcatctccctcgggaattctattccatcctgccaattaaagatgtcagcaaagacaactgtccatttgataaagctttgtacttccaacgcaatatccattgtgctcgatcaaattaaatcagtgtgcatatgtctattgtactcgtacaatggattgttgcatccgcttagtttattggacattttaatggagtgtactagagatattactcc

SEQ ID NO: 369 - DNA, 4545 bp, Oryza sativa
gtccagcaaggtcacatgcatgcgtggatgaatctagccgtgaaacatggctgcgaatatgcgataggtgctgcaaaaattgtgcatggtgctgcccatgtgaaacatggagatgcgaatctcctgtcaggaaaatgaaatcccgtcaaattgtttgaatgtgaaaaaagcttttaaagtaacctcgaactgtgtaattagagaaaaaaacatagtagatgctggtcgtatcatccgttctctctccgagcagtattgtatcacccgtaaataaagtacggaatatgtttaatactagctttcgtagagaaaatttctccgtcacagtttcgtcaagacattttaaagaattattctacctgctggccaccttgccataaacgaaagttgaccaaactttgagtatatattcataaacaaatcaccaccataattaaatcaacggaatcacaactaatcaatgctagtgagatcagcgagccgtaaacctatatacaacaaacagatccacggctcggaatctccatggcctgtatttaccaccaagactccgggacccagcaagtgggccccaccacatgacatccccgaacccccggtcccacctgcatgcatgacatccccaaggcccgggcccaccacatgacacatccaaagccacgtgggccccacctgccaggtgcgcgccctacatattttgacggctcagatgcggcccaggcccacgccaaaacagctgacgtcatccatgacaaaatacaaccccacgcccccctaccccacatccgaccgcccacacgtcccccctgccccctcccgatgcgcgacacgtgtcaaacccctcctctccggtcaaccgcacctcaccgggctgccgcgcggcccagcccagcaacttgcacgtgcgtcacggcgacgcctcctaccccaaccagtcgacacgtgtcccccctcgcgccctctatatataggcccccccacggcggggtaatgttccattccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccggtaagcaagagcaaaagcagatcgaatcgaatcgaggaaattgaagtcgaattcaaattcaattaattggggatttggaattgttgcagagagggcgatgggaggggagaaggagtggtacttcttctcgccgcgggaccggaagtacccgaacgggcagcggccgaacagggcggcggggacggggtactggaaggcgacgggggcggacaagccggtggggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcagggttagtatttacttcttttaattacttacttctcctaatctaatcatctcttgctttcaatcatttctcctcaccaacgaatttacccccattttattttttaaaattctacaaggaaaaaaaacagaaaagaaattgccgtatactgtatttgttcatatagtggtctcaatctagagagctctaggaagatatgggcaaatcaatcatcagtagaggtttgataaaatgatttttatttaaaatttgagaaaagaatttgaaaggtgtgccaaattggcaagttgcagcacgcctgagttgtcgctttcgtagcatggctgtagccgctaggtataggctcggatggcgtcatggctcacgcacgcgcagatagagacaagcccgcgcccaacctttatcgaatttaacgtcacctcggaaaacgtaatcacaccgaatttatttaccaaaaactttttaccaccaccactcgcatgcattccacatcaatcttgatcactttgctaataatttcagttttttttttggttaatttttttttgcagttggatgattgggtgttgtgccgaatctacaacaagaagggagtgatcgagaggtacgacacggtggacgccggcgaggacgtgaagccggcggcggcggcggcggcggcgaagggtggtcgcatcggcggcggcggcggcgcggcggcgatgaaggtggagctctccgactatgggttctacgaccaggagccggagtcggagatgctgtgcttcgaccggtcggggtcggcggaccgcgactcgatgccgcggctgcacaccgactccagcgggtcggagcacgtgctgtcgccgtcgccgtcgccggacgacttccccggcggcggcgaccacgactacgccgagagccagcccagcggcggatgcggcgggtggcccggcgtcgactgggccgccgtcggcgacgatggcttcgtcatcgacagctccctcttcgagctgccctcgccggcggcgttctcccgcgccgccggcgacggcgccgccttcggcgacatgttcacgtacctgcagaagccgttctaattaacggaacgtgacgcctctgcaaacgctaattagctcactaaccactgtcaggtcgatcgtgtaattcttttaccagtctagggtacagccaaaaaaccaaaaattaaccgtgctcgatcgatcgatcgatccatggatcgatgatcgcctccaccggcagatcaaaatcgaagcaaaaaatcagggagaattcttggtacttccagtacctctcgtcgacaccacgtgtcgggttttctgcaccgcggatcctcgctggccgcatcgtaacggcgagcgaggttaaaaatagtggagaattcaagaacacatccctgatttttgtttctgccggatggggagtaccgtgagcatggtagaaatgactggtaaaattttcgttgatgataggtagccagagtcgatgtaaccagtcgattttttttttttttggttttagttgacatgccttcctgatagattcagaacaaacaatagagaagagaggagaaaaaaacacagaggagaaattcagagaccaaagttcaaagttttggaattttcaggggcgccagcagctgatggtattgtcagtcgtgtctaggttcgtagaggaaattaaaatgtagaagaacgggtacttcagttcacttcaggttcgttcgtgccaaacaggtctctgacactttagttaggttttgatttttttttctctttttttctggttttttgtcgtttggtaatgtaatgtaagggtgattgcgacatggtatttatgtgattagagtcgctttcagttgggtctctcgcgtgacctggaaagccaaattttgtaatgcaattatcggtaataataataataataataataataataataataataataataataataataacagtgctgtaacttgtaattataatactgtttcgatctctctagccctctcaccaacttgggtgtaattattcattgagattacaggggttggctggcacaagtacaagctggaaaacgaaaggtgagctgcatctttgcaagtgtgatgtgccatactgccatggcaaagatatatattgcaagtgttattacaaaaaaacagataagatttggccatgctgatggttgcctgcacgagcatggcaaatggtagttattaattaatagctagttttgttgcttactttttgcctttctggtaatttgggattatgtgttaaatctgttggtgctggatccatttatgcagctgttgggatatgtcatgcatgctactattgaaccatattgatataaaaagggcgtcatcggccatgactttgtgtttattttttctgaaaaagaagtggtgtggtgacagttgtttttcttatgggtgtcatcaagtgtcaaaagtcataactctgtgccaataacacaattatctgtaagtagtagcttctttcggtagtatgtatgtgacagaaacttgctatggcaaacagccaatcaaatcaataatgttaaaatgcaaatgtagattgtagagataattcaattgttgcagtctgatcaactgatcacaacccattgattcggtagtgtagtatattacttttactgttcagcattgctgtctatgacagaactgaaaaaaactttagcaatataaactctggacctagaaatactactagttcaggaagtcagatactccctctatttctaaatatttgacaccgttgactttttagcacatgtttgatcgttcgtcttattcaaaaaacttttgtgaaatatgtaaaactatgtctacataaaaatatatttaacaataaatcaaatgatagaaaaagaa

SEQ ID NO: 370 - DNA, 4561 bp, Oryza sativa
ttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaacaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggttctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgcggtcaaacggtcagcgcggggcgggggctcgcatcgcatctgctccacgtgtgcgctatcgcggctgcggccgcacgggccacacgtgtcgcttgcccccggctctataaatgcccggctcctcacccggaacaagtttcaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccgtacgataatcctcctcctccatcctcccaatcatcaccaccatcaacgccgtcgtgaattgattgattgatttggtttgatttgttggtgttgtgtagggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcagggtaagcaaaaaccacacccaagattccatcactaaattcattactaaatctgtgttcatcgtgattattgattaatttagtcacctaattattcgcccaaaaccgcagctcgattcgaacagctggtggtacttctagatggatactactatttagatatttgatatatttattttgcaacttgtttaatcagctcatttcgctttcgaaatgaattgggaggataagcttagcgtggcccacggctttgggccgcagaaattaattggagacgttggctcatctcatctctagggccgcacctacgtggtgcaacttgcgcagccacgatcgaatcgttcgagcgtgaaacccattgccgtcaccacctcgcctcatccctttcagggaccaatcggtttttagccctacgcgcccctgcgatcgcgacgcccacgatagctaaatcccgaaagcaaataagcagtaatcggacagcgactcgaccgggattagttaaacaatggcttgattaattagatgctggaatttggagccttctgataagtttagggcctgtttggcacagctccagctccagcttcaccccttctggagctggagctcagccaaacagtttcggctccaccaaaacggggagtggagctgggtggagctctctcacaaaatgaactagagttgtggagttgggtttaggcagctccacaactccactccagactcaactcctggagttaaatttaggagttggagctgtaccaaacaggcccttagttttgcacttggtactttaatttttttttgagtgagtgtaaatttgtttctaaactttgtttatgaatttgttttgtattggtgcagttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgtagatatctttttttttttggtagatgctgatgtctgtttgttagcaatggaaaataaaatgatggaaccatgcgaggaaaaagcgtggaattaatacaacagacgcatttattttccaaccgagctgcacatcactacagctggagatgatcgatcagatgagcgaccaagcaaaataagcttgggcgcgaaggaaatcaaacgtgccgctctgggcggagtgaggaaaaaacgtgaggaattggagtgcgcgcgtagacgacatatgggagagacgggtggatatgcacgcattgaacgatgagtggtcggtcggttcaatgcgcacgtgtggggggcggacgtagttttgtctttgagggttcatggggcggtgcggttgacgacgttctacatgcggcctcgtgcttatcgcctccggttagccggcgtgttcccattcctgttctccaggatatgctcctgctatactctctccgtcccataatataacaatctagcctgattagacattttataatctcgtctcataatataacaacctaagactagattagatattttataatacgatgaatgaacgaaatgtctcgtccggtcctagatggctatattataggacggaggggtaagtatattgcacattagcacatataaatcaagtcatattaggcagattttattccgaagatttactccctctattttatattataagtcgtttgacttttttttcttagttaaatttatttaaatccgatgaaatttgttggagtaattttcatctgactggacctaactcctgtagaactgagcagcaaagcaaatagcgcaatggatttatccaggagtagtgaagctagccatggttttcaaaaaaagaagctagccatactagctcatctcgtctaatctaatccatcctgccatcgacgcttttcctcctgtactcctgtgcacagccacggtcccggacaaaactgctgactgctgcttccagagataagatccatccacccgtt

SEQ ID NO: 371 - DNA, 4484 bp, Oryza sativa
tcattcataaaactgcaccaaaataaaggtgtgaaaacaaataagaaattacattcttgacacttccaaaatgcccttaattaatcctaagaaacagcaagagaaatgattttttagttgcttgtctataattcgatcttaaaatcttgcagtgagagtttacatgtatgggctaatattcattaacaagtatgaactaataaaagaaacacatactactatagaaatagtcatcactattgattcaccacagcggtactatttgttggttcctggcatgaacccacaatgtgataagatacccgcaatcacagccatgtcctaagttaaaaacaactttgataaggtaattaattatagacgtgttgtaatcacgtcgtttttcaactagggatgcgctggtcatcttttcggtttgtgaccgtgctctattgtatcttagcaccttggtaccaattaagattttcttttcagcaactgtgttcctgttcactgtaaccaaacttcttttcaatctttaacaaatcttggccggtttctcggtgaaaaaaaaagaaaatatagacacgagttcgattccatggcgcacatattccgaggtgatatcctcttcggacgatgcaaaacggccgcatgtagggatccagtccgttggatatgccaactggcgaaattcatcccccacgcgaaaccccccaaatttaaccccaaaccgcctccacatacatcggccgccaccgcaccacgcggtccacgccaccaacacgtacacgtggcgcggccacggagttccaccggccgacgtcaggcgcgcctgacccgggggggcccacccccgcgcgcccaatctccggcgctatcacgccgggcgcgagggataacggaccaaacccaccccccgcgctccccatcctgcccccgcgaagcgccggaaaccacagaaaagccgcgcgggtggcatggcatcgcggccacgcatcatcaccctcaccaccattcaccgccaacgcaagcggacaaaaaatctgcgcgcataaaaggagcccctcccctcccgtccccaaaaattcgagccctcctccatctctcgcctcctcttgatacaagctcgaccctgatagatctcatagatcatagctgagaggggatcgagtggcttgatcttggaagtgagcagctatagctagataggttttgcttgtgcagggaggtgtgtgttgtgtgtgggtgactgccggagacgatggttctgtcgaacccggcgatgctgccgccggggttccggttccacccgacggacgaggagctgatcgtgcactacctccgcaaccgggccgcctcctcgccgtgccccgtctccatcatcgccgacgtcgacatctacaagttcgatccgtgggacctcccatgttagtacccaccctcacagctcgccgcgatcgatcgatcactgatttgcaattaatttcgttggtgatcgacttgtgttttgatttgcatcagccaaggagaattacggggacagggagtggtacttcttcagcccgagggaccgcaagtacccgaacgggatccggccgaaccgcgccgcgggctccggctactggaaggccaccggcaccgacaagcccatccacagcagcggcggcgcggcgaccaacgagagcgtcggcgtcaagaaggcgctcgtcttctacaagggccgcccgcccaagggcaccaagaccaactggatcatgcacgagtaccgcctcgccgccgcagacgcccacgccgccaacacctaccgccccatgaagttccgcaacacctccatgagggtaagcaagctccatctacgttacctagcagccagattcaaattatctaaaccaaacaacttaattatgaacaaaccctagcagctggatcttgctatcgatggagtagagagtagatcgtctattattcatctctgtctgatgtgctagtgcacttgcacagttgcacaccgtggtttttttgggtggttgtttctgatgatcgatacgtgttcgtcggcacgtcagtattatcgcatcggtttgtgccttgccaatggacgcaactcgctgcttttagtgtgtctgttttaaagagggtgttctttaggcaatacttggcatggttgcgcaagtcaatagatccgacaatgatagccacgatgcgtacgtgttgatgactggttcatctctgcatatgcgcgcatgcataccccctgaaattaatcccttctatttttgatactcttaatttcttaatcatatagtatatgcatccgtgtgattgatcgatcgatgtgcgtggatttttgtgcagctggatgactgggtgctgtgccggatctacaagaagagcagccacgcgtcgccgctggccgtgccgccgctctccgaccacgagcaggacgagccgtgcgccctggaggagaacgcgccgctgtacgcgccgtcgtcgtcgagcgccgcatccatgatcttgcagggcgctgccgccggcgccttcccgtcgctgcacgccgccgccgccgctacgcagaggacggcgatgcagaagatcccttccatttccgacctgctcaacgagtactcgctgtcgcagctcttcgacgacggcggcgccgccgccgccgcccccctgcaggagatggcgaggcagcccgaccaccaccaccaccaacaacaacaacacgccctctttggccaccccgtcatgaaccatttcatcgcgaacaacagcatggttcagctcgcgcacctggacccgtcctcctctgcggccgcctcgacgtcggcaggcgccgtcgtcgagccgccggccgtcaccgggaagcgcaagagatcatcggacggaggcgagccgacgatccaggcgctgcctcctgctgccgcggcggccaagaagccgaacggttcatgcgttggtgcaactttccaaataggcagcgccttgcagggatcgtcactgggactgagccaccagatgctgctccactctaacatggggatgaactgatagctcgttcttcgtacataataccacagcctgattaaacactgaacataattgcacatggcgaattgatgatttgaacagtgaggtctatttcgaaagcaaataggtccaaaacgatagatttaaatagtaaatatattgggaaagaaattgtacttaatttgtacttgtgtggactagctaggtcgtccgatcatgcatagctatatagtttgtggtgtgtatacattttttctcatggtactatactactgtgtactcaagctagctcagtactaaagattaattaagctagataggggttgataagactttgagatagacccactagaagtctggaacatgagatcaaggagaatgatgtcaagatcataaagccggatttatagctcatattcatgtaaatcaatcaataagtgattctttaatggcagccactcatttttttcaagtttgtactgttaattaatgttaatttggtgggggtgatcactaattaatcaccacagctaccacctgctccaagaatagaattacttcattcagaagaaggggaaatactaacaaacggttggaataaattaaagaaaatgtttttctttgagagataaagaaaaggatatggaacatggatattcaataattggctaaagataggcaagttgtggatggtacgtagttttcagttcaggtggtggattagccttttcctgctcaagctttcttcatattggtgaagaggctttgtccatgtagagaatctcttgtcaagccaaagcatcggaatatcgccatacacatcaacaagccaaaagaacatcagtgtcacagaagaaacaaaaaccagtacgttttggcggctgcgagtgagattgacactttaaatttcagtgcagctcacctggaaccatagatcatggtctacttttctccatcacaggtgaagaaataattacatttatcatagtggattatattctactccagaatcaagactatactaattctagcatcggaagagtcaaatcagcggaatggggccgtttatcttaattagctggattgttgaactgtgtattgaagatgactagtatagtactattcgaactgttttgaaaggaataattaactatttgccactcttacgagtggttctaaaggatttgtcacggaacccagacacatgagaacccatatattatagacagtgagtggcaaattattaattgacacatcttaaaagtgacaaataattaaatatcccgttttgaaatgcaaagtgactgttctgcagaagaataaatatgaccttgtaaactgtactgcttgacataggcctggtttagttcccaactttttcttcaaattttcaacttttccatcacatcaaaattttcctacacaaaaacttccaacttttccaccatatcgttccaatttcaatcaaactt

SEQ ID NO: 372 - DNA, 8525 bp, Oryza sativa
ggatggcaattgttgattaagtatgcaaccataaggggtgtaaggaaagtcaatcattgtgcagctatggtttattgggcatttggatggagaggcatcttttttctcttctaatgaagtgaacattgaagaaaagtatgttattcttcgctccaagtatcaatgcatatacttgtaaaataagcatcacatcacatgtatatacatgtaccatgccaagaaggtaagcatcaccgtttagcgatgattcgaggaccagcatagtgtagaagagcggtgtacatcttaccttaatttatagaagaatggtatctcccgatgaataaaaccatatagaacacggctatatcaaaaactcataccatattaaccttattgatttcaaccagagagaaacgggactaggaaaaacaatctaaaacgactaataacatgttgtacatggtagaggcgagatcaatcaaggagtcgatagtggtgtatgaagcacgtatacattcatttctgtttgaaacaagggtgcgtacaccctgtgatcacaaatatttgtgctctatgataaatctggttattttttattgcttggcctatcaataatcgggataacttttagtttgaaaacataaaacaatataaatagatttatctcgaaaaagtacttttattgaaaaaattcaaacatcttagtactaaattcaatcgagcaaacttatgacaacaaatcattgaccatatgctagaggttgtaacaatatgaacaatcccactaaacgaggactcttcgacattgcatagaaattattaattttatgttcagctaaccttaaaaagactactcctaatataattttcataaacgaacgaggtatatagcgactcgaaatgaggacaaatcaggtccattttttcacccccatgcaggaggaaaatgagaggcaggggtattttcggcacttcacaactcgagaataaacaaatcttgaaaaatgtgacaagatggccgctgctctgctctgctcctgctcatcatcttcttcttctccgctctccctaatccaaaaaaaggcggctgctttggtcgctcgctcgctcgcgcggacgttggaggagaagcagctaccgggatggacgccatggccgtgctcgcgaggacctcccgccccgccccgaccctcctcgccgcgacctcccccgcggtgtcccggcgcccggcggccgtctccttcgccgccgccgcctccccggggtcccgcggccgcgtcgcgctgagcgccgcgtggggcgggagggcggccagggggcgcgtctccgccgccggccgcatcgtcgcgtcgtcggttggtcacctctcgaattaatccccttgtttttacctactcgcgtttggtccaaattgcaggaaaagattagttccttttttgtgggttgagaggggcaatttggtttggttgtgatgttggtttcagacttttactctactgttgtattggcccgagtcgtattttttttgatagattggggaagaaaaagacatgctactagctgagcacagatgaagataatcgtttttttggctccctattgattgcaaaaactgaacagataattcactgaaatgtcccacatattcatacgttgctttggccagtctgaatttccttttttgttgagaagagtcagtctaaaattttagtacccgtttctggaatattctatggttattgacataagttattggaaaaaaaggaagcgaacttgaactgaaagtaagaattttgccttgctgctgtcagcggcagacagtactgatgaaaatatggcacttaggcatgctacattgtgttgattgccaagtaggagttgcttttgtaccgtgatgcgcatatggaaatggtcatggcaattattttggatgctctgataaccatctaatttgctgcctagttcgtgcagtacaattgaagatgtttgctatatatgtcattatgtagaatttttgtgcccatcagaattccaaaatttggtcttcattttttttactctttttgttaataaatgcaatgatctctgtggttctactgtgagattgtttgaattattcaacaacgtgtttcaaattccagtacttgaacaggtccaagtttccttaggcaatctcattttgcgatgcagcatgacagttgttgcaacttgcaatgtcttaaatacacagtgaaggggtactgtagaacaatctaaatctgtttatgcatagttgagaaaattgagttatgttgaagggatgccaaatttattcttgtagtttttcattattcccctcaagcataaagccattttctgtttgctaatctcagtaacgtgttagtgcatcaatgttggttttattaatcttacgcatttaatccctgaaatcaaagatgcagatcagcagaacttgtagaactgtttcattttttatgtccacttattcttttcatggcacgatatatgcctatatctgagaggtattacggatgctgtttgacttagcttaagtatggaacctgagttcgtcgcttctattttcacagaataagtgtggatctgtctatttatgaaactaggaaggtagcccgcgcatttgcgcgggcatgtttttatttcgtttcgaaaacatgtctaacaaaataagtttaaattaaagtgaggtgtttcccttcttaattgaatgttcattgtattttttctttaaaaatcttgagaaactttaattgctcataaatatatattttttactaacctgctatcacctttttaaattgaccaaatatacatatgtaagatagtgattcttatgcgtaggatcctacagtatttttaagaaaaataccaagttaatatgagtcttaaaataaaaattagtaggaaatttctaatcatatcgttatacgaaatgcttattgattttgtattgacaccttagaggcatttacatgcaggtcgtggaatttagtgtattcgtttaattatcattgaccttcatctcctgatgtgtcaaagtgaaatatgacttgtatgtagagaagaaaaaaagtttaaaagaataaaatatcgttaggatgtaaaatgaacttttttttcctctgtaaccaatggaatagattgattcaatactacttttgcgggttaagtgctccactaaaatagttcactgtgtaaaagcttcaactctaccttctgggttaagtactccactaaagtagttatatgtaaacacattacaaaagttatttctaaaggtagcccatgagtccgaggcaaaaggctcatcacataggaggctgcacatttgaggaacatgagaacaatattctcgcggaaatcatttgtttagaatgtgatgaacataattgtatattcaattaaaaacgttagaaaagtggcttaaagttgtcatttcacattgattggttatgaaaataatggtatatataaatctttgtgccgatatcattgtttgccaacaatcaacgaacttgatagttacttttggtgttccttttggtatgtagcaaattggctacatattttacaacttactgtatcctttgctgagatgcacttgcttttttttctctgtatacttgattgtctcattgtttattaatggatgccttcggtccacgtgacacaatatatatttcaaataaaaagccttctcgagtctaaattgattttgcagcgtaggagatagtttattgtttcgtgtagagtgtgtgagactccatgtagcttagcaggaacataattttcattgcgaaaaataactccgcatgtgtgattattatgtagtgtggtatgattgttgtcatgatttaaatatttttactctaaaatttatgattaaacattaggattttacataatgcaaacaatcactttgtgattttatcttagctaacatgcattaggcctttagtgattatgtttatattgcataatcctaaatatgaagcctacaatgcttatcctattttatctttgttgtttgaaagaattagccatttatacaaccatggtagtttaaatactaaatagtttttaacttttaagtttctaaaataattggtagataaagcttttagctcggtcatgcatgatacatacatgtagtcccaagctaatttgccccctcacgctgacagtgtcctgagtaatgtcgatgggggcaaaattgtgaccgatcaaagtcttaatttttttcagttcaagaaaaaaaaatgaatctcaattttttagactactatccaatgtcttgtactctatatgtacgaacgaagctataaccgatctcttttcctttgcgttagatcaatgtatatggcccacaccattaatttatatatatctaatggttaaaattaataggtccaccgatttgaatgaaaaccgatggtaagatatttttcttttttttagaatttataggattttacctaatttattatagcgtaaagtgatgatttaggagcatttgtagaatatgcatgtggtggcttgataatgtttattggaagtataatggacttttagtatttttttaagtttcagaaagaaaaatgaatctcgattttttagactactatataatgttttcttcttccgtaagtgtacgaacgaagctataaccattctcatatcctttacattagatcgatgtacgcatggtccacaccattatattattttatatagatctaatggttaaaattaattggtctaacattttaaatgaaaatcaatgctaaagatatttttctttttttcttagaatttgtaggaatttttctaatttattaaagagtcatgtggcaatttataagcgtttatagtatataatataatataagacacgtataattatattattttgacttaccggggagtaatttattttctaatttaattattgtgtaattatgtttgatgataaaatctatatcgttattttttcataatattttggaattatttaaatggcacgtaaaagtcagaaattgtaaccaaaacatgacattctttttgaaagattaaatataagcagtttagatgttatatttgtttaattgtcaattgtgctcacctattgtgctttctacctaatattgcataagaataggaataagaaataagagagggaacagaggaggaagagaggaggcatacgggtccaagtacgtacgtatacctactacgactccacgtaggtacaatactgatagggattggaggattattttttctttatagattgatctaatggttaaaaatatcgggtccaccagattaaatgaaaatcaacggttgggtgttgtctttttttttagaattttaagaatttctataatttatcatagtgccaagtggcagcttgggagcgtttgtagggtacacgtggcagtttgggagcatttgtaggaagtttaatggacttttattatataatagatgtcagacatttctgattacctcaatattctgttatttcagttagaagttgagaactctccacttaggtgatctcttcctgatcaaccataagattaaatctattttttctgtaggttgagcaatcctatattatgatcaagcctgatggtgttcagcgaggcctggtatatcattttacttacttttctaactttagattccattacttttttttgacgtaatatattccattactgaatactgtagttccattatagtttctttcagctcagataaacactcctgtcgattcgttcatataggttggcgagattatttcccgtttcgagaagaaaggctttgtgttgaagggcttaaagctttttcagtgccccaaggacttggcacaggtttgcctcttaatatccaccgttttcttcaaaagtaaagtgttttcttccaccatctggggactcaccatttaatcatcgttggagagcaatggtgccatttcaaaatataccatggttgcgtggcatgacaaaatatcatgcccagtttattttcttggtagtgggcaatttgccaagacttgaatggacttatttgaggagatcacagttttattgttgtgaatggaaatttcacaatcgaataaatgataaatagcatgtctgtctggtatgttatttcaggacagccttgatcatccaaagtactcattctttgctgactgctgagatagttctttcgagtcactttttcttgtattcagccaacgaaaagtgatccattaaatatccaagcagctggagaaaattttgtagaaatgccatcgaaatttgtggttaaacctggtttctgctcaccgtcagagcatacagtattatctttgttttcacataggaagggaatcaccaggagtatattatgtttaatcaacgagctgctaattctctcttatgtgcacaggagcactacaaggatttgaaggaaaaacctttctttcccggtctgatcgagtacataacttctggccctgttgtttgcatggtatatatatttgtaaagaaccaaacatatttgtaactctgcactttgatcagtaaactgttttcaattaaatttattgttgttctgttctgtaaggcttgggaggggaatggtgttgttgcatcagctcgcaagttaataggagctactaatccccttcaagctgaaccagggaccatacggggcgatcttgcagttcaaacaggaaggttggaatcaaacaacctttcatgttttaacattattatatctaccacatctttcacattttagcggatatctctgcatatatatctctgtcaaagaaattaaatttcttatggactctgctttccaggaatgttgtccatggaagtgacagtcctgataacggcaagcgtgaaatcggtaagttctactccttttcccagtagtcatggtataacaatataaggtgcatagaatcatgagttttaagtactacgaagaatgaagtagttgacacagtgattaggatcatgttttttttttttaaaaataataattcagcagcactatgtgcttagagacgtgcatgtttgttagcttggacttaactttattgtgacctgctattttgttctttacaaacagatgataaactcattacacattttctgtctgtagctctatggttcaaagaaggcgaactctgcgaatgggaatctgttctgacaccatggcttgtagagtaatgctcccagatcagtgcaagaactggatgcagtgcttgttcttgatttgaggggttatgtatgagttcagatcagcagagtaaagtagcttataccaaagctcggccttctcatgactgtacaccctgacattccccttttttgtaatacccaacattcccttttttgcgtttgaccgattactctctgttgtcaaatctcctggcatgtctgtaattggttcagaacaataccagcaaagctccaacttccaagtcattatgcagatgaatgcgttcaaaattatctcaggcagttgaccgatgactgattgtcactgttgtactatagctcccagcagaggtgaactcgtgcagagttgcagagttcatttggctgatgagccatatcttgatcagcagttatgaaattgtcaccgtattggtgttcaacccacaaatgaggaggctaagggatactcgtttgatcttttttggtgcttgcatttcttgagataatgttttactgcttgatatttcatcccagaagctctcatttgtacctcagcctctcaacacctgaaagtctggacactgaaggcattgataattttcttacttcatagccgaaaataaataaaatctcaaaatcaagactataggtgaaaaaccagctaagtgcttgtgtttgagattagccataaagcatattggctcaacatgcgaaattaaatctggagcgttgggcacactcaggtaattgtggggacttgggccgtgccggtctagcacggcatggcccatcgtgcttcgtgccggcccaagcacggcccaatggcacgcagtgatatttgggcgagcccgggttcccttcttcctcgctactctactcggcgaggcgttacgagcccttcctcactagtcactcctcagcgacgttaaggagacccgacaacttcttcgtcaaatcttgatactgggatgaaaacggtaacggaaattcttagctgaccgatgttcgtttccgactttctaccggccaagccatatgaaaatggtaatcgattggaacgaaaatgaaaatggtaaaatttttaaatgtgtcagttgctgattttttttatttcatctaccttataattcaccaactcattttactcatctttctctcctacactcttacattcatcactcaacggttcagatcacctctgtgaaatccaatgctcaggatcgtctccacctcccacgcgcgtcaaacgcccgagaatacggtcgccatcccgcaatccgccaatccgcccctctccca

SEQ ID NO: 373 - DNA, 5742 bp, Oryza sativa
accgagacggctcggcacgcggccggggaagcggcgacgcaccaccggggacccaccgccaatgacgacgaggcacgacatggtatggggcggtgcaaaggtggaacagcgtcggtgcccgaaggtgttcgacgcctgattcttggcattcgggatgcgacgttgagagcgagattctggcgacagtgacgacggtgcggtggagcaaggccgggtggagctcgaggccgacgaggaagaggaagaacgtcgccgctgtgctcgtgtgctcggtgctgccgcttgccgtcgcgccgtgcgccgggtggccgctgcatctcatcgtcattggcggtgggtccccggcggtgcaccgccgcttccttggccgcgcgtcgagccgtcccggttcgagccgttgcgccgaccgtgtgttgtgccgctgctcacctgcggcgggaggaagaagaagaaaggagaaagaaaagaaaaggaggaagagagatggagagctgacatgtgggcccaagggcatttttagcatttcacgcgatttctctctccttctcaactgaaaatcattattttaatcggcacagtgtccattggcaaattaccacgttatggagtgtttttccctaaaagtgagtttaggcagtgtcccacggctaaaaccacacaatagcagtgtcctatagcaaaatttgccttattgatatgattcgacgaaattgatcctccaaagcaaactaagtcataatatatttttcttcaaggtccttttctctccctatttctcagggatcattctgtaatttctctatggctgtgtttggaaaatgggttaggagaggtaggattggaaatggaaatgaatgaagggataggataaaatagggtccctttgaagggtgggaaatcatatcccaaacccattttccaaacataatctatgtgaggaggtcttttctgtaagatacctcatattccaaactgacggcgtcatcgctgtcaaacggagaccgtcaatttcgaaccgggcgggatcgagaagattccagaaccagaagcacatccgcctcaaacacgacaaaccccccctaccctgttcatcttcgagagattcctcccaatcccgagcagaatcccccgccccggcgaatccgcgcggcgctcgaggtaatccaatccctcctcttcctccgccctccccctccctcgccgcgtcggctcgccggacggacggtgggttctccatggtgtcggctttctttgtgggctctgccgatttccgcgttcctgaggccgcgtagaatctgcataggagttgtttgggtagatttagttggcggaatcccccgcggtgtgtggaatggaggtggattagcttggctcggttcggtcccatgcgtggatatgctgggccgcctttggagcatttctttgtggtgtggctacccagctgtataataaacatggcgagtaggattacttcctgtgtagtcaatttagccattccatttagggatttctgattctgttgcaggtgtccgtggcactggtggtaccttgatagagactagagtgaatgcctttttctttgttctgtttcattgtttgctgcatcctgatgcaaattagctcggcctgtaaactgtaaaggttgcttgtttgtgtcgtcgagatgggatttagtgcgccgcggcagtttgatgatgaattagggccttagcaggttctttggttaggagaatgttaatccagggtgaagagcgaagaagaacaagtagctcattaagctgcaattcatggtattcatgaaaagttgaaacgatatgtatttcgtttgtaattcatttccacagcttttctgttaaaaaagacattgaggtgtgtttgttattcaagtagtggaaccacgtatggagttttctggaatgggaaaaaatcctaatggagcaatactgtgtggaggtcgagtctttaccgatacttgtcacaaaataatttagttattagctctcttttatgaaaggtagaagaatggttgtgaataactgggaatggttgaggaggatctgtttgtctattgtgtacttttgtgcactttggggctgactatagttttgtttgtagctttgcacaagatattagatgtgatgcctttgtcacttgctgaaatactgaattattttccctttgctgacagtgaatttgactagctagtagccacgcatgaagccagatggtgaaactcagcttcgtcctacagctgctggacatccagatcctggtttgggcacatcatctgcagaatacgtggcctctctaggaccagctacagtatgatctgttctctttcttgtctttagaaacatgacagtacaggtagtgcaacgactacctaggatccttttctgctcgaagttctgatggtaaaatttgactacaatttgatcaagaaataaaagatacattattatatgactaatttcttaccagttacatcgatacttagttcttttaccaaccttctcttatactgctcaggttcagccctaataaataaattatttctttttcaggctccagtatcttatccatatatcagtacctattatggaggcacttatggtgcttatagtggacaacctctggtaatttacgttaccgatatagtcagatatcagatttactatagcagctgatttttgttatctactttctttaggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaaggtatttcctaaatattatacttgcttgagccatattttcaagctatttatcagacagggtgaaactgctttgccacctcttcaagattgttgttgaagattgacccatgccatcaaaacaggccttatcaaaatttcaagaaatttatgggaaaatgaaaattaatctgtttgctccaagttcagcatggttgtgacaacttattgggtttttacagtttcccttttgtttgtgaattgttcttttttttctgattgatacatccattgatctcatagatgaatatatgtgttcatatgtgtttggaatttcatttcttgctttcctcctttttcactgttgcagttatggatttgcaacgccttaggccccgttcgatctcccgtgttggagatggattttgttgcacgcaaaacgagaaacctaattagcacatgattaattaagtattaactattataaatttgaaaattggatttttttttcaaacaacttttatataaaaactaaaaaaaagtaccagttaacagtttgaaaaatgtgctaacggaaaacgaggaagttgaagtttgaagttgaagaatagaacagggccttagtctagaatcccacatatcagtcaattaaggggaaaattcctcactttggcatccttaatttgatcttctatagttattttgactgcaaaacttagattgtaccagattttagcaaggtttaaggggggcaatatatctaccctgttatttccatcttcctgagaatatctttcatctctattcaagtttctatcaaaactgactgtgctaactaatttaaacagaacaccattaaatgatattgtgagtttgtgacaatcttaatttagacgatatggctaatccaatagctttgtcgtaagtcacttttttcctttatattgataactacagaccgatagaagcaatttatggttaatttttttactaaggtgctcaagtaatgttctcctcactaaatttaatatagtttcacacttgaacacgtagaggaccaagcaaaaaaaaggatatgctccttgttctaaatgctttatcatgtttaatgggcactagtttctgttcatattgaaactcagttgtgttctttgtttctcatttctttggtaccatttggtttgttccttcttcagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgtacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatgggaacttttgtgaatttcaggttgaacaatagttccttggaaataccatgagaataacttgtttacagaacggtttgttcattcccaaattcgctgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttggcaaaatctactcctgaaagcaatggcaaatacagaacagaaataggtagtgtgtgtggattgggggcaagtgtatggagattgtggctgaccacattgggaagggtggcagttgccttggaaggagagaggcaacaccggctagatgaagggtatggaactaatgaatgaaccctactcgttagtggtaaagtgtggttgggctgtcgaatgagtacgtacgagggagaggagaggtgggccttgattcagactaatagagaagaggacttatatgtccttttcttttagcaaataatcataaatgttctatagtctattgtgctacggaaatttaaggaaatactaagttatttaaagcattgagagattttattaaaaatatatccaacacaacttcttgataaaattgtattccatggttctattttcttgtagaattgtctttaactgtattttaaacttcttaagaaaaagcctggcacgaatgctagaaactgcattttagaatgatttattaaatctcaaaagtttcaaataaccatggcacgaaagctgcaaaatgaaccaaattttgcttgactgggagtgtcagatcaaagacgatggatgattgctaaagttgaagaactcaatttcaactcagtgagctagaactactcccctccacccaccaccctccctccttccctaggtccactcgtggatggtgagttgaatgtttgtagagaggctcaatgtaattttttgcctattaaggaaaaactcatcatgtcattttttccacatgggggtagtgaagtggttgcaaatggcaagaaaggaggctaatgatgttgtcttccctaaatagggtgtgaagtcatgctgcataacgcaatacataggagaagaggagggaggagacgaggggtaatatgtctggtttga

SEQ ID NO: 374 - DNA, 6900 bp, Oryza sativa
aaagaaaaagaaaaagagaaaacgaagttcttgcttgacttgaaacgtaatcacggaactttcttgtgagttttggatggctgcacgatctttctaaatccctatcaccattcattgaatcatcgataaatcacgagcaaagtgcagcacgagaagatcgatctgcagccaaaaaaacgccagaattgaaaggacgattggatcaattaatggaagcatgaataatgcattttctctcctgaatttaatatgactcctgcagcgttcaagggccaaaataatcaaggatctaggaacaaaatgattgaacgatctcaaatctgcttaaatcatgtgctataccggtgtaaatacagttgcatgctgtctttttctgttttcgaaacacatggagctgtctccattatttttcaggaaaatgctcttttttcatgtaaatatactaagcaataatcttgaaaatattcacaggagaaaaacaaaaatgatctagcataaaaaaacagagacagagagtcgtataatacacttactgctgtatttaatttttttcaaatatagcctgcattgttaaattagggaaaaaaaagaaactgcctttgaaccctagcaagcacatgctgaattatttccacaaaccaaaacagaaatctgccgcatttcacgtgtaaaagaagaaacaaaaccgagaaaaaaaaatcaagagcgagcatgacagcatgacacaggccctcttaaaccaattttgtatcgaaagtaaatttaaatttaaacaggatggcaaacacaccccatatcctactacaaatacgggtggatgcagcggatccacctggactatccaaattggctgtcggggccagatcacgctgtgcgctgggccccaccgccaaaacaccacgcaccaaacacgacccactaaaaatcccgccacgtgtgcccaccccggtgggacccacctccctcccgctttatatacggctcatcacgaacgcatccgaaaaaaaactacgaaaagagagagagagagaagagagttttgtagcgagctcgcgcgaatgcgaagccaaccgagagaggtctcgataccaaatcccgatttctcaacctgaatcccccccccacgttcctcgtttcaatctgttcgtctgcgaatcgaattctttgtttttttttctctaattttaccgggaattgtcgaattaggcattcaccaacgagcaagaggggagtggattggttggttaaagctccgcatcttgcggcggaaatctcgctctcttctctgcggtgggtggccggagaagtcgccgccggtgaggcatggggatggaggtggcggcggcgcggctgggggctctgtacacgacctccgactacgcgtcggtggtgtccatcaacctgttcgtcgcgctgctctgcgcctgcatcgtcctcggccacctcctcgaggagaatcgctgggtcaatgagtccatcaccgcgctcatcatcgtaagcgcacacacaccattgctgtgattgattgatcgattgattcgccattgttgctgacgcacgcttgctgctcgatgatttgcttgcttgcttgggcaggggctctgcaccggcgtggtgatcttgctgatgaccaaagggaagagctcgcacttattcgtcttcagtgaggatctcttcttcatctacctcctccctccgatcatcttcaatgcagggtaagtagaaacgcttcggcgtgttcttgctgtggttagatttcggcttcagttcttttgttggcacatggtggtgtacaaggtttttctggggattggggaatctgtttgctgctggtggtacactgtgtacgcgtggctggtttcttgtttgtttcttctgggcctagctgtctgtccgtcgatgtcttagacatggctgctagttcatactgtgcaggttgtgggtgaattttttttttgttttctctttaagacagagatggatttactctcgtcttactggcataccttgacttgccagctcgaactgctgattggtacagtatggagtagcaactgtaatcttgaccattgcatgaagcattgagaaatgctgaaagattatttgttttttaattttaattattatatattgattgactgtgcaacagcttctgtctcctagagttctactcttggtccatttacagtggttagtagtactggtcatccaacaccatgaaggcatgagagggatatggtcctgtcaagagtgatggcgtgatcaatttctgaaagaacagtggccatgctagtccgaatttggttgagcatttaatccccttttgaaggtttttgggccatccatatagatttgaagtagggttgtaggagtaaagctgaatattatgggcccatgtttgctttcacatttaggaattgcaaagtctctctttgggaaagggcacaagtcctttttgagttcagagttactctattttcgttccttttctgctttgcttgaacttttattttttttattcatataataacacaagttgctgaataattctacgggaaaaaaagcatcgtcctggtcctcacaaatatttttccatcagttttcaggtaaagaaaaagcaattcttccggaatttcatgacgatcacattatttggagccgtcgggacaatgatatcctttttcacaatatctattggtacgttctttcagaaatgattcttaattcttccgtgagttggtagtgctttcattttctgttgttccgtgtaaccttttggacttctgagattctgactctgatcaatttcttaatttcagctgccattgcaatattcagcagaatgaacattggaacgctggatgtaggagattttcttggtaagccatggctatctttctgcatgatcatgctggcactaatattgacaccatgtgagcatcatttcctcctgttgactgttatgttcaatgtgcagcaattggagccatcttttctgcgacagattctgtctgcacattgcaggttagttgaacaaattttgccatacctcgagagagacctggattcaacgtgctaatgtaatgatcttaaccccaaaacaggtcctcaatcaggatgagacaccctttttgtacagtctggtattcggtgaaggtgttgtgaacgatgctacatcaattgtgcttttcaacgcactacagaactttgatcttgtccacatagatgcggctgtcgttctgaaattcttggggaacttcttttatttatttttgtcgagcaccttccttggagtatttgtaagttgattcttaagtttcactttttacatcttactgtctgtcttgactctactgcttggttgacacatgtaaacttaatattcttcttccaccctgcaggctggattgctcagtgcatacataatcaagaagctatacattggaaggttagttaagcccaaacaaaccctcattagttaacggttttatgctcagtgttaacttggatgttggtgactgattccaggcattctactgaccgtgaggttgcccttatgatgctcatggcttacctttcatatatgctggctgaggtgtgcctctgctttgatgcagtatcaaaatttgcatatagtttcattttatagtttgattttatctactttgtttgtttgatattggcagttgctagatttgagcggcattctcaccgtattcttctgtggtattgtaatgtcacattacacttggcataacgtcacagagagttcaagagttacaacaaagtaaattataattctcattccatattctactgtttaatgattagcttcagttcgtagaaaaactaaacaaaacttactggtttgttttgtcctttcacctcaggcacgcatttgcaactctgtccttcattgctgagacttttctcttcctgtatgttgggatggatgcattggatattgaaaaatgggagtttgccagtgacaggtctgatacatgttctcatacctaattcctatttatggatatggagactcaattttacttctctttcccattcgcagacctggcaaatccattgggataagctcaattttgctaggattggttctgattggaagagctgcttttgtattcccgctgtcgttcttgtcgaacctaacaaagaaggcaccgaatgaaaaaataacctggagacagcaagtgagtatctggtgtatgatcagacaattttcatttgaattcgacttgccatctgctaactgaatttctctcgataggttgtaatatggtgggctgggctgatgagaggagctgtgtcgattgctcttgcttacaataaggtcagtccgtcagtgcaagactattgcttcacaccatctgtatatctgtatttctcttctcatcttgccattaattagtcccaggagaagtatgtcttagtttcttctccttaagcttaactgtctcgttgcaattgcagtttacaagatctggccatactcagctgcacggcaatgcaataatgatcaccagcaccatcactgtcgttctttttagcactatggtgagtcatcttactgcaacctatgcctaacgcaaagcgtcctcttttcatccaagtttgtgccacatgtctgaattctcaccctaaacaggacctcagcattaagctaacctaataataagttcctcaaagtcgattgtcaaatcaaaattgtcagctgtgacaaaagtaatctggaagcttgtaatgttgaacatgctctaatccaaccaaaaccaactactgaccggagaatgaaatcatgtctttttgtccctactatcttgtcctcttcttatcccttctgaagagattgccgtaccgtccagtcattgactcatcgtccatattctcacatgacatggatcaaggatggcacaattatttgaaattaattgtcgtttgttactactagcttttcgttttagttttctggatgtttctttaggaagacatacatgtgtcatcatgtcgaattgcgcatccaatcacttgattgtttacgagctaaatccttgttcagaatccctggaagctcaaatgtgcaaaacatctatttttgtgaaacatactgacatttataaatgtttattaggtatttgggatgatgacaaagccattgatcaggctgctgctaccggcctcaggccatcctgtcacctctgagccttcatcaccaaagtccctgcattctcctctcctgacaagcatgcaaggttctgacctcgagagtacaaccaacattgtgaggccttccagcctccggatgctcctcaccaagccgacccacactgtccactactactggcgcaagttcgacgacgcgctgatgcgaccgatgtttggcgggcgcgggttcgtgcccttctcccctggatcaccaaccgagcagagccatggaggaagatgaacagtgcaaagaaatgagaatggaatggttgatgaggagaatacatgtaaaatgtgacagcaaaagagagaaggcaagttttgggtttgtagagtttggctgctgctaatgagttgttgatagtgcctatattcttcagaacttcagatggtgcctcaccaaggcctaagagccaggaggaccttctgataatggttcgggatgattggtttgttctgtcaggatgaaccctagtgagtgacacagggtgatgtgctccgacaacctgtaaattttgtagattaacagccccatttgtacctgtctaccatctttagttggcgggtgttctttcctagttgccaccctgcatgtaaaatgaaattctccgccaaaatagatttgtgtgtataataattttgcttggttgatataatggtatggcatggtttgcaatatactccctccgtttcgttttatttgacaccgttgactttttagcacatgtttgaccgttcgtcttattcaaaaacttttgtgaaatatgtaaaactatacgtatgcataaaagtatatttaacaatgaatcaaatgatagcaaaagaattaataattatttaaattttttgaataagacgagcggtcaaacatgtgctaaaaagtcaactgtgtcaaataaaacgaaacggagggagtaagtcaatttagcgtggtagtcatttctggtaaaaaggaagccagcttgtttttgagaaacgttcaggggtattccggctagctacctgtgtaggttagatgacctggtttcgaagtcttaccccttctaattagttgatattaggttcttccctaatattcgagttttagaagccagtttcagacgtctgaactctgaatctattactgtacaagtcaggttacctgttgttctggagctatgttaggccctatttagttcctcaaaaaacttttcccaaaaacatcacattaaatctttgaacacatatactccctccgttttttaatagatgacgctgttgactttttctcacatgtttgaccattcgtcttattcaaaaaatttacgtaattataatttattttgttatgagttgttttatcactcatgatactttaagtgtgatttatatcttatatatttgcataaaatttttgaataagacgaatggtcaaatatgtgagaaaaagtcaacggcgtcatctattaaaaaacggaggtagtataaagcattaaatatagataaaaagaaaaactgattgcacagtttacatgtaaatcgcgagacgaatcttttgagcctaattagaccatgattagccataagtgctacagtaagccacatatgctaatgacggattaattaggctcaaaagattcgtctcgcggttttcagtcgagttatgaaattagttttttcattcgtgtccgaaaacccctt

SEQ ID NO: 375 - DNA, 7287 bp, Oryza sativa
agagactaaggcaactcacgcggtataaaagacgtacccccggaggggttcaggatcaatgaatcgtagcgccaacacatccatcatagtttacgaagccgaaggactcaacccgaagccgccgggagatctcgtcgaataatcttggcaaagatctcgttggtatctctgttctctttgtactctgtgattttccatatcaatatcatataaactagatttgggctattatcttacgagaggcctgaaccaatataatccttgtcttttgtctgttttgatgttgtatcgtgtagatcctcgtaccaatgtaccctaatatcctatttatccggtctacgggtacccccgtcgataatatcctaattaaactagctagggaaaacaaatcccggcccatttgatcttcctttcaatgattaatttctcgattatccatcgattctgcatgcacgtagtagagctgccatatttaaagtggaaataggagatttgcactagcctgggtatagcgtcaaaagctgaaaaattatgcagcaaacaaatttcaacgattaaactataaatcggttgaggtctgaaaaggaagaccgtgtcataagaaatgcgcaactggtaaagcacaattgcgtagaggtaaagcacaattgcgcaactggtaaagcataactataactcctctattctcataataattttgattttacgagaaactgtcccatcgaaacatgcccttaattacattaagttttaaaaaatatgcccttaaattaataccaaaatgtgcggttggggctctactcttcgttttatggagtatatatatataactatttttttgaattgccaacgggcatgtgcttcttgtctgctaggcggctgcaccaaccctctgaacaagtaaagatagcaccgcgtcctcccaaaaaaaaaaaaaaacaaaaacaaaagcgagcatgtgtgcataaaaggcagaggaatcaatcaaacagccattcaacgtgcaagcgcgtcgatcccatatcgcacatatatatacacatacatagcaggggttgcacaataccatctccaaacatcaaaaacccaagctcgctcgctcatcggcgagctccaaatccacctgtgtagctcaacaggacgcacacgcagagcagctagctaccaaagcataacaagctctgcagcctcaagagtgaacatgatgcggtgtagcgaccgcctcctctgcagcctcttcctcgccgccgcgctgttcggcgtcgccgccgcggcgacgcggcgccacgactgggacatcagctaccagttcacgtcgcccgactgcgtacgcaagctggccgtcaccatcaacggccacacgccgggccccaccatccgcgccgtccagggggacaccatcgtcgtcaacgtcaagaactcgctgctgacggagaacgtcgccatccactggcacggcatccggcagatcggcacgccgtgggcggacggcacggagggcgtcacccagtgccccatcctccccggcgacaccttcgcctacaccttcgtcgtcgaccgcccgggcacctacatgtaccacgcccactacgggatgcagcgctcggcgggcctcaacggcatgatcgtcgtcgaggtcgcccccggcgccgccggcgacggcgagcgggagccgttcaggtacgacggggagcacaccgtgctgctcaacgactggtggcaccggagcacgtacgagcaggcggcggggctcgcgtccgtgcccatggtgtgggtcggcgagccgcagtcgctgctcatcaacgggcgcggccggttcgtgaactgctcgtcctcgccggcgacggcggcgtcgtgcaacgtgtcgcacccggactgcgcgccggcggtgttcgccgtggtgcccgggaagacgtaccgcttccgcgtcgccagcgtcacctccctctccgcgctcaacttcgagatcgaggtacgcatgcaagctcatcccccatcgccattgccgccattatatattctttacttatcaccaaaaatcaaagtgaaaagcacacacgttgaaacaaaaacacatgctactacataaacctcgatttcgattaatctcgattcacagaaccattacgtggcacagacagagtagtgatggatcagaaatgcataggggttccacaagatggtcgtagccagatgatctggtttcgaaagctcaccacttctaattatttaatattagatctttcgttaatatttgtgtctttagtgtagtgatcgatccacttatccccaaattaagtacaaattgagatggcgacgctgggagtaggtattactagttggttaattagcatgtctaacacatttgccatgcaaatgaatggatggaaacgaccacatgcacgaacttggtaggaaattggacattgggtagctctcgcgcgtgcggtcaaccgggtgaaccctacaagattgggttttcgccgtggcatctcgaccagagagatgagagatcgcccaaaatcacggtcacatgttcgaagaatcgcaccaatatcgagacagacgagcatcttttacttgtcccggcaattgtgccactgcacgatattccgtaggattagtatattttttgtactacaagtatatatataatccatcatgtttgggagcgtctgcgagcaaatctgcaagcaagcaggttgatttcgtcaatggagaaatctgtaagcaagctgaataggctgaacaagttagctgaatagtgggggatgatcctgacacaacctaatttgggccctagttagttggtgtttgtacttggctttggctgcatcaactacgtgacaacgagtttaattacttggtaataatgccatccaaccaaatgtgttgactcatatatcgaacattgacttgggtactacgtagtatatgtacgagactagcaactcgtcatgggctcatggcgttcgcaatgaagcttcctttcgctgtccaccgaatagtttccgattaacacgcctacgcggcttgacttgactattactctatctgtttcatattacaagattttctagtattgtccacattcatatagatgtaatgaatcttgacatacataatatatgtctagattcattaacatatatatgaatatagacaatgctagaaagtcttataatacgaaacgcagaaagtatttttttaaatatatcgttactagatgatttataaatagtcactactagaaaactatttctgcaggcggctaaaattggtctgtccattgaaaactatttttgaggcggctaaactagttgtacaaatataaaaactagagtattgtttaaggcaaacacgtagaccagccgaaaatgtcggcagcatagttcagtgtaatttaaacaaccacaagaacagataataatagtgtacttacaagcttacactataaccaaagtaattagccgttaaccctatcatgacaatatcacgtatgataaggtatactagttgcagtacataagtacaatcaacgaacaatcatatgatacgatggcccgtgatttgcgtgagatgcaagagatgatacacatgccggcccctacttcttggccgtggcgccatgttcgagaaagcctgcaaccgcgtagtatgggcataaaaaattcagcaatgtgtatagcttggtcagttgacatgcatctcgcttggaaattgctttgaggcacgacaaactgaacaagtggggaacgggcaaatagcatctgcatgcagtacacttctccgtataaaagtatatcctccttgcatgtagggaaaagtaagaaataattaaggctccgtttcacttacacgttaagggactttgatttgtagaaaaagtgtaggaaatttgaaagattttctattaaaccctttgaaacaaaggattgaattttatactatcttttaaagtttctatggaatgggtaatcctatagagattttggaggaaagttagcaagaggtccaacctcttggaaaaatttctttgagtctatctctctcatccgattcctgtgttttttctgtggttcaatcaaacggtcattcctatatttttcctgtattttccaatcctctgttttacacctgcattcctgtcagaattctgcgtttctcctattcctccgtttttccattcctgcgattcaaaggggccctaaacgagatgaatcatcagccctgacagcacatgttgagtactctctccgtcccaaaaaaaaaaacttaaactagaagggaactccctccgtcttaaaacaagcccctccgtctcaaaacaagcatgagatgggacataattaagtacaacaaatatggagacggagggagtaactactacactagttgtgttaggaccgctgtacggctataatatctccgtgcacgatacagtagtgtaggaaagtgattttatccctcgagaagatattcacttgtttcgtacatgtcacctaaaatagtcgtcaaaaaattttaaaaaaactggcaacatagattaatatggaatatatcacttcacaaacatgcacattcaaatttaacttctacaagttgtaacaaaaataataaatatagctgcaaatgtacgataactattttcagtttaatttgttctttttttgcaacttgtagaagttgaatttgatcttgcatgtctgtggagtgatatattttatattaatatatgttattatttttttaaaaaaataataattattcagatgaaatacaaacaacgaggggatgtctggataaaaatccacatccgtagcgtagcataaatatctctagtgtgaagtattcacactgtagagctcagatttttctcgccgatttagtaaaacagatgatcagtgacacagtaatcttaattttctgaataagtcattgacacagtaaaaatacgagttacaacttggttaatccgtggtaattaaacgattaattaatgtgttaatcaattccgcaggggcacgagatgacggtggtggaggccgacggtcactacgtgaagccgttcgtggtgaagaacctcaacatctactccggcgagacctactccgtcctcatcaccgccgaccaggaccccaaccgcaactactggctcgcctccaacgtcgtcagccgcaagccggccacccccaccggcaccgccgtcctcgcctactacggcggccgccgcaacagcccccgcgcccgcccgcccacgccgccgcccgccggcccggcgtggaacgacaccgcctaccgcgtccgccagagcctcgccaccgtcgcgcacccggcgcacgccgtgcccccgccgccgacctccgaccgcaccatcctgctgctcaacacgcagaacaagatcggcgggcagatcaagtgggcgctcaacaacgtctccttcacgctgcctcacacgccgtacctcgtcgccatgaagcgcgggctcctcggcgccttcgaccagcgcccgccgccggagacgtacgccggcgccgccgcgttcgacgtgtacgccgtgcaggggaaccccaacgccaccaccagcgacgcgccgtaccggctccggttcggctccgtcgtcgacgtcgtgctccagaacgccaacatgctggcggcgaacagcagcgagacgcacccgtggcacctccacggccacgacttctgggtgctcggccacggcgccggccggttcgacccggcggtgcacccggcggcgtacaacctcagggacccaatcatgaagaacacggtggcggtgcacccgttcgggtggacggcgctccggttcagggcggacaaccccggcgtgtgggcgttccactgccacatcgaggcgcacttcttcatgggcatgggcatcgtcttcgaggagggcgtcgagcgcgtcggcgagctgccgccggagatcatgggctgcggcaaaaccaggggcggccactgatgatcgtgtagtaaaactgaaattaattaccagaagctagccgttcgatcgccattgatttttatcacaattaattcttttgttttggatactatctcgatcatatggatgcatggtagcttcgtagctagttaattatattcatattagtgtttaacactatgttagttaggtccgtattattccacactatggtgtgtaatttgcaatggtgaaaatggtgatttattactgccaagatgtactgtaaaaaaagtaacaactattcaaataaatgaatgtattacctgaagtcttctgatcatctgaaccagttccaattgcccatattggtgcatgtgttaagcagagcagatggaagactaaattgcccatattggtgcatgtgttaagcagagcagatggaagactaactacctcctgtgttgactaagcatgacatcaatagcaaataatgatagcagttagcaagtaattaacacaacgatttctaaaccaaaccatgcacgtgctttcttttaacagattctgtgtgctcagggaactttacagagagaaatctctcttttctttttaagttgtgaaggatctctatcacaaactggtaccacgcggtttagatctaaatatatgacaccgatcaacttttcccttttaatcatcctactgtcagaatatctagctgatctctagtacgtgttaggtatcaataattaatcatctgcgcgcatatgcatgtgcacgtagtactcacaagggcatacactgtgacggtgatcggcagatcgtccaaagaaacagagaatgcaattcctggaatttgtaaacgttaattccccggacacatctacgacgaatcaaggtgcagctacttcattattcagttctttttttccgaaggttcttttctttgttcattggatgaattggcgtaagtattattagctgatgcagtgcttatctatgcattgtattattttatacaaatatatagtaacagtttgatctcttgtaataatcctgctaagtcaacccaatcccgcaatcgcacacacctgcaaggctgcaaccatccgcatcgagtactccagaccaaaaagaatagacgcactccagttaaaaacaaaaaagaacaataaacatcatttttagttatattaaggctatatagctatattatttacacatcttttttagtttcataccaccacactatccttccatctgtgacggcactggaatttgtgggccgtcacaaggaagtaatctcaatcgggccaaagtttcgcccgattgagatatgg

SEQ ID NO: 376 - DNA, 14746 bp, Oryza sativa
tccaaaggtcgtgctccaccagattggggcgcaccccacatgggccccacatgggccagggtcccaaacaaagttacaagcccattggcccaatacaggtgacgcaacaccttgcttctgtgattgcggccaaacgagatagaattccgagatgaggctggatccgttgtaaggaggacttcgagagcttttcatcaagtactcacgggcccaaaacagagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcaggaggaggggaggtccgggaggaagaagaaaggggagagatgacatgtggggcccacatgtggtaggccccacaattttgtgtgtgtgaatggcaaatgggtcccacatatctgtttttaattgaaattccacctcagcgccatgtcagcacacagactaggtaaacaccgccacgtcagcgaaaccatcctccaaaaccaccaagggagtcaaattacaccggtttcaatagtttgggggtgaagatatccggttttgcgatttagggtcatggattagatttcgatcatttttgagggtcataaagtgaacttatttccttattaatttatcatataaatgggtttatgggtcaacccatttacatctctagttacggcaattcagactataatacaaaaacctatggattataaatttactatcactgatttaacctatagatgggctcaccggtcaggcggtcagcccgtttgcatccctaccatcgaggcgtctcccgtcgtaggcattcccccctccggccgaacttttttacaaagaacgattttttttagaaaaaccggataaaccggaattgtgggtgtagaccgaacggccaccctaactaggccatcaggccggctggcctccgctgcagcactgcacgcgttcctgctccttgtgttcctctctcctctcctctcctccgcgtagggggtagagtaggggaatccgcgccgcctcctgctcctggccgccgtgaatgctatggccggcggcgaggacggggccgacggcgtcggagatgacaccgagcttcgcaggttctcagacgtggagctgctggagaagtcgcggcgcattcagggggagctcagtgggggtatcgagcgaaggctcaaggaccgcggggccaagtttcgccgcttgctagacgccatcgtccgcgagattgatcgccgtaaggcagcaacggtgagattcttcttctcttcttttttttttatgctgtaagttattttcttggtgtgcggtgaggggattaaagattcaatccttgcccggtgcgcttcaattagggcatgattgaagggatggggaatcttgatttttgttatgcttctgttcgatgatatgcctgccgcgcatacccaactgtaataatccagtgttgacaacttcaatgtactgtaaggctcttgttatctttggtgtgaggatggtgattactggagaaaatgatattatgttatcaatgtactcctatattctaagggaatgctggccaatgctaatcacttgataagttgatattgtgaattttcttgtgtctgatctctaaaataggtaacaaaagagcgcctcacacaatatatgaagtagatgttaggcaaccaatccgttaaatgctacagctatttacatatacattagttattaagggtggataaggtctttgtaagactgatcatcgtatgttctcttgcaggatgatgacagatgcgcaagggtagttcaatcgggatgtgcagaatcatcaggtatgggattgatttgtgttaagatattggttgatttatggttggtagcatggatcatttatgactgggacttatagtacacgtgttctcgttcatgacttcaagtattgatttgcttgctgttctattgaacgcttgttactcactgcggtgccagtgttgtgtgatagatgctgtaacttactgaagataacttaatatgtcctttgcttctgtcctctcttaagatatgggcaagctgtctatttcattcttcataccttaaacgctttgctttgtagtagatttacatgcatgaaaatgcagtataggttttcttagttcaaatgatacatataataaaataatgtggaagagtaatacaattttactacagttagttcctgatttgagctgttggttcacatttttcttcaatatttgatgatctaaggtgagccactcctatgtcatgtgacttcccatttgttgagtaaaatgttgataaaatccagaattagctgatgcccaaagctcttttcaaaggaattaattagtttcaaaattgtgtgatgctcagtaacaggtcacgatgaacatgtatctgttaaaagaagaaatcaccactttctagtaattttactccaagagtatattagcacacaattcgagattatatgagcaagctactgctagtctgctactatatcaattgggcagacaaaaaccttgctagttttcagatcatatttctttgtttcataatagttggccatttttttaccatgtgtttcttttatagtgatatctacaattggttactattctatctgaattttattccatgccaacctgttggttttattaatgtcagttaaacaacaagcagtaaccatatcagattttcggtcctcctttgggatagatgaagaggtaactattttgatctttgttatataaacccagtattttgtgcaagtgttttatttcctttacattaggcaggcgttgatgtatctcatttggaaacaagtgcatgcattggcgacccaaaaacttcaacagataatgaggggatcttgtgtgaagaggaagattcctgtaagtgtaaaccctctacgtctcaaaaggcatcatatgttgataggtcaacttatatggaaaatatagatgctgctgatgatggcaaggataatggctacagtaggatatgcaaagatgcccacacttctaggaaaaggttagtatacacaaactcttgtattgcagagtctcaagccgaacatccattttctttgttatgggaatgttaacagttaacttgttctaaaatcatgcatcatttcatgagatgcataaccctatcaaaattcttggtgttcataccttatagatattaaagcatcaagggaaatgcaaaacattcgtttagataacttatttttttacaatttagaattatgaagcatggagatgtaggtttccatcaaacactgattttttaattgaatcaaacgcatccaagacaatgcaaaacatagaaaaaaaagaagcaatcttacagttgcaatgatttatataaaagttgtactccctccattttttaatatatgacgccgttgactttttttagatacgtttgaccatttatcttattcaaaaaaatatgtaattatcatttattttaatgtgacttgatttatcatcaaatgttctttaagcatgtcgtcagtttttttatatttgcacaaaattatattaaaaaaacggtggtagtactttttatatggtgcaaatttaggctaagcattgtgactgttagataaagcaaatcagttgacaaacaaatagcaatactgctattatatataccatgtcttgtgcatctgttagactgttagattgttgtatatctcaccagttctaaacttgtaactgcatatatgtattgatcaatgaatatgttttgttaatctgtaacttattagttattgtattgaattatgttatctgtcctctactaggaatggagaattttcacctaccttttcaatgcgattgcgatcaagaaaggttagtatgtacattttcctttccaaacatcgtgacatggtatactagtagtaatttttatgttgaatactaaagttctagtaatacagttggcagaggtccaccacccctattattgccagtacataaattagttgatttgttttttgactatctgttatggtggtcaataacatggaaagattaattatattttctaactgggaaaaaggaaatatttatttgcaatgatattatcatcttctcgctcactatcaaagaatgaaccttactgccctaaaggctcctccttttaactgaattgtgataaatttgtgaagttccgtttgctgatgtgtggttgattctgttattaccaagcttgatgataaattgttgattagatgattgtacacgctgtgttttatcttcgtgtcaagtgaattgttatttttcatgcatgctcattgagttttttatactttgaccattttcgcattccttcatttcacaaatacatgccatttcagatgttaccatagtttctaatctacagctttgtgtactaatttcagtagtaatatgctggtaaaaactataagatatgttactacaaaatgtattccttttgagaatctattaatattatttccatataaactgattagatacctttttttgttataacattggtgctgatttctagtatgcaactatgcattactaaaattggaatttatttgtaatatgtgacatttagaaggaaagacatagaaaaccggttattttctaagtaactacgattagaataaggattctgctccaattagaatcaagatggaccctgtacaacatggttctatggtaacaatagagtcctaggattgtactattaaaagcctttttttgaaccttgtggcaacaaggggttcgggggattatgtaaacaaaaaggcaggaggggtggtcgaacagagacgaaagtcggccatagtgatccgggagtcccgtgtggaagggctctcgctcaacggatcaaaggtacgccggggataacaggctgatgactcccaagagctcttatcgacggagttgtttggcacctcgatgtcgactcatcacatcctggggttgaagaaggtcccaagggttcggtctcttagttgaggagtggtggcatgggatctctaattctcccccatgttcatgcatatggggcattttgagtttgttctgtggtgtgaacgtttttttgctcttatttttcttaacaaacaacaaaattttctgggtttttaaatcttgcacatattgactttgctgcttataaaggcattaatgttttatagtttataaatatctttccaccaattgttacacccaaaccatgatggattccaattccatagctatactgttagtagagatataaaaggtgtgctgaatgtttcatttgtgatgttatttgtctctgaactttacactgtctaatatctggttaaatattcataaattgtattcttatctgatctaattataactatcctaattcatatttatatccaactcctgatatgtaaaaatgatataatatggtaagatcacctttgatcttgttttcatccctacggttagaacataagacaactattgagtatatttgtctacgcatcgaacatgtgaattgcgatttgctactgctgataaggggtatacccacttcagccgtctgcattgaagatggcatgaaaatttcttacatatcaaaatatccaaaattttatggcatattggtattagtaacatgagtacataatgcttttgtacaatttaaaatgaaacttcaggtcggcagatatacccattaaaaacatattttgtgaacccagtatgactaatagatgggaagttttgatttttgatgcatatttcatcccttcattgtgatttatatgggaatgtgggggtggggggttgtttttttatggactgtaccaggaaaatagaaaaaacctgggcagcttttgattcttcggtagtttatgatcagttttcagttccctgtcccatacagtaattgcaacgatccacagaatgaaagtgaaattaatttgcctcttgttgggttattgataaactgcacagtacctgttattatagatgtactcatcacagcttctagaactatctatgctagttagtttgctttaggttactctttttacaaagcttattctgatatttctattcaggtggttgaagaggtggttctactcgatggagatacttgcatttcagactctgcagaaaaaacatcctctgcatggtaaatgagtttatgatttgtcatttggccacttgtgttcttccatatgtgtataccatcttaacctatgtcgttggtcggtgtctaagtgagtttgtgcacaaacttgtgtggtggttgcaaataggtataacaacctgcaaatcgtttgctctggtgcaacaacttgcttagtctgtgcaaacctgggacaaaagtccacgcaagcggaaactaatctgaggtggccctcattgatgatacatataggcctgcagtacacacataagttccaggctagactaaagctacttaattcagatattgaaccacttgcttgtgttctgcactatagcaaactgaattagagcaagcaggaaaacaaaatcccttggatgctattgtgttctgacattgaaccagtatcaaagctatttgcttgattttaattcttcagtatttgaagttttgaaccaccgtaaataactgctaaaacaatgtatagaggccgtcacagtaatctaatccttctactacattgttgcacaaagctactgcaattctgctccttgcccatcaacatcttataagcaacaacataaaagttctcccatattcattacacaacggttaactattggtgagccttggtcgagatatgtccgtactacaggcctacacgtcatcaatgagtgccacatcaaatcatttttgcttctgtggattgttttgtcctgggtttgcacgggctaggcaagttgttgcactgaagtgaacaatttgcaagttgctgtacctacttacacccactgtgcaagtttgtgtaccgaaagtgcaatttacttattatattttacgtctagtattttttctgtgattttttcactactgttgactaatgctggcacttctacagtgatgcaatgaagatacactatccttcatggttggtctttgaactaacataattatttgagcttactctgttttatatacagttgatggttaattttgtttttctgttctctgcagggacacccctaattctattgagctttcttattctgacatgaagtgtcttgagcctgaatcattgttgtcctcacctatactgaacttctacattatgtaagtgtttgtggagaaggatgtgcatcatagactcatagtttcatgaaacaagggcattgttttaggagaaaaatatgtattcatcacggaaaacaattaataataaagatcacttcattaacatagaccataaaaagatccatggctcattctagcagcctattttcacatttttcatgttgatatgtaaaacatggtgatcaaggtgatatctgggtgtcatttaggcaatagttaggcactgagattgtccggtgtggtcaagatgactgactggctgtctcctaaaacattgagcaacaaattaaaatggaagggaggcagattgagagcctgctgccgtgttgccacaactgctgtttttgttcaccattgtcgttgctgtattcatgcaacagctgggtcaggttgatttctcaagttgtatttccctttttacttcttttgcattttccctataaatcctgctgcatgctagttttatggcatcatctaggctttcagacagtctttctctaacaccttacaccttttcttctctatcttaatgaaatgatacacagatcttctgcatgttctaaaaaaaaatctaggctttcagacagtgcgtcattgcctcttgtcacgttgtcattgcctcttgatggttcatgttctgttcacatcatgcatgctatatatttgagatggagtgacacaccagtgtagagctactgttgtatgccccccactttatcctggctttacaccttcaactaattaatcaataagcatttgaacattatccattcaatgatttgaacagacacaatgaagcaaacaaaaaatatgaaactcctgttgtagatgccaacataaatttctcatttaaacaagaaataagtgatcttgtcctttaggcttgaattgcctttaatggacattggagctcgatagcaatccatagaccacgtttcagatgttagcatttgttttgcgtgctctattgcctttgtgtaatggtgatgcaaaatatatctcagcaacatcttttggtatctgttggtgttattaacacttgattatttatacttttgttgtcttgcatgtgttaaaaatgaacttctgtctctttttttattaacaaaatcataaaatgaaatccatctaggtacctaatgggacaaatgccatcgacaagtaggcttggaggcaagtatcatattttcaatacatacttcttcagcaaacttgaagccttgacatcaaaggttttttcctatattagattcttaacatttactttatttcttaaaaaaataatatgctataatgtgattgatagatttgctatcttttcttgttccttttctatttttttttgcggggtattctagttcatctttcatattagatcttgaattttgcacctagaaagatgaatagctataattcaacatggacaagagaaacgagtacaagactaaccatatatgtatatgttctattcaatcttactggtgttttaggtatttagttcgtaattgttgttatggagttcatgccttgtggacagcagttatgtagacaaagcagcagtggtagcacttgtaattttggttgcagctagcttgtcaattcataaggtacaactggctaggattcagataattcactaagagtagctagtttggcataagtcgttatgcataaggttgtctagttcccaatcaattgttgcctcttagatttggtttggagttggtagaccatctgtatgagggagctagtttagcttctctaagttacgtaagagataaactcttgactaatgtccacttagctggtttatcagtcgtatcacaaaggattgaatctcctacaagctagagggtaactacgcctccatctaaccaatttttagccctcagtcccaagccataaacacctttttctttgtcctaatgtagcaactgctggctacatgtatcatgcataaattatgtttaatttcatgctactgttagctaatactctctccgtcccaaaataactccacttttctacacgaatctagacatagcctatatccagattcttgtataaaagtgaacctattctgggacggaggtagtacctattttttttattactttttcataaatgaaaaattgatgttagttcaccattttgatttttttataaaaaaatccatgtgatgtttattttgtatggttattcctttaattttttttgtattcatactctgaaggtggacaatgatgcttatttcttgaatctgagaagatggtggaaaggtgtagatatatttaaaaaggcatacataataattcctgtgcatgcagagtaagcaattttgttgccttctttttgttgtcatcaggaatacaacaattatttgttaccaactcatgagctcaggtcccaagtcccaactcctgagttgggacctgagctgatcacatgcatatcttaacctatctatgcaacgctacctattcggctattccttacagtatattgtattgtattggtcagcgcacactggagcttggtcattatatgtatgcctgcaaaggaagaccaatcagggcccaccatatttcatttggattcactgaagtttcatagcagcagatttattttcagcaccgttgagaggcaagtggtccaaaaaacttctgagaatttgtatgttgtgtgttatttggtgtaccaccttttttctcttaagtacacaaatacatgtgataaaggccaacattttttcaacatgttcttttttcttttttcataattgagttccccaacttcccaataactgcacttctgcaattggtagaagcttagcttctggtatctgtatactgttatttggtgcatgcctttttattcctcctgcttatatgggtatgaaattgtttgatactcagtttaagctagattatttttagtgctttcttacaccttgaagttgtttacagattccttaaagaagaatggaactacctgaataaaactggttctttagaagattgtcatctacatgaatcagtgtggaagaaccttcctcggaaaattaagaagaaagcagttacagtaagtgtttcctccctccaaatgcaattgcaaatgtgtgcagcttcttatcttttaaaagataacgtatactacctatatagttgaaatttccaatagtctacttctccattatttagccatgcatgtatcttgcatcagacccatgtttgtattatttactgtgatgttactgaaaactgttaaatttaagatctcctacatcaagattttttttattttattagcaatgtaaggataaatattttggtataaggtactgctaagacgatcatttgcaactttccatgacaatttgtcctttctactctaagtgagcaatttcttcgagactgaaggtgttaagttcaaccaattcaaaatgtacaggccgtaaactgtcaaagactcaaagtttgacaatgtaggggcatggcgacaatgggtgtctatcatgtttaggttgtgagcgaactacatataacccacatgccccttaggttgagcgaactacatataagcagggttggtgggattgcatgctttttctaatgtgcgaatagactgcatccaatctggagcagtcttacagttgtacagtacaggtaggcaatgactaggatatttgggacatacattaccaacaataaattagggttacatttgtagaaacggaagtactgttttcttataaaaattagaaaatccataatattctgctgaccaattctacatcatgccattgatgaagtacaactctatcactacctcctatccctaagtgtaagggattctagtcataaatctggacatgaaaatgcccagattcatagccagactgccagaatccattatagttagaaacggatggagtatatgccattcgttgacttcctttgtttcttatgtcatcactgttagtcaaattctggtaaaactccatcaagtcaagtagtgaacctattgttctcagagactgaaataccctcattttctttatgggtgaaaggcagagcagagtattgtacactagaattttaaaaaggttagattggttccatgccatcgaaagttctcgacttttggtttataccatcaaaagatctcggtgcactttaataccattcaaagtttccccgttaccttttcatatcacaaccgttcacttctgttagagctttattattttatttttgttctcttccacattttgctgaaaggcaaaggggatatgtctatactacccttcctttacccatctaatcctgcccaatctcttgttctttctctcgagccaatctgaacgcatcgcttgagcattgtgagacacggcttccctgttcatctcgcattcgcatgctccacgctaccatcgatgcgcataaggaggcaattagtcaagctagcatattcggcatgcataaggaggcagcagccatggttagcaaccttaaccaacaacaagatattccaaccgctcctggagagccagagccatgtggttgcattcgtagataaagcaaaaattgcagtgacagaatgtggtggctatctccagagcgcccgacactgctcgtcgtgtgcggcggccaccgtcgtccatcgagcgcagcgccgtgccgctcctggtcggaggagcatgccgagtgagctgcacacgcgggtggaataggggcacggaagcaacaggaccggtcatctgacaccagctacgaccggggttggctgcgggacaatgcgacgggggcggcagctatgctggacgaaggggaaatatctgctttcgatctgatatgatgcatcggggctatgaacatgacacaagggcaaagatgtcctgcttaacgggagattcagcaaagtggacggaagtggtataacgagtaacgtggtaaactttggatggtattaaagtgcaacgagaactttcgatggtataaaccaaaagtggagaactttcgatggcatggaaccaattttgccttttaaaaacgaaagagaaccaagtaggtagtaacatcaaaattacttttgtgataatagtatagtgcacatcagcacatggtatcctagaggcaaaattgtcattttattctatctataggtggttgattaatgatgatgatatatacaaaggaaactattggactttgtcagtggcaaatcatagaactggtgcttcatcaatggcatatgatggaatttctccattagtattgttcagaacatcttgattctggctggtttgtttgttcttggtattttgttcctttaattatccttgcattcttcttccttttgttgccaggttccacagcaggacaatgaatacgattgtggtgtctttgttctgtactatatgcgacgctttatcgaggaagcacctgaaaggcttaacaacaaggactcatctaatatggtgagtcaccattagttgagttttcaccattttatatgatggtgttctactgcctgcacggatacttatagctgcccttatctctcttttcttttttatttttctattttcccttgttagtttggcgaagggtggttccaacgtgaagaggcttctgcactgcgaaaggaaatgcaagctctgcttcttcggttgtttgaggaagctaaagacaacaaccacatgagagatccaacaacaccagtgtcagcaacagcggagcaccctgttgaagtcttgtcaaccgagccagcagtaccagaccaccctcggaatgcggttggcgtcgccacctcatagtttgcaggcggctgccatgggagctggccttggaatgtggaaggttggtgtgcatccggaaaacatagctctcaattgtcttctccggttatgccacaagagaaggaaacttggaaggtactgtactgggtactatggtaggtaggtctgcaaagatgcgatactgccgtgtatagtttaggtagaaagccgggttatccgctgggctcttggggataattttggttcttggttagttcttaggctgggctacaagagaatggtcgaatttgacaaactgctcctacaagctctgagctgccaagttgacagctgcaggatctgcttgtaaacccatgaggaaggggagaatcatcagaatagctctcacctgcctgcccaaatttctgcttgtaaagcattctgaattgaagttctgatgggtatagccgtcggtggagtggaggcacaacttttggagttggatactgtcatcgctcttaaaaccatgcttttggggacacttgtacatttggtgctagtaaaagtcaggcggcatcacggagttcacactgttttccaattatccattaattcttgttcagttaatcccatggtgagattaaccgaacaagctctaattgttttcttttgtagatgcggataacacaaatgcacacatagagtcagctgcgcgtgtccagagaaagagagagagaaccttatttaggattttttttatttttaattttatttattaaaatattttgaaaaataactttctatttaaaaaaattacataactagtcgcccatcgccctctaggagggtgatttttaaaaattgccctcctagatagcgattttgctgacatggcagacggttgttggccctcgcctaacgccaggccatcgagagtgtcagaattttgcaagtggcccccttaccgcccttctagagggtgatttttgggtatagggggcccgcttgcaaaaggaatgcgagggcggcctggcatttttgcatgtagccccttgccgccctccctattttgtactgtacaagcgaccgtctgcttaaagggaagcaaggatggtttttttttttgcaagcgactcccttcccaccttcctagagaatgtttttcaacagtgtagggggctgcctgcaaaatgttagccgccctcttttgcatcacccccaacccctgcacagtaaaaaaacgccctatgggagggtgggaagggagccgcttacaaaaatggccctcccttggtggcttgctgtctgccacgttggtaaaatcgtcttcccagaatgatgtgagactagttttgtaaaattttcaaatagaaaattattttttgtaaaatattttaataaataaaataaaaaaataaaaatcccttatttaggggctgtgggccgtgtttggtttagcgctaaactttgtcatactttgcgacgacagcctgatcatctaaggctagcgtttggttcatgatttgatttgtcatgtgccctgcttttctagccgatagatccattcatgactgacattatctttcca

SEQ ID NO: 377 - DNA, 8934 bp, Oryza sativa
gggtgaaaacggagcggataatatccgatccgctccgccccgaatccgtccgaaatgaggatatggtatgggcttttagaaatccggcggatatggatgcggatgcggattatccgataggattttttcggataatccgaaattatcaacacatgtaaccactctatctattgcatataacataagttggttcatccaatggcctaattcatcaatgaacctagattttttagtctgaggctttcaccgtcttatgtcactcttgcgtagctgtatttttacattatggacattatgtattcatgttgtttagcacttaagcctataattattacgatgggtcgtttattgattattgtattatagttccttgcattgctaactcgatgttgtattgattgcatacacacatagcatccgataaatttattccgtttccgaaccgactccgcaccatttccgacatccgaaacaatccgctccgcatccgtacactatccacacccactccgaatccgtttaaaaaatatggtttaggatatgctatgaccgctatccgtccaaatccgctccgttttcactcctatctgcattgttcaggaggctaaggaccttcttctgagagatagggaggttgttatcaggaaagttagccgtagttagaatgccgttagtcatttcttagcaaacaaggctagggtggagttttgcactggtttttggttggaaggaaattgcaatcagatatcacagctagtctgtgagaacttctccaataagcaataaattttcttccccgcaaaagaaaaaagtgattctatgtcaaatttgtatatatgtaccaaaggaaaaaaataatcgacgcctgagagattcgaactctcgcggggaaaccccatgtacttagcaggcacacgccttaaccactcggccaaagcgtcggtgatgtgtaaggatacgatagaatacattttgaaataagattttactttcagtcgagtgcaagaagaggaaagcaagacgcgtcaaatctatcaatcagcttcagccaaagccgagagcccccccaaaagagagagaagcacgcatccgatcgccggcgacgaccgaatctgtgccgggcggcaggaaggagagcggcgatggcagcgatggcatccctgtaccggcgtgtccttccttcgccgccggctgtggagttcgcgtcggaggaggggaagcggctgttctcggaggccctggagagcgggaccttgcaaggcttcttcaacctcatctccgtgttccagacgcagtcggagccggccttctgcggcctcgcctccctctccgtcgtcctcaacgccctcgccatcgacccgggccgccaatggaagggcccctggaggtggttcgacgagtccatgcttgactgctgcgagcccctcgacaaggtgaaggcggagggcatcaccttcgccaaactcgcctgcctcgcgcactgcgccggtgccaatgtccgctccttccgcgccgaccagtccaccatccacgacttccgccaccatctcgtccgctctgcctcctcccaggactgccatctcatcgcatcctaccacaggaagcctttcaaacaggttgtttttgttaatccttctcttcttcatttcaaggtcttaataaccaaccaatttatcattgcattgcatttcagactggaaccggccatttctctccaatcggcggctaccatgccggccaagacatggcgcttatcctggatgtcgcccgcttcaaataccctcctcactgggttccactcccactgctttgggaagccatgaatacaactgatgacgcaactggtctactcagggggtctcttctctacccatcttcctcctctcctatctttcatactagaatgtactgcctcccttctcaaattgcacatgtctcacgccattactgtttttaactatacatcttttaaaaattataaccatatcatttttttcatgattaatctaccaatatcagcttcgcatataaagtcctattactgtttttagtaataatttaagattttgaggtcgtcatccttttaggaacagaggtagtagcttgagaattctcagcttctacctactactccctccgttccatattataagacgttttggcatctctcgtctagattcactaacattcatttgaatttagacacatatatgaagcacatatatagattcaggcatgaacctattcaaaaccctgtacgtcttataatgtgaaatagagtaagtagttcaatttctgaataatggagctactgattctctgatgagaatctgcactgttgggagctggagattctttgagctgccccaaacagggcctttggtttgttagcaacgattactcttgatgaagcaactggggcactgttatatcttattcaatcctttgtgcaattaaactcccatttctttaagaaagcctccttactgatggtacatttatgttttctttgctgcagtaattgttgtggttcgcaagtagttgtagggcctgttacttccttttttgggcagccatctaattgcagggagcattagttatgatctcttcagtttgattgcccagtttttctttctaattggcagagattgcttaaatctgatggggtgtcctttttttgggtggtttagcgcttaggtttagatgaatatacatgttacatcacttgcatttggtattgtggaaaatagcaacttgtagcattgaacttaaacatcacactaggtgtatcttccacgtgttgctgtggagatgacagtgcttttctaataaaactgcgtggaataatataattgctataggagggttaagtagaatatactttagaagctgtggcctgtgggaagaataacaaatttgctgttgttatatgacggaaaagtctatttggtttctcaacttgtcgtgtgatttgcctttgcgtctcgactctaatacctgatattacttgtccatcatatcaaaacgatgcaaatactgtccctatgcttgttttgcaagtgtttttttagtgaggtggcttcccacatcatcactttttttgccatgatatctgcctatcaattagacactcatgttagtcatgcctcttccgttataatagaaaaacaaatattaagaaaagagatgaaaatcatatgcatacatggataatccgaatggccccatcatgttccttattttttgctgacttattttccatgtacgcagtccagtaggatgccacatatgacaaaaccaccaatatacctaccagggacatcatttgcatggttttgatagttgagggatgagttttatctggtgctggatttgaggagtggaaattaaaccacattaagaattgagggtccaaatatgtaccttttccttatttattgggatacatggaattcttgtactgcacagtgactgcactgatatagacatgcacactaaagtactcacttcaatctgcacccatccactcgaagacgcagaccatattttcatccactgcccctttgcttcggccttctggaatctgatacaagtctctccaaaccgcacatcaattgcatccgtatacatcaggtcaccccctccggataactcccaaaccgtctccaaggcaccttcctgttactctgcttctggagattttggcttcacaggaatgaaatcatcttcaactacctgcctccctcagttcatcgtctacttcgtgcctgcatagaggatgcagggctctggactcagcggcttagacagatcaaccttcctattgccgccacctggaaatccctttttttcgggtgctctgcagttactgtatattgtgtttaaaactttgtacagtgttttcccttaaaaaaaaaaactataagcagctaaatgatacagctagcccacttgctgcttgaatgatgatgtggagaggtaggcttggcaaagttgccttgtaaacacaaattaattttcactgtaattatttgaaattataagtttagaacgtatgatgtaattatttgaaaccgttgcaagttgcaacacacaggtattaagctagtcaaaagaataatatacaattttaaaatagtcagcatataaaagtaagcatggtacaaaaatatgcaaatgctgttatttgatcttatcttataagtttacttaaaagagcaacttttagttcctgtgaaatgttcctaagaaaatcaaaagggcagatacatgtttctttgctgaactcatactgtgtaaaaaaacatcgacaatcacattgatatctgatattgtttatttattgctgatagcataagtgtattctgattaagatatttatattatttatagctgtagatatcatttagatccatcacagtaataatataaggactttaagttagtttttcttgccaaactaaaggatttatatgctgtgaaataaagtaaactacaaactacatattaaaacccatctaaaagaaaaacaacataatacctttaacatctcgtgggcagcaagcattgactcatttcatcagcaaatattttatacctgatctattgcatttccacttcagtagctcatctctcctttgttttgctattactttcagaatgtcctgaccaaatacatttcatgaacacaactaaaacaacatatctgtaaaaaaacagtacagaattgaaggaaataataggaaaatgagaattgaaaagtgcgaagaaaagcaatatgcaaggaaaaacaggattgttgtgattcactggactcaccagatgaaagagcatatgccattcattggtagacagagttagagggttggagaaacaatgttaggaagttttgcttgctccagtttcctcctccgtatctatccagttattcagactcaagtgcatgttggcattttgggagatccagacagcaataaaaacttgactttatggctttattgttattgggatcaggaacttccgaacttggcaatttagcttggtcacatgactcacatctaacaccatttcttccgcatccaacctccatactgtcaactccatacctgtttatgaggagacaacaactgtgaactgtctccgcggttcttcctttgtgcagcatatttttttgttcatttgtttcatccccatacatcaaatggttgtttacatcacagtgatccaatggttggtaaattatgattactagaaaagatgcccgtgcgttgcaacgggtggatgctatttcaatcttattattattatacggtttagctagggtgaaattcactgtgggagtccgatatttatctcaagttagtatgcaagtttttttttacaaaatttcttatacgactcttttcgtattttcgaaagcaaacgaacttaaaatccgactcaaacacggatatgtattccaaaagcaaacgaacttaaaaccgactcaaacacggatggcgtaccaaaataccggcaaaaacatcttcaatttttataatagtagagatgtggataccatgatatttacctttgctgcaaaacattataggggagaaattacatttgcgttatttcctatagatacaaaattgagtatcatttcagttttacactcaattgccaaactatctgtacttgtctttgcctttttattcatgccagtttaagatactgccatcttgatatttgaaggttcatgcttatctcaaggcacactgcagctccttcattgctctacacagtggtaaacatgccaatgcttggtatatcgaattcaagtgggtacattgatataatttcctttatatcattcctttagcttttgtgcagagttgcagagatgaaagctggaaaagcatggcgaagtattgcatggaagatgtacccgatcttcttaaggatgagagtgtagacaatgttccagcacttctgtcccgcttagtgaaatcccttcctgccaatgctggaaatttgatcaaatgggttattgaagttaggagacaagaggaaggaggatcaggattaagcaaagaggaggaagaaaggcttattttgaaggtcatcttcaaccttttcttttcaatctgggattctggatcagaattttctttttgtctcttttaacacaccttacactgtgtgcacttgcaggaaatgatactacagcaagtccgtgatactgagctttttagattagtccgtgaactgcaattcactaagcagccatgttgtagttgctcatattcaagtgatgatgattcctttacccggattgcagcctctgtgtgctgtcaaggggccgcattgctaacagggaatctttcatcaaaagatgggttctgctgcagagaaacttgcttcaaatgtgtacaagtggatggtgatgggcctaagactgtcgttacaggcacagcggtttcaggagtcaatgaacaaagtgttgatatgcttctaccgatatccacattggaaacaagcgtgtgcaattcaaattcaagcaacgaggttgtcaaatatccatctagaacagatattttaactgttctattgctggctttacatcctagcacatgggtgggcattaaagacgagaggctgaaagctgaattccagagtcttatttcaacagacattcttcatgatgatcttaaacgagaggtttgttgtattaatccaaacatcccttgctccctactccctagcaagatttgttttctagataaaataggatgtaaatcatgcctagttttgtgccaaacagatctactttaaaggaaccttgtcagacgaaattatcgtttccaccttccaccacaagataaaataagatgtaaatcacgtctagttttgtgccaaaagatcagttgtatagggcctactttaaaggaacttgactagacgaaattatcgtttccaccttccaccacaagacagaatagttaacccaatgtttaggggagacgagagtagtagtcactgatgagcataataaaagagaaaaggaggaaaaggaagcatatgctttacatacattaatgaagttaagtttatgagtattccttgaagaggtcatggggctctgcgatactaaagtttttacttctgagtacctttttgaatagaataacgttaacatataaatccaacatctagcaaaatgatctgggcgccgcattttattgcacatgtgtgaattgtaccttcacatgcaaaactgaaacaaacatttttctggagatgatattgaaacctttttcttttacttcagttaaggaagtatcgaatagaatgctgtttccaatcagatttgtccatgtttccctttttttctcccttgtggatgagcattcataccatgccggagttaaattcatatttccatgaaggaagataaattgttcatccacttctcttttcatcaaattatagatgtcaaaaacatttgttgcactagtttagaataacattttgtctgttgacacagatattgcatctaagacggcaactccattatgtgaggtcctgtaaagaggaggaatatggagatcctgtgccacaatcccattaacaatgatgcaaatcgcgcagttggttaccctggagatgcaaaaaaaaggggttagaggaggaactacatactccgtattacctttgtttcgagtgaggacttctcatttttgagacacctgacctgagacggatccgtgtagacatgttcatgttcatcacctgtggtcgtttctcttgttagtgacaactgacaactagcggggaggcacacgctaattgtgcggctggtgtccttgcaaaagtttctcataataacgcaatggcagatatattttcacactttattattaaataaaaatattgaaaagggcaattaaggagtaggataaactctaagagcaagtatgatacttcttccgttcctttatatttggcaccaagcatggtttatatttagacctggatcattcatcttctcttcaaaagttttctaaatgctcaaatagatgtcagattatcaaaatgtattacatattaagtactaaactttcatttatcataatctaatcaactcaaaattattagtggttaaagttgcaatagtatgagtcaacggtgacaaataaaaaggaggaaggctctaagcgctagtcccaagataggcttagattagataaagatgtggaggagaaaatagagaagttatcctgtacacaaacaaatttgaggaaatagagacaatgcgtgtattgctcattttgactagtgttaaacttgggatcagtgataagaaacataagttcacatatacaactaatttttttgagttttcgtcaaagcggtcacctagcagcacccatcaaatgcagcccagtctacctagtaccaatctgtatgactcatctttcttactttttcttcttcacaccacagtcgacagtatgacacgacaggacacacatatgcttttgtcttccttcttcccctccaactccaatgatccactccacccctcttccaaaaccctaacggcctaacccctcgatccaccacgcaacgcaggcaacttccctcgctcggtgagcaacggcctaacccctcgatccaccacgcaacgcaggcaacttccctcgctcggtgagcaatccttgttgtgttgtttatattatggattttctgtttgatgcataatttaaatgcgggggtcctaaccctaatattagggtttagggtttagggttcgataaactgtatgtgcagagcatgcttctgaacggcgtccgacagctaactgcatatgttgtccaccagcacgtcggatgttgcattggtttctggactccgagacctttgaaccagcattaatggtgacggtgtaatcgg

SEQ ID NO: 378 - DNA, 3202 bp, Oryza sativa
attactcctggactctggatgtcggggtataaattaatcaaaaggtggtgctggtgcatttgagcggatacaaaaactgggctttctccgccatggtgatcattcaattttttgctcatgcttctccttattaacaagtgtatatcaacaaagccgattaatatgtttcctcataattttttatttctttctggaactatagcctgtataaacttttttaagatatataaactgtttacactgtaaggctgctgtaatactaacttcaaaagcatctttcgttagataagcaaccaaaagtaaataatcgtggagctgcttaccaagtatataggagtatgtctcaaaaattaaagcagagggaaaatgaaaatgcaacggaaagtgttcttagatgtactagtatcccctgattttttagattacttcattaattggcacggcttgtgatcaaacaatgtatgctatcccaagctaatgcgaaattaaacacgatcatgctactaatccaaggagatattaacgcagtaagaatcaatgggcgatgccatcatgcattcttcaaagaaaagagtggcctccacatcctctgaagtctgaattccgaagccaggctttccggtcagtgccagtataaataaacatgatttatcgatatgataggctacttaatttcatgtgatatttactatgcatccaaaatcacaaatggtaggtgcgttgtgagcgtctatatttgtactgtgtttctagaaaaaatcacagatgattttgttgtgacagaattctatgtatacataacaagaaaatcccaacaaagtgggtcaggaaacactgggcttaaaagcaaaggtccagaaagatgataaagcggcccaagaaggtccaatgtaagagtttaaggcccatttgctaggctgacgcatgggacccatattgcggttcggcccaatgacacgtcacccttcgtcaagtccaagttccaaacccgtacgaaacgcccactcccctaccacgaccagcccgcaccgcacacgcaaccaccgcccaactcgcgcgcacccaacgacggcgccgccgctccgcctctctcttccacgcagcaaccggccgccatggccgccgccgccgccgccgcgggctcctccgattcccgcaagccagccgctcacccgccgccccgcgacttcctcgtccacgtcgaggcctacctctcccgccgcgacggcgtcgacaagctcctcaagatctcccgctacgccgcccgcctcgccctcgccgcgggcccgctgccccccgccgcctccgcccgcctcaagtcgttcgagtccagcgtcggcctcagccgcaaggccttccgcctcggcaagttcgtccagaacgtcaacgccctccgcgcccatccccatccgcccccggccgtcgcgctcctcgcctacggcggggagggcgtctactacttcctcgaacagttcgtgtggctggccaaggccggcctcctgcccgcgcacctcctcccacgcctccagcgactcagcgcctgggccgagctgctgggatacgttggttccatcacgattaagctggaagagatcggcaaactggagtcttccgtcaagatgcggctgaaggaaggttgcagggaggagagcgatgtggtgaggacgctacgggtgaagctgctgctcaagcggatgtccgttgtgcaggacgttgcggacgccgtgatggcgctaggggacgtgaccgacgggaagggtttgctcggcagctcgacgctcatggcgtccgccggcttactgtccgcgttgatcagcgctcacaagaattggaattcgtgctgaagcccaaaggtatatatatatgttgtaaaacacgatgagatgaaataataaagctcaaactggagcaaaattaaaacaataaacaaaagttgtccctggattatggatgttggggggtataaatcaaaagcgtggctttatcaccatggttgttattcaatgttttatttgtgcttctccttaaaaagggtaatggttctcatcaaaaccgaaaaccgattaatatgtttccatatacctttctcctttatgtaataaagagtttgtgttctttcaactataggtttaggtttatgtaaaaggtacaatttgtagttagaattaaaaaagagaaaagctaaagacactctggcggtgacttcttctcaatgtcttgtatacatagccatgccaatgaaaattactttgcactttgcagcactatattttcgtatatcaatttagtgattggtcagcaactcactataatatggcctgcatgcacaatgtacatgttagtagaaagatacttcaaaatattggatatttaaatcgtcaccgttttatccttttttctcctctctgttcatatcaaagagaccaaggaaaacttgccgagttgaacagcataaacaaaaactatgaacagcatgattaaagcctgatacaccatggaactgaactctgtagcataattatgtgaagtggatgaatacaagctgaaaccatgaatgaacttgacaataagatgaaatccaagcctgattatagttcaatacagttctagtatccagtccctcagtctgtgattctttgttttgcagaatcataaatcaatagtacatggaattgttaacttgatctagaaactttgcctaacatggatttgatacatttgctattatgcttgattgctacctactactaaattagtttaactcaacatgcaactatgcatagttggtaaccacctgcatcttttactagtataaaacgtaccaaactatctaattggcatgtattcatagattccctgagttacatagtgaacacatcaggattggtgagagtgttgcaactcttatgtggaatatactataataagggcaccgattgtctggtattgtgttgtgcttgtacttgctgttttttttttccagtatgtagtccacaacaatttgaatgagccatttcggattttcctttttatgaaaaccttctttgtttagttcattacttccaaattctaccaagagttgccctgcagagcttacaggcggtcaggtagttgcttcttatgttccttccaacagtattggccccctggtgtataaagttctactgtactttctgtgagcactgaagatcacttaaaattc

SEQ ID NO: 379 - DNA, 7407 bp, Oryza sativa
gttcaaggctggcgacgaagatggtgagggggtaagcatgggagacgaagggcttacctgagaagctccacaggtcaccgacgacttgatctgtgccgccaacaactattccgccgctctgaccactgacgtgatcaaatctactgctaccgccctgatctgcacttccaccaccctgatctctgccccctgctgccccaatctgcgttgctccgcctagatgtggttgtgagggcctgaatggccgagctcaagactgacctgggaaggggggatggaagctcaagttcatctccttcgggcaccgccaaggagagagagggaagatgcaacgttgatgcggaaggggagaagtagtgaggagtgacggagaagaagatgaagagggaacatgtggatgtttgatttgtttataaattttaaggcaaataccgtaaaatattgaatagaaaaaaatctaagaatttaaatacaaaatataaccgactgaattaggttgaaaaaaaacacgtggatgtggcttagcttacccctgtaaagggtgtcaccagtgcaaaatctcatcctccccctcacctcctttctcttatgactatagctttggactgcaaaaagagaaaaaaaaccctctcgcttttatgcttacgcttttcaaacggctaaatattataaaaaaactgtagaaaaatattttaagatatcatatattaatttaaaaaaacttaataatcagtaaatcatgtagtcttctcaaaaggcatccgcgttctatcataccatagacatagggcctgtttaagcaattttaagaaaccactagcttctaaaaatatagaaaaaaggttttcagcttatggttatagtttattttctgaactgttcgaaggagtttctgaaattctaggagactgagagaagctccacagggcgaaattcactcacggaactgcgacagctctggactgtaaggaagattcatcgaatatgcactgcacctggagcttctttcttcttttcttccggcctctcttgtctcttcaactctttgcgtcttgtcggcaccgcacggcgcacgccctattcctccctccttccggcgccaacccaagtacccaacccaacccaagcggaggggactccacttcatccacagccacatccacatccaccgagcaggaatccaatccgaatccaccatcagctctcctatcacattccctgcatccgtcttcgagcgagctatgcggcaggaggccacctgcagccttgtgctgacccaggacgcccaacaccggaagaaccagccaccgctggctgaggaggacgacgatagggatcataccgacgatgccatgccgccgccctgctcgatcttgctccgccaggaggagggcgaggcgacggcggcggcggcgggggaggggctgctggtgccgccgctcaacttcgccatggtggatcatggcgtataccgctccggcttccccgacatctccaacctgccgttcgtcgagtcccttcgcctccgctccgtcctgtgagtgcccgtccacctgctcttgccttgtccatcgagatggcgttgtcacctccatggtttcttgtgtccctccactcaggtgcctctgcccggagccgtacccggaggcgaaccaggagttcctccgcgcccacgggatcaggctgttccagttcggaatcgacggttccaaggtgaacaactttgaattgaacctgctatcttctcggttctgaattaaaatttgttcatctcagtctcagctatatatatgattcaaattgttcaaaagtggctcatatatttgtttgtgaaactctatgagaaatatatgaactcctagattcgattcatcaacagctagtttatttgtaactgagctaattaattaattaattagatctcctttcgttgttagtactcgtgattagtcacggattccttgttttaatatttgtcaaaatcgcagtgtgtgcggcttcatgttgtcagtgctttcatactctcgaatcttcttcttagtacttttgtaccatgtactaagccatccgtgacattattaaaaatagatagatgccttctccaagttgagcttctgcattctccactccgtgctttttgctgaaagcatctctccacaaaaattgtcctataatttgattctgctagaccacactttactaagccatagtagatttggcaactaagactgcagtgccaacttcagaaatttgatgataaactcaaatcttaaatgcgctgatgcaaagcacaggtaaaatagacagtgattgctgctgctatcaaaagcccagattcgctatcctccaccaaccgggaccgcgggatactattatggtggtatctcgacgtttggaccaggtggcacaggagttttttacctaggagcatgggtggcggtctagtctacggattgatagccactaagatatacggcggtatctcgacagttggaccaggtggcacaggagttttttacccaggagcatgggtggcggtctagcctacggattgatagccactaagatatatgtttctgtcaaacttttgtgcttgggagatgttctagttgtttctttcttcttttttggctgtgtgcattttatgcagaggccgggggtgactcagtttgattgtatcatcttgatgtaattaactgagtctaaataaagcttccattatctaaaaaaaagcccagattcagtagaacacatcagatagcaatcttttgcagtgtaaaatctacttgcgtaaatgtagcaggtgccctgtacctgttagcaaaatgaaggttggatttggggggaatttattagataatatgctgtatttattttgtgcttgcacctcttctaaggcctgtactctttctacctgatatgtattagagaaaatcccttatatgtattactgttttagtgtgacataaataataaactctatttgaaagcctgtgatgattgagcttccatagtggtcttttgtactggggctcggtaaatatttatgttttgtaatcatttcataacctagggtttttcaggttgctaaattcagatgtgatgcacagtagcttgtatataaagatatctttagcatccactcatggatatttcaagtggtccattatgttcttttggtttctggttcaattatctggtgcatacactacctcaggtagatgatatgatgtgtcagttaactagtgaaagaaaattgagtaagcaagtacttcacaaagattttcattttgttggattcatgtttgttagatcttttctgtcaacgtgtataatcaaactagaactctttcaggcattctaatttggatctagtctttgttcacaggcagagacgcttctttatctagtcacttttattttggaaaagttgtttagtagcatcagtaaaagacatcggatacttttctaaataatgtcgcaattgtcttaactgcaatacgtcgtcctaatgatgtgaagtgctagatgacattattgtcgcgtttttagtgcaaaactaacagtgcataataatcaggggcaaatccacatggaactaggaggatgcaagggcacatagtacggttttatttcttatgttagaatatcttttatatgcgtgcacctccataggccaacctcaacagcccccaaacactttgttaaattgtattgtggtccttgctcatattgccactgatagtacttaggtaggataccttgtttcaaacgtccaaatagccccttgcttggatagataatatggtctaaaagaagtatgattaaggcatcagaagaggatatagcttaatatactagagaaaaaagaaagtttgactccatagttctttcattttggccccaaaagcaaaagaagagcgagagcaaactatgtgggcacaggtccacatgtcagtgacttctccagcatgggcagtactgcagacaatccccattggtctttttccccttctactggcatactttagcttgttcaggatcaagtttttatgtttcagtccagtatgattgcaacattataggaaacatataatcccctacgacaaatagttgttgattggttacaacctttatagttctttcgtttttgcttttgccttttatgtacatatctctgtaagactgtttggttctctttggttataaaaatcacactgctaggtatcccctaaaaaaaacattataggaaacattgttcttttctggaacaaatcggagataattgtagacttcaacacaaatacacaggatataaatgcattataggaaacattgttcttttctggaacaaatgggaaataattccagacttcaacacaaatacataacatataaattgatgtcatattgaaactaccaataccttagaagcttcatctgatttggtcaatgtcatttttcgccgttaaaagggtttttagtcatttctttctctatttgttgataggaattgtcagaaactttgtgtcagttatgttgctgtgatccttgggcgcattgtttgttgtgtgattgtgcatctccagtattttttttccttcaatactcagtgagctacacattttgttaaatcataagtaagttataacaacctagaagtttttcagttcaaaaggaacaaacaatgtggacacatttttatcttataattaaaaataagttgccaaagtatggcacttcctatattgcatagtggtttgagctaaaattcgatcttgtaattttgtgatgtggattaaatccagaggtctcatactcagcatgtgccaaacaaaaaggaaaattggttcttctctctggattatattgttaatttggctcttttatgatacacggaaattttggaatagacaccttttacttgatgaattgggttggaaaactgaagtaaaatccagcttctgaaaattttattttatgttccattactggctggcaagaaccgattttagctggtggcatgtattgaagctcaatgattttagcttgaggactcaagccatgtgtttcagtatttttttttggacaaattgagaaaatgtctgtagcagtaaatggtggtcttaagtaacttagtattgtttgagcagtattggataaccaattcagccttcaactacgtttccgttgtttacaagctaatcatttttatccaagtataaagtgtagtatgcttgtatgctaattttcttatcttcttttttttgcgggaaatagcaggacaatctcctgcattgctatatatttttcatatgtcatatcgcagaactctgttgcttccttgttcctgcgacctgagatgcttcttcataaattgtcattttcatgttcaggaactaggttttggtactgaaaatagatgttgcttgcaggagccctttgtgaacatacctgaagatagaatccgtgaggctctaaaagttgtgctaggtatttaaaaatgacctaagctactaatttgtcgcattgtttttcccccctgattagatatcaaattctttttgtagatgtggcaaatcacccggtgcttattcactgcaagcgtggaaaggtaaaatagcttgattacaattcgttacggttgccttcccataattccaataagttttgagtcaaaattgtgaacaaaagaaatctgtgcagcatcgaactggctgtgtggttggttgcttgaggaaattgcaacgctggtgcctaacttcaatatttgatgaatatcagcgctttgctgctgccaaagcaagagtatctgacctaaggtttatggaactatttgatatctctagtttaaagcatttaccagcatcattctcatgttgagaaagcagcacacccagagcagcctgtgtgccaagattggcaattgtctctcggtgactctagagacctgtttatcatagtaacaagactaccttggtaagaaaactatcagtgataccttttaattgtgttttcatcattatactacttcccagtacatgtagtcgcaagtttaaccttatcatttttggagaataggtcccgagttgtagttgatgttaaagggcatagaaaccggatcggttgccaatgcagttcactgtattagttcagtgtttttcaagcgaataagagggatgcatcgggagctataccattgttgtttctgcgttagcagtaccagtatgtatttttttggcagtgcataattttttatatgttgtaattatgctcaatctgtatatcgaatagaatctcaaattgcaaggaaaaaccatcatggcccttcaagcccttgactgaatgtgtgtaattgttcagtgttttaaagaagattaagttcagtgtgttgtctacactagatttatcctggtgctaatggaatgccacatgatgacatgatctacgatttaatggaatgctaagttgccaacaattaggcgagctactttttaaccatcaatgtgatgactcgtgaaaagaaaaaagaacattgctcccatagaataagtctaatgtccttcctcccgttttaaacttttcaaactcaacgagacattactttggctagatgattacatagactctaaaacgctactccctcaatttcaaaacaataggacatgttttgttttgttcggattgaccaacaattactctattagaatataatatttttaagtaaattaatgttattagattcatcttcaaaaatatttctgtatgaataatttcgtatgattatacttgtgtcacataaatatactccaccagcatgttcgttgtgaactttgttcctctttcttttttttctttttctggatccatgtgattctgcattcccgggtgtcccaaacacaatagagatagcagcttaagcataaaatgaacactggtaatgtgagaatctcgtacgagaaacatttccttcatttcaaatcaacacacaaacacgcagcaacttcacaagtcagttacacgggagaagggagaggcaaagaaaagagaaggaaaatagtcaaaaagaaaatagaagctcaaggatacttcctaaaatgctgcatccaatgctcttctattttgtcaatatactacaaataccagctactgcccacctttaggccgcagagaaacagagaactcctcgctctcttgctcggtggtcttgtatgatgacgactcctaatttaaatacttgagggttcttctataattataagcactccacattgggctttcttcaactgcaaattgaaaaaaaaaaagacgggatcataagaattagttcgctcaagtgaactacaaaaacgctaggaatgtaatgaaaaaacaatgcaaattatacatgttatcagcaacagcatc

SEQ ID NO: 380 - DNA, 5755 bp, Oryza sativa
gaaagtccatttactcgccctcacttatagcccgaagcccgattctgattttcatccatgaacaacacaacagtaaaactacagatatcgaagcttccacaatataaatcgatgccaattgactcctttaatggtttgtgaaacaccaggaggtggtgtggtggtgattaaatttattttttaatcagttgttaccctgttctttattatgtgagactgttttttaacttttgttcggggttagctctcgtgctcctgcaagtgttagaagtcaccttgccatggcaatcagatgatcaaggagaaattttattttaaaaatgtgaaataaattaccaagtccttaaatttaaaccattatataacttagatatatgaaattataaattacatgtttgcgagtatattgttggtttaacgtatcacagcagatccattcctcgtttgactgtggatggctgccgatatggcactccacgttaatacaaagaatgtattcaagtgatgtaaaacttacactaaacctcttcttgctatagggttgaatcccctttcctcaacgcatgaattccccttgttcacggtgaaatgtactccatatgatgtactactacattaatctaaaaagatatgatagaggcgtctcgactggaaaagtttggaagaacatagcatcgattccaagcacgcaagctgcgaaacaacatgagcccaaaaaacccaattgtccattaatccatccatccattttcgttagaattcagccatgttgatcagggcaacaagaagacgaccgcccacctcaccatttccacgcgccgcccccacctttccagaaccttccctcgtcccaataccgtcgaatcctcgccgtcgatccccaatccgtgggcccaccacaaacccgcaggcgccgcatcttctctcttacccccgctccaagccaaaccccacctgaaccaaacccactgccatctgggccccacgcctcccggccccacatgccagcgacgcggagatgcgaatattccccccctctattctataaagaatacctccctcctccatcgccgcatcacatcgcaatccaaaccttcgtcttcgtcttcctctcgccgctgattcgattcgatccgatccgatccaaggtgagttccctcctccgatcgcgcgctcgatcttggatccgcgggtgcggaggattgctgtgtgcttcgcgggatctcgtttgacgctcgcggggccggatttggtgcaggggaggggaagcaatggcgacgaagaggagcgtggggacgctgggggaggcggatctgagggggaagaaggtgttcgtgcgggccgacctcaacgtgccgctcgacgacgcccagaagatcaccgacgacacccgcatccgcgcgtccgtgcccactgtcaagttcctcctcgagaagggcgccaaggtcatcctcgccagccatctggtcagtgagcaccccctgccatcgatccttgaccctcccgcgctttcgatctgcaaagtggcatgctactttagatttttttgggttctaggggtggatgatatttggtcgctagtactggaaggaattcggatcggaagctaccatttgtgtagatatgagtaactttgtcagggttgtagtgatcaacgtaggattcgatatgatcgaggcaaaggcggcccaatttttaaaatgaaaatcgatctcttatttgtttgtgttgtttaaatagatttgcattatgacagactgacataacggacttgacttaattaatgaactgttagacgaggtactccagatgtgctactgtttgttctttattgtgatcagtgcccgaaatgaactttgattgtgatgacttggaccagtgcattgtttaatgctcttgctgacctttgtgcttgccttccattttggttgggtaccatgactatctatttcttccattatattagtacgtttttaaattttggatgactaataagagttgtactagcataataatataatgaacattaaaagtattcagcatggaggtttgacctttagtgtaatggggtaattaatgggtttgatgatgattgtcttgtcttctgttgttttcagacaatgcaagttccttgtctataattgatcatcaaatttttgtataattgatcattaaatgtttgttaggtaggaaatagtggttaaacctgatcacagagacatgtcaagtttgtgcttctgcatttcacatgtatatttcatccagcacttatatctgtttcatttcactcacaagcacttatatctgttccatttctctcttgtgagtgttgtttcatggattggataacatgatggcatagtggtctgataaccaaaacttcacttttttgggctaaagttttgtgccatgagaacctccagtagaatatatcaatttcaggagtatccaaaccaaaacggttatgttgtatattgtacaacaagttgacaaataagcaactttgtgttgtagcttttatatgcagaagagtttataatgcttgtggtgcgtactgtgaacaaaacagaatggattactaatcaactgtaagctcttaactgttgcttttcattctaacatgattcacttttgtaacctccagggccgtccgaagggtgtcacccccaagtacagcttgaagcctcttgttccacgcttgtctgagctacttggagtcgatgtatgccattggatgatagctgttaacagttaatttttgttattgttgaactagacaacagctcttgtattcctctgatctatttgtgtgcataaataggttgtgatggccaatgattgcattggtgaggaagttgagaaattggctgctgctttgccggaaggtggtgttctactcctagagaatgttagattctacaaggaggaagaaaagaatgatcctgagtttgccaagaagcttgcagctgtcgctgacctctatgtaaatgatgcttttggcactgcacacagagctcatgcttcaactgagggagtgaccaaatttttgaagcctgctgttgctggcttcctgatgcagaaggtattgccaaaatgaagtctccatcctggtcaatgtttgcttaaatatatattcctagtaatacataggtcccgtggtaataactcataattaggaattgaattcatatacattattcacctcaatcctcaaccaacctagtttgtattcatttcaaagaagcaataccacccttaggattggcaaccacccaatagtccaccgaagagtttgttactttaggagtaggaaataacatggaatattagagagaagtttataagtaaattaatatttttttaatcttcaatgtattctccaaaatatgttgcataatgcttatttcagaataaaaaatacaactgtactgatatggttaattatttcaggaacttgactatcttgttggagctgttgcaaacccaaagaagccatttgcggccatcgttggtggatccaaggtctcaactaagattggggtgattgagtctctgttggcaaaggttgatgtcctcatccttggtggtggtatgatcttcacattctacaaagcccagggatatgctgttggaaaatctcttgtggaggaagacaaacttgagcttgcaacttcacttattgagaaggcgaaggcgaagggtgtttctctcttacttcctaccgatgttgtagtggctgacaagtttgccgcagatgctgaaagcaaggtttgttcatttacacagttctgcaaattacattttgctccttactaggaaactaaagtagttttaaatttaaaataacaggtggttgttgatgtatttcatttcaagcatcatacaagtaatgatcgattaatatattggcatttcagcctccatcatgatatcataaattcgaaaatgtttgtccctgtggatggcaacatccagtaatattcatggtgcatagtactaaattattacaaacttttatgtccgttgttttgatgtccactataccatcattttcagactgttgctgcctccgctatccccgatggttggatgggtcttgatgttggcccagatgccatcaagacttccagcgaagcattggacacctgcaacactatcatttggaacggacctatgggagtctttgagtttgagaagtttgcagcaggcactgatgttagtacaattgactcacatccgctgatctcctgcattttctttcttttttctgtcgctaaacattctcgtctttcatcaggcaattgccaagaagttggctgatcttactaccacaaagggcgccacgaccatcatcggtggtggtgactccgttgctgcggtcgagaaggctgggctggccgacaagatgagccacatctccaccggcggtggtgctagcttggagttgctggaaggcaagaccctcccaggtgttcttgcccttgatgaagcgtaagctaattcggcttgtctccatcagcagtctgcacttttgtttcagacctctcggtgtaactttgcaatgtcaatgcttgtatgaagaacttgagataggcttatcgtcaagttttgctagatgagtcgtgaataagcttttcgacttcctcgctgccgcgagtgaagtggttcgaactgacatacatactctcatggatcgatattttgatatgcggttatcacatccctatgatggcatcatctgttgatattgcccgatccgctgtggtttatctttgattttacgtatgattgtttgctgtgcgcatttatctgggttgtttttttacgcagaaatctgctaatctattactccctccgtttggattttgagtttttacttgcaacgttagaccacccgttttattcaaatttttttaaattgttatttattttatttgtgacttactttattatctacgttactttaagcacaacttaactttttgttttttatatttgcaaaacaaaattgaataagacgaatggtcaaacgtcgcaagcaaaaacttgaaagtccttatattgtgggacagagggagtacttgaaaacatgccaacatttttaacacaacaaatatattatcaaaatatatttaatgttacatctaatgaaactattaatctgatgttgtagatgatgttattttttttataaatttggttaaacctagggaggtttgactagataaaaaatcagaacgatttgtaatataaaacgaaaatggtatacattgttatgaaaccgatcttccgaaggagtcggatttgtaggaccgtgatcgtgaggatcacggtacctcctccttctattattctgtttccttattaatgaagtgggcttataccaaatatatatgtatatatccatataggatgttcttttgtttccttattaatgaagtgggcttatatcaaatatatatgttattaatgaagtgggcttataccaaatatatatgttatatgtatgtatctatataggacattctattgtgggtataaatacaatagtgaggttgagggcaaagtaatacttgtaacagatagagaaacatcaataaagttgattgccctccactttcgtgttcgtgtgtgcttgttcgattgttgacaacgtgaattctaatacgttatcagcacgaggtgctcttcagccaaggtatattgtcaacatcgatctgtcctaatctcgttctatagggataacgataaactt

SEQ ID NO: 381 - DNA, 5819 bp, Oryza sativa
atgatgaagtaagctgaattgaagaagggagaatcatttctggtcattgccctgccccccatagaaagaattttatgcgtatctccaatgctagtggtgggcaatacttggcatggtatccatcaaggcatcaagcaccattgctcatcaattttcataaaaacatatttatcaactacatactacctttctaaaacaaacactaaaaatatgctttgactctcaaaaaggtttcaaagaacattttatctaaggatcgttcctatgcttcaccgaaactatatagctagacaacatacaaaattagctaaggtggagctggtatacaaggcctgcgtagaggtcggatttaatccattgtcttaaaaaaagtatacaatgccttgttattaaaaagtaaaaagacatgggagatcctaatatataatgttttgtaaatatttcttcaagatttgtttatggtttagtaaaactcctcgggaaattccaacaatattttgggaagataccttgactaagaaaaaaaatccccaaagaacaaaaaaacactctacctcaggctgtcaaaaacatgccaggatgggcaatgtgatgaatagtcctattgaggtctctttctgtagagaaactatcgaaaaactaaatttatggcttggagcaaactcagttcagagtcatcaattatatgtttatcgcaacagtgagatgggaccaacatcagaaaggagagaagatttcctgtccaatctgtttacatggcattgatgcacaacaatgttcccaaataaaccagactctatggcatcaacaaatacctccaaaaattacttactagcatttttccaatgcttcctgtgtaggggtctgaatttgaccaaagataaccaatggaatcaacaggctggtgcagataattagctacctgtttaatagatcatcttgatcatttttttgcaaagaattaactaccccagctagatccacatcagtcaaattataatccagtatgaataaagtatattactacgacatcaacatgcatatgatgcattgatgcatacagtgatacaggcttacaacatcagttacatactcttaggctgtgtttagtttctaaaattggggagaagtttggagaaagttggtagtttgaaaaaaaagttaggagtttatgtgagtagaaaagttttggatacgatgaaaagttggtagtttggggaagtttggtgtgaagttaaacaggcctagataggagaagaaagtacagaagcagaaaccattagtttacagagccctaagcttgcagcagcagcagcagcagaagtagcagagaagtgggagagcgatgtatccattcctgcaaatccaagttggcaattccgagggccgacatatatcccactccaaggagatccgacaacgatgcccaacccaagcagcttgcttgcatctccatctcctcctcatcggaactcctcctcctcctcctccatctccattatttccaccccggcaacaatccaaccggacgcagcccacgggccttgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgggtagctcagctttgctctccttttattttttatttttttttctgtttgttccaaggtttcttgcatcactttgcggcttatcttgttggttttccttctattttaaggtgtaaagtttgtctccttgtcttggttgtgcttgctgttcttgtttgtttcaaccaacttgtgcagttatacttgatgcttaatgcttctttttttttctttttctatgtggtttatgcaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggtgatcttttttttttcgttggctgtaacctgcaacttgctatgcttgagatgaattcttgaatgaaactgatgagaaatttcaggatgctgaatgcgaggcaaccgaagagaccaaatcgtcgtcgcggcgatatggatcaaagaggagaactcgtgcagctgaagttcataacctgtcagagagggtgagatcatcaaatacagctactgatcttaagagataaatttttagtagtcatcctaaaagatgatactgatgtagagaagaagggatcggatcaacgagaagatgcgcgcattgcaagaactcatacctcattgcaacaaggtaagaaacattattatatatgcatcttttttctgatcaggtgcaagtccatggactgatacagctatgttggtgagtggtggcatatctgatctatcctttgttgatatgattctcttttttattcaaaccttttgggtttactttactaactgcagttatctatatatttttcaattagaccgacaaggcatctatattagatgaagcaatcgagtatctgaagtcactccaaatgcaagttcaggtttgaactactgtttcttgtatctgaacttacatggtcctacatgaggccaattactagcacagattgagattgtcgaatctgtgcctcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtacaaaaataccatactgacaaagggaattttcaggcctctttgattgttcacctagattaggcattggtcatttgcaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgtaagcacttgcaccaatcagtacatctgcctatttacttcaaatgatgttgagataactagagctgcgtatcgctacttgtatgtattactattgttttcagccaatatatctgtattgaacacgatcggcaatttgtgccgtcactttttgtcagcttaagctttcagagcaactaggtaacatgaggacctatggacttacccatatcatctgtagtctgtttgttgagctcgaaatgcatgactagatgcatagaatatgaagccatcatcgtccagcttaaactttcacagtaacctgttagttcatgcaagctaaccagttgttttcatctgacctgtcatatgatggactagtcggtggctccaatctttttggtttttgacatcttctagcactgtccatgaaaattaacggttgtatgtctatttcagcgtcacgctgttgcatcaaatagaccacatgatagcaaagagttgctggtggataacttcagaactattatttatgatcttcattttcttgatattacaggataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctctctaaattcttagaaatgtctttccttttctgggaggaaagaggaaatgttgaaatacttgttaaatgacaaccatgcaagcaacaggaaggcacaaaagaagccaggtcctacatgaactcattggataacaaactgacactgttcctgttctttaaatccaaagtacagctcaatcagagctcgtcttttcggccagtgctactgctggtgggcaaccagcatatgatacatatcttatctatgctttagcctaacacgactttctgtttgtggaaagatttggtgaacactgattgtctgattgtgtctgactgttgcacaaacgagccgacacacttattgccaaaatcttcagcattctggttctttgtgactcatgcagcagcagcaggaacaacaactgggagagcctgaggattatgtctgggaaccctaccaccattgcaaattgccatcatcccagcagaaacctgaaggtatacaggagttgccaatttctttttttgcctgatgttacagcactcaagtgcaggttattacatggtcctacctgcacatgctatggggggtccctgcacattgcaactggttcataggatcatatctactatctcctgagctttttttttcctgtctaccacaatgggatcccctggcactccttgctccacgcctcgccgctgttgctttcgcctttccgttattcttcgggattgaacagattgtcgcctgcgtcattgcagcgtaagaggaggaggaggaggatgatgcagccgggggcacttgctgagcctggacagtgatgtccatgtaaatgcaacctctggcttgtattgccggaacatgtacagtagaggtggtgtaaaacactttgctgtggcgttttactgctgtagttacttcttttcacctagttggcaaagccaatatatggccagcttatggaagtcctatttcgcaatcagctgcgagataaacagtttgcgatcact

SEQ ID NO: 382 - DNA, 3661 bp, Oryza sativa
gtggccattttcccccatactagccgactttgctactacttgatagtcttatcactgagaggaatggacgcacattattatatgctagattgttaaatcgagaggggattactgttgcaagtgagacagtacctagcacataatatgaaggtatatattcattcttcttgggtcgagttgttagcaatgctgaattatcaatgtttgccaactgctagcaattaggaagaatggctagtttgtggctatgattgatcgatcatcaagctaaagataatgctatgcaagtcgagacagctcgatgagctcacacaaaggataatcttccaaactgaccactctgtccgtggtcttgtttggatcctccgagctattaaatagtcctctgaaattttgctatttaggattattaaacgtagattaccgacaaaaccgattccatagcccctaggctattttgcgagacgaatctaatgatgtatattaatccataattagcagctgattactgtagtattactgtagcaaatcatggattaatatacctcgttagattcgtctcgcaaaatagcctagtggttatggaatgagttttgtcagtaatttacgtttaatactcttaaataacgaaattccggagggctatttaatagccctccggatccaaacagggcccgtgtcacctaaacaaaaatggctttaatttccagaacctgccccgtagcaaacgaacccatactactaatctatcatatcatcttgtgaattatttatctctcgctgacaataaccgatgaaccatcaaattcaagcttagtaacagtagcgcttcctgtcatccacagattaatcaaggtaaaacaaaaacccctaccatcatcgttgtcgtccactaattactaaattgccgactgctaaaacaaaatgaataattaattaattaattaattagtaaagaggaagagaaagagaaggccattggtgcagacgtagtagtggagcaggagctataaaaagaagcaggaagccactcgctctcctcacagccacagctcgccatcgtcgtcgtcgtcgtcgtcgtctccggctccggcaagagagctagtagtgagtagtagaaagaagaagaggcaaattaatagtaatggaggggaaggaggaggatgtgaggctgggggcgaacaggtacacggagaggcagccgatcgggacggcggcgcagggggcggaggagaaggactaccgggagccgccggcggcgccggtgttcgaggtggaggagctgacgtcgtggtcgttctaccgggcggggatcgcggagttcgtggcgacgttcctgttcctgtacatcagcatcctgacggtgatgggggtgaacaagtcggcgtccaagtgcgccaccgtggggatccagggcatcgcgtggtcgttcggcggcatgatcttcgcgctcgtctactgcaccgccggcatctccggcgggcacatcaacccggcggtgacgttcgggctgttcctggcgcggaagctgtcgctgacgcgggcggtgttctacatggcgatgcagtgcctgggcgccatctgcggcgccggcgtggtgaaggggttccagcgggggttgtacatgggctccggcggcggcgccaacgccgtgaacccggggtacaccaagggggacgggctcggggcggagatcgtgggcaccttcgtcctcgtctacaccgtcttctccgccaccgacgccaagcgcaacgccagggactcccacgtccccatcctggcgccgctccccatcggcttcgccgtcttcctcgtccacctcgccaccatccccatcaccggcaccggcatcaaccccgcccgcagcctcggcgccgccatcgtctataaccgcgcccacgcatggcacgaccacgtatgcaaccaaccattatttaatgctttctcaactacttagctactccatccatccgataaaaaaccaatcggaacgtgacacattctattattatgtatctgaatatatatatactatctaaattcatcgtacaaaattcgttttttatgggatttgagggagtagttgctaataatcacacgttaatttagttcattgattagtgctaattgatggatggatttgtgcagtggattttctgggttggtccgttcatcggagcggcactggcggccatctaccacgtggtggtgatcagagcaatccccttcaagagccgggactaattaattaccatgcaccatcatcttaattaagcgataattactctgaaataatcaaccgagttgatgctgcaagatgatggaggatcaagtctctacagtactacgtgtgttattaccgtctggtgatcgatgaagctagccgctgcataattataagcgcgtttatatatatctgatgttgctgtaattatatctatgtgtacgtagtatgtttggtgtgagaaatggtacttgtgtgtgcggaggcatgcatgttcttggttgcacgccttcagctatatatagctttgcatcaattccatctccaaatgtgaattttactagttactatttttacctcctctcatcccctcttatgttatgtgtgatcaagtatttgatcccctctcgttaagtaaatgttaagcatgcgtatttgtaaacttgttagtgctatactgatatgctatcggccctatcggcgccattattgccgggtcttcaaatgccacggtgtatgagaagacttacgaattgtgcaaaaaaaaaaaaaaatcttgctgacagccataatcatacatacatactagctatgagcctatgaattatagcggaccatgcatcatattttacttgaacaagtaaaaactaaaagcataagaaaaaagtaaacaattctttaaattcctcagttcaatgtatgaaaattacttgtggttagagctattaattatagcggaccatgcaccacattttacctgagcaagtatgaacagaagcaaatctaaacaagcagtaatgaactgtacactgacagacaagttaacatacatcctcagctaggttacaagcagctttctgctattagaatttacaacattcacatgacttaaaggtgtgtttagttcacgcaaaaattggaagtttgattgaaattgaaacgatgtgacggaaaagttggaaaattgtgtgtagaaaaattttgatgtgatggaaaagttggaagttttaaaaaaaaaagttgggaactaaaccaagccttagaaaaaagtatctttcctgacagtaacataccaatatacagctatgaattatcacagtttacctgaacgagtaaatacgctttacttggaagtccagttttagacctaaaaccagcgtataataatataggcatgtaagtaattttaatagctccataaaatatgtttagatcgatgggctgttttccggattaaaattcagccctgtaagtccattaaacaaaaaaaaaagtccttcacagcccacgataaaaatccgacaaaattaagtcgagctcgtccccgcagctgcaccagtgtttaatttttcggtttagccgattgtattagaggtcatcgatataccgaaatttccaaaagtttaaacaaatgttagtaaaatttaaacaaaatat

SEQ ID NO: 383 - DNA, 3430 bp, Oryza sativa
tctaagtaggaaaatatgctgacatggatctcttgtatagagcctataaataaccattgtgagtgcccttaacacaacttcgcttcgtcgaaccgaagtccaaccaaacaatttcaacttcatctaaaaaattaaagctagctaaaatactctcacaaaattaactagagagatgtacttaggtttaaacctacaatagaaagttataaatccacttaatacatagagaatatacaaaaaatataaagaatgatggttctcgtacaaaagctaacttaatacgtgctctaaaaccaatatattaatatataagtgagagagaaggatatgagatgataaattgaagctaaccttattgtaaatatattatatatacgttaactttaaaatatgctaatagctaacagtgagctgtactattaaactcgcttcttaaacagattcacaactttatttgaaacccaaatattagtaaaattaaatttagatgtctgagtctctaccgaacgagctccaagtccaacggagacacacacgttgcagtaagggtgggccccacgggcgtccggaccgtgcgtcgcgtgcgtcgccgtcgaacacggcacagcgacgcgcgtgtccaatggacggtcgccactgcattattccgggtgcgaatgcgattagattaggatttgatctcgcgattagattgggcgtgtactcgtggtagtagcattactactagtacgtggcgacgacgaatgacagcgatatatttttctttttctcttttgcgttggtggtagcttcgtcacgtgtccgggcctgggtgggtggtcgccgtttggtgtggacgcgaaggacacgtgtcgcgtggcggtgcgcggcggggaggcgggactcgtggacggcccggatgcggccgaacccaccacctgtcgcggcatcgacgactgatcgcgacgcgaggcgtcctttatattgcggccccgctttcgtctccgcctctctcattctctctctcgttgctcctgagatcgtctcgtctcgtggtggtggtggtggccattgccggagcttccaaggtgtttgatgtcgatggcggaggtgtgctgtgattctgcggtggtggtcggggcggaggcggaggcgagggcgagggcgcgcgccgggaggcggcggcgggcgggagttgagggggcagggaggtggaacgccacggcgacggctgcgggtgtggcggcggaggaggccgcgacgaggaagcggagggcgagtggtggtgaggccgggttggtggtggtggcgaagcggcacggggcggcgtcggtcgccgggaggaggagggagatggaggacgccgtgtcgctgcgcgaggcgttcgccgcgccggcgaacggggaggttgcggcggcgaggtgtgacttctacggggtgttcgacgggcacggctgctcgcacgtggcggacgcgtgcagggagcggatgcacgagctcgtcgcggaggagatgggcgccgggtcaccggcggcggcggcgcgcgagccggcgtcttggacggagacgatggagcggagcttcgcgaggatggacgccgaggtgatcgccggctgccgagccgagagcggcagctgccggtgcgaggggcagaagtgcgaccacgtggggtccaccgcggtggtggccgtcgtggaggagagccgcgtcgtcgtcgccaactgcggcgactcccgcgccgtgctctgccgcggcggcgcgcccgtgcagctatcctccgaccacaagcccgaccgccccgacgagctggagcggatcgaggcggccggcggccgcgtcatcttctgggagggcgcccgtgtcctcggcgtcctcgccatgtcgcgctccatcggcgacgcctacctgaagccctacgtcaccgccgtgccggaggtgacggtgaccggcaggtcggacttcgacgagtgcctcatcctcgccagcgacggcctctgggacgtcgtcagcaacgaggccgcgtgcgaggtggcgcagtcgtgcctccgccgcggcaggcagcggtggtgcgccgaggcggcggcggtgctgaccaagctggccctcgctcgccgcagctccgacaacatctctgtcgtcgtcgtcgatctccggcgaggcaacgccttgtagagagagtgtcacccagctgatgctgtagcatcagtactagtattgcagatattagctaagctaatggttctactaatctttttttttcatttcccttgtgttaaaaatcattttttttctcttctaattttctccctgaattaaccaagttcagtggagcacatagatcaggtgatggggttgtgcaactgctagttggtgtaaccagaatttcatctggataccaactgaaatgaaatgaatattaagcaagattatttgagaaggaagtttaaaccatgggatttttgttaggcaaatcacctttttacttattgaattactgtttctgctgtggttcagactgtaccacttggggcctgttccctttggtgctattttcaaccttaccaaattttggtaaagttgccaaaaaaaatggctatatttagtttgctgtcaaattttggtaactatataagtaatcctgcgaaaacttgccatcctatagttgccaaaacttgccatcctaattaattactctgcatcttgcaatcatgcaatcttgatgatatgattgcacgatattttcctctgccgtcccggactcaaattcaattaaaataacatctctgaattgattggggatacaaaggacaaaataaaattccagggttcatcagagaagcaccaagggaacattatcctcaattttcaattatactactgtaatttctcatgtttatgtcagtgacaagattcagaacattccaaacgaaatttaacacatcagatatttttttctgtgcgcgattcgtctggaaggagaacatctactatagtatctaatacatcttcttcatcagtcagaaaatctcaaatcacacaccaacacttgcgcggtccagctaaccctgctctgtggctgcctgcctcctgtcccagcaagaagcaagattctctcatttttctctcacgagagatctgccaatgcacagctcaacgattctcagcaatctctcaactcccttttctaaagcgaaattagtactatcaagcatcaacataggctgatgtgattagaccagaaagggattacaaaattggccactccaaacatgctaacatgctgctaaccctgatttatggacgggtttgttgctccagcagacaaagaaaatcttttgcttagccactaataaagagagtttagagagtagggtagagattgcaagcaacattggtgaatgaagtgatttggtgaggctacgagggagatgtggtggcagacatgggggtt

SEQ ID NO: 384 - DNA, 3041 bp, Oryza sativa
cttgtccgagcaacaactatggtacactatttcggaatgcataaatataccatgggtgactgaaattctaaaattttcaattgaagagcttcaaagatttcaacgaattccgctaagtttgcaaaatcaaatagaatttgaaagtttcggctggtaaaatatcctaccgggaccctccaataaaccctgaaattttgcgagttttgggaatttagttcctgtcaacagctgccagtgccacacccttcccttacctctgaaacataggaaattttgcaggatttccatgagaatttttagtggccaccacatataaagcgaagcaaaagtcacatggagcctgattttttcccccataatccgtcaaaattccaagcactttgtacttttttgctgctggaattccagggcacagcacatcgatctggcccttgggcgattgacaattttgcgccacatagcagcagcagataaggttttggaacggctgctacacgtacgaaccaaaaggatgaccaagaaggagaatttgaagatttttttatagtattaattatgattgttgatcgaattcgtcaatggcaaaatcggcctggctctggctggctggctgctaattcattccagaaggtagccaggaatttggaggtaggactagcatttacatgaattttcttgaactgaagaacaatcatatcttgaggtcaatattgaagcacaagttaattaggacttcaatttaccaacttatgtgcgttctagctctatttaccaactccttgcctgtaaaggtttggagattatttggaataattaataggagtattgcttgtgttgatgtgtgtaattaacagatacttgtaatattaattctggtgtttggaacatgcgcttattgctaatgtgctacttacattcttttttttttcttactacccagtgctaaaagagtattacacgttaggtgtgtaccagtgcttcccaattactaatatacaggggaagagaagaagaaatgaagagtatatatgcttctcacttgcaaccatggaatggaattaagacacaaattcttcatgccggaaaattccacaatgcacggctctcacacccctatatatatggtcccaaagtttggtgcatactcccatctgcaacagagaaagattgtgccacagtacaaactacctcattctccatcaggtgcacaatagaagaaactaaggtaagcactacattggcacccattcacccaagatccctatttctctcttccaaatcttcctctagcatgaagataagattgtacttatgataacgaattatctttttatttatacacatgaatatttagattctcaaagtgatggcggggatcaccggatctcgagcactcatggtggtggcgctcctctgcgctgccgcggccatgactgctgcacaagaagcatccaacgtgcgagccacgtatcattattacaacccacaacagaacaactgggacctgaacaaagtgagcgcatattgtgccacatgggatgccaacaaaccgttgtcttggcgccagaagtatggatggaccgccttctgtggacctgctggtcctaggggccgagactcgtgtggcaagtgtatccaggtattaaaattttcttcacattgacaaccgatttgtacttcaacattaaactgagtcgcttaaggatggtgtgctaaatttgtaggtgaagaaccggggaacaggtgcgacaataattgcgaggattgttgaccaatgcagcaatggtgggttggatctggactacgagaccatcttcaagaagatcgacacagatggtcgtggctaccagatgggtcacctccaggtcgattacaagttcgtcaattgttgatttggtcatgcctctttgcatgatcatatactggaataagaaatatatggtgttatacaataagatggaagaggttggcactctgtaatcatgctgaataatgaataaacgaaattacagttcaacaaagattgtttcatatccttaaatttccatccccctgccctgttatttcatattttcgcactattgcgaaggccaagcgccagcatgtgaaatttcaatttatcgtggaattgatgcaacccacgaacaaacatatacacacactttaatgccccaagtttaagggctcgttcggtttagctaaaattggatgatggattatggattacggaggagatcaggtcctgttctaaacagatgatggactctaggtttatgataattattcaatggcacatacgaatgaattaaatcttgaaaagttgaaatgttgctttaaaaaaggtattatcagaaatgtagatgaagtaggttaattcagaaaaatcatatcgtttacaagcttgggaaggttgtgcgggataatccataattcatcacctatagcaaatgcacattaggtttttcaattaggcttccaaaaaatgcggtctccctaaactttttcaatcatcaattcatcataccttaggtttttttttcaaaatattgattatctttatatcctataatatttaattaaaccctataagagagataattcatcatccaccatttaatctgtttcatcacaagttttaggtccgttccaactaaaccttgtgacctaggaaatcaataagataatcctcacgtttgtgtccaaatagatatgcgtttatgtccaattagacatgcgtcgagttcatgccttcatggtgatttatcgtaagaactagtgatgttgagtgggcacacggacaaatacaaattgaccgactctaatttaactaaaatatatatcatcacattataaactagcaacaataatgtacatttttggatgcgaaataggacccccacgcactcgcatcctagtgaggatgaatcatttcagctttcgaaacataaacaaaaatgatgggcgagtaccatatggtcaggaagcacatgaggtcgtctgtcatacgaccagcaggagatatctgaatatctgaaagtcac

SEQ ID NO: 385 - DNA, 3517 bp, Oryza sativa
ggtatttaaaaatgctgataaaattatactaacagtattttttttaattcattctaaatatttaaaaggacattaatatcgaaaacttttaaagtttgccattaaacacatctaaactgcaatgagattccattaaagtcaacagtatagttgttccttcaacatatatagcagattgttaaagtaggaaaacactttccagaaattcagtaaaccactgagaagttcatttggaatatctgaattaatataattgaattaaactgaaatgttacaataaccctctttttgacagcgacacaataaataaaggttagttttaaaatattaacagcaagaggaccaacagggcaacaggacagagggcccaaaaccaagcaggatcaattgataacattttggttaaattttcattataaactgttggatctagcagtcaaatttgaggttaaaaaacaatatatacatgaatacccagaatccaccacatctctttaatagtacctacatatactgctgaactgaagacatgaatacctttctttctctatggtgacctacagaatgtggcacagatgtagcagtgccacagatgtaacagttattcaacttgaacaattcaagttaaacctgggaccaaattaaaatctccggccatgctgcaaatacaccccttgtacttccaacacaatctcaacaataactgttctttcaatgcagccaattgttgttgcaaacttgcagttaattgttcatgcatctctgcatgcattgccctaaaggaaagataattaagttgcccagtgccagatgcacaatggcaagaattgcagatctgagaaaacagagagaacaatcatcaacttttaacggcacatttactaacaatctgcaaagccggtgcctgattgaactggtagctcagctgatcactactatctactacctagctagtcgcagtttaatttaacacaccatctacctagttgcaatttaatttactctctcctgcatatgccaaatgcttctgttgcacttgcatggatatgaacataatattgcatgtagctttgcatgcatatgctcttcttgatcactatataaacccatcactgcctctcttcttgctcatctcccaatccactacttcttgctgatcatcatatatctcttgtgagcttcagcaatgggggctctgccaagggctctagtcctcggcgtttgcgccgccgtcttgctggtgaacgtgctcgccgttgccgccgacggcgacgccgcggcggcggcgtccatggtcgtcggattggccaagtgcgccgactgcaccaggaagaacatgaaagctgaggccgttttcaagggtatgttgatatcataaataatcacgcaatatggtccaattaatcattgtcatttatttaaactactacctgaaaaatgcttgttctaagttctcataaatgcaagacgtttttggttgtcctaagtcaattttttttaaattaaaccaaatttatattaaaaatatatatcgcaatatttatgacaccaaattaatttcattaaatctatcattgaatatattcttttatattgtgtatatattttgtgttgaaaatgctgctgcatttttattcttgattttgttcaggtgttcgcgtggcgatcaagtgcaagaacagcaacggcgagtacgagacgaaggccaccggcgaggtcggcaagtctggcgcgttcgccgtgcccctcgcggcggacctcctcggcgacgacggcgagctgaggcagcaatgcttcgcgcagctgcacagcgcggcgtcgaaccagccatgccccgggcaggagccgtcgtggatcgtcaacgccgccgccgacaagaagaagaccttcgtcgccgtcgccggcgacacccacttcccgtcgtcggagtgcgcgtcggcgttcctctgcgacccgttccacaagaaggacttcttcttccactacaagaacccgtcgccgccagcgccggcggcgtaccacaagccgccgccgtcgtacacgcacccggcgccgccggtgtactcctacccgacgccggcgtactctcacccgacgccggtgtacaagcagccgctgccgacgccgtcgccgccgatctaccacccgccggcggaggagaagaaggtggcgatgcaggacgacgcggaggctgaccccgagctgttcaagaagctgctgccattgatcaagaagaatccattcctcaagttccccaagctcccgcctgtggaggtggaggcaaagccatagatggtcgccggcttcgccgcggcgccatgatcgatcgatcgaagcgaggaaacatgagtactagctggtttaattgcttcgtttctttgtgtgtttttcacaccggctactcgagctagttaattactgcccttctagcgttgttgaagcttggtctgttgcctgcctgctagcttaactattcagatataaataaaagcttctgttctctatgatgtgattacatgtttgccggattgaatggatacctagctactagcttagctagcttaattaattttattggatgcatactaaaatcttgcattttttccatacaaatatttacttcctcgtttcatattataagacgctttgattttctttatttttaagtaaagtgtacgaccggtcacttagcttgtatcacgtgtcatctagaacttgtgtcactgtgtcatctagatccccgaactctaaaaatgctaattcaggtcccataacttgctaaagtgtgtcattctggtccaagatggctacggaccattatagcatgctatgtgacactggtgtggcataccacacggatgctgatgtggcatgccacttctgcttgtccaactaaagaagagggaaaaaaagagagagaagaaagggaaagaagagaggaaaatggaaaaaagaaaaaggagaaaaggaaagaaaacttttccaagtgggccccagttgtcagtcaatatagagatattgctggtgccacgtcagcatttgtggggattttggattatttatcactctcttcgatggtgcattctcaaatgccatcattcccattaactttgattatttgccattgtgacctaccaagttgtttctattttaccattttttaactaacaactcagcaaaacgatgagaaaatgaccacattgcccctctcattcatcttccttctaccatcttcctctccgacatggcatgaaccagtctccaacatgggacaagccaagcagtagggacaactattgccatgaatgagctggggcagcaggacgagcaatggatgtgacgatgcttgatggttcgccgttgggtcgtcggggcgaaggcaatacatctcggttgcaggccctctacctcgcataaatcttgtgaacttgagagaagcaacgcaaatggaggtggggcacccgggggggaggtgtcagggttatggataccacatacctaatagtagttgactaaa

SEQ ID NO: 386 - DNA, 3826 bp, Oryza sativa
caagcatgtgatacatctctccatttcgcactaacttcgcccctacctccatgtacatggatgctcatggcagcatgagatgctaacacttggtggcggttggtcgtgctagttctgcttccttctcccggcatccgcagctacaactggatcagataacatcatataacaatcacggcgtcatgtctggatctaacgctacttcaactttgctgctcaaggtgttaggaatggatgagatttgctccggtccaacgaaaagtatctcgagttactggtacctcacggtaccaaatcatttccaattgttagatctaacaatacacattatgtctaactagatttaatgatcagaaataatttggtaccgtgaggtaccgatacctcgagatattttttttattggatcggagtaaatgagaacagagggagtactccactcgttaagatttattttccataacgcagggattaataaggacagtggttaggagtaaaagataagctacccacagtgccactagtaatgcaccgacctacgtttaatttcatattaacgtactacgtgtttctttctcttcgatacaaagttgagttacgcttatgcatgcattgcacacgaatacttagtacacgaataggctcgatcaggaatgtaaaatactaaaatctgcacaaaatttactttattgtttaattactgtcccggcaatgttagacaaaaacaaaactcagtagttactctttttttaataaaagggagcttggtgcaaggagtgctagatcgatcaggctacagggagagaatcaaataatgtaggtaaaatgatcaggttaggtacgtttatttgtggtataatattattgggagtaaaaacataacaacttgttaggtaaactgatattttcatacctactacacaatagtcagttcatataaattgaactatatcaaaaaaaaaaaagcaccattcatcctttaccacgaaaatatgtaacattaactgcatatatcaatatactgtttacagacaactcgctggctctgttagagataagatccccagacaactcgctatgatcagaattgacacctgaaatttctcgaccaggaaaatagttaagcagggcaggaaaccccaggattatccatcaaccaaccaactaggtgcttgcttcagattttcatcagtacatcatctctaatcatccaggtaaaagacaagatcttgtcacgtgatcatggccccatgacacagtattatcatagctactatccaactgacaattgactaacaaatcatagtcactcactgtctgctactgaaagccttcctgtatttaaagccatggatatctgatgatgaactgcataagagatcatttgcattaatttcagagatagagtgagtgatcagttgagtgttgttgcataaacatggctgcctctgtcatggcttctctggctctgaaaccatctgcatctccattactagaacgttcgaagcttcgagggaaagggacaatggcaaggccatctttgatcatagtggccaagaaagcaaagaagattcagacatcccagccctatggtcagtacatgctgtaaaattcagagttaatatattagcaactggcttaaacatgaaatggaaaatgggtttctcagtttcatgggtaccaatgagtgtctcctggttatcttattttttacatgcaaaggtgataaatggtagtgaatagaactgtgattgttaccattcatttttctctaaattagtttaccttctcacaaagttatggtatgccaccatctagggcctgctggaggagtggtgttcaaggaaggtgttgatgcatctggaagggtagccaaggtcagtataaggctataagctcagacaagcatatatatcagacaaaatggttatttttcaccattaaatttttcaaatttaatcagggaaagggtctttaccagttttccaacaagtatggagcaaatgttgatgggtacaggtaaatgttaccgatccaatgaagaacaatatatttgagatccatgcacaaataataatatatagtaactcataaaaatattagtttcaaagtaaaaatgggataaagcatgtgaatgaataaaaggagaaatttacagatctagatgagggagatgaaaagagaaacacctatttattatctgtaaaaacagtgaaatccatagcttatccatgacattttgttgcttctaccgtgttacagcccaatatataccccagaagaatggtcttcaactggtgatgtctatgttggaggtaagcaaaaaaaaggactcgagaaacaagaattttaacactgcgcactgcttatttaaatttctcatgagatgtttattgttctcacaaattttgtacttacaaaatttcttgattttcccaggaaaggcaggtttacttctctgggcaatcactcttgctggaattctagttggcggcgctattcttgtctacaacactagtgcactggcttagctaagtgcagcagaccaagctgtgcctgcttccatgtatataatcttcactaggaatgtaaccagttatgtacctggactggacttgactgccagcggtggtaatgaataaggccgagtaatgttaattctaagttatgcaacgatgttttagtgagcaacatagtgttcttgggctctagggacaaataattttgagttcaacagagttggcacctgttggatcataagagttaaatcagttgaacagcttattctgaaaaattggaaaataaagttttggtagcgtaccgatccccatggagtgcaagtaaatcttcatcatcgaaatatccccaaggattacatgtcattctccagtattacaataatagtaataataaattaggtgctataaaacatactctgcatcagtgaaagtacaaaaccacaaaagcatattaacaatgtcttagtaaaatattttctgatttaacaacacctaataagataaatgttctttcagataataagaatgatatccagcatatccacaaaaaggatggctatcaccttcaaaaaaaaaaaggatggctatccaggatgcatgccttaagaatctaaatttccatcataatagaagagggtttgcaccataaaacttattaccctcttaaataagattatctatgtgagaatcagattactttacaatgattaagactttatccctatatgcaaaaatctcacagaaattaatatatgttctttcagacagaaatgaaaatgatcttcagaacttaaagaacggtgttgataggcgggaagcatttgactcgctttgtttcatagtatgttggcttatctatgtgagaattgaagagtgttcgatcagtaatcatgcttgtcgacacagctctttggaggggtcaaggaggagctcatgatctggaaggaagcaggcctgtttccttttcaggatgagtagcttgtaattgtggggtttcctgtgcttcttccgttttcgacagcatcctgtcgatgtacagttgccaacatgtacagttcctgtttctttttgtcccaaaacttaatacaattggttggcctcttcttcggccaacccggctaaaataatcttcagaacttaactcagtgaaactgacacacaaagaacgaaagaaatttcccaataaggggaacagatatgaatgcacttggtgaaattgactcacgaagaacaaaacgaaatttctcaatcagtggaacaagtaagaaaattctcaggattatccactcagcgctagacgtttcctt

SEQ ID NO: 387 - DNA, 7366 bp, Oryza sativa
tggtagtagtaagttgattagagtaataaacgcgcagtgtgtcaaaatgtatcaagtgaccttcgttgcatctacgtactccattaatcaacacgctgcgtatgcgtgtgagactgacagagatcaaggtcctcttcttatatacacttctcttagcacacatttcaaacggttaaatagtatattttattaaaaaaaaactttctatacacacgttagtttaacatatcaaacaaatttattttccaagttttaaaaaaattaaaacatactctctccatcttgaaatatatagctacttcaatcacagtaatttattacaaaataaagctatttttttcacctaccctctcctatcaatcaattataaccattttctatttaattacctcacgcacattcttttctcagcaaatcacaaacttcctcaaatatcatttttaccaactttcttaatactcgtgtccacctaaaaaatatctacattttggaaggagtagtatatactagtaatatctacgggcctgttcactttaatgaaaaaaaatcttaccaaattttggcaggatttcttatatagttaccaaaatttggcagcaaactaaatgtagatatttttttgacaactttattaaaactcggtaaggttgaaaatgacatcaaagtgaacaggccctatatttttgttttacgtgccctgagctaatctcgaaggcgacctaagttattgggttgattagcaagggaggaggttgatgaggaattgaccgtgtcaaatgtcaaacacacggacgaaattaatcgaagaaggaagcgactagtgtattactccagcacaagtggtccggtcgccgtgaccgcgtctgcaaccgcaaccgcaacatgacacgcgctttgcgccgcaccacctttgcgacccggcccaacatgactcgtccggtccggtctggtccagtccgacccgaaccacccccccccccccccccccgggcgcgtctccttcgcggcgtcgcgactcgcgagaaacagaaagagaagagagagagatcccctctcgcctcgcctcctccctcctgcctcctcgatcccgatctctcctcctccgccgcctcgccgccgccgccgtggacgcctcaaggtcagcaacgcactctctatctcgtattctcgtggccgcaatccacggcaccggcccgccttgcgctcgagtaggtagaggtatacctcgtcgtcgtcgtcctcctcctcctccacctagggtttgaccatgccgcgccgcaccgcaccgcggcggggcgcttcgtatgctgctaggcctctgcgctgcgacgtgcgggctgcgaattccgccccccggatctccgcccggcgctgcgaccaccagcaccaccgccatttctgccctcgattcctcatcggctgctcacctcgtctcctaccgctaaccccgaccgtgcaatccatccccctgttttgtatgctgccgctgccgtcgcaggaatcttcttcttatcaagggggcggccttcaaagcttcttatggctttcctaatgcgtccgtctaacagatttatttcaactcgctctgcttgctcgtttctcatgcattattaccttgccatttctgttctatgtgaaggattactagtattattgcttccttcgttttacacttttactagatgttcctgcttcaaatggcaagctataattgtttgtactcagtctgctattctgctgcgagaatgtttgtttgatttctgttccttcatcatgcaccacgggaagtcttatttcagtatccattttagttcagttccattgggcatttccccttcgccttgggctctcttgctgggttctctaattctatcgattgaactaggtgcctatctccacgcaaattgagcggcacgccttggcttactactgatattttatgattgagtacagcatgtactgcaggcgattaaggtagttgagctaaaatggaaagatgacaaaaagcagaaatcacaaaatattcttttgtactattccaatttattcgtcaatttgccgcgtttcttgctgattctctgttggcgcgcaagctattccaaagcatttcctttctggaaccaactcactacgtcatgcaaacccatttgtgccaatcatgcagataacgcctagtattgatgagcggttgcactgaacccacattgtgccatcattattataccaccaaacacattaatttaaatatatagtatgccaaccaagatgtgcagatgcacagtgatagtacattaaaaggagacaaatatgcaggtgaaagaacacatcttatgcttcttccttctaccttagctgtgttggaaacttggaatagtatgtacggtacccatgtcagggattgtaattcttcgctaaatcacatactaagtactaacgtacacaactgcatattgcgtcactgacatatatcgatgaccttgtatattgaatggtttgagctcatgtattcttacccttgcacatgtggattcttaaacagggctgatggaaaatttctccccgagaaccctgctcaatagtatcttgcgtatcactgtcttaacctccgatggctctactgcaaggcccaagcccattcagaagtactgccaaaatgtgtgtgatatctcaagcattgtgagccctctcatagaggatctatgtgagtctcctgaagagcaactcaatgaggtgttaagggagcttggcactgctattaacagagcttcagggcttattgggaactggcaacagacaaccagcaaaatatattttgtacgtactcatgagctgaatttgatatgttcactttcacttattcaccctaccttaataagttactgaagtattgtcaatcactatttccacctctctatgctttatcttttaaaagattttagtttcatgtttatcagtccattgttgggttggcatttaggttagcagacaacctatcacacaagttccgttaattgatactgtattcaaaagatgatggacgttgccttcatgaattcagaggccttgaaatataaaaactattggaactgctgggggcaatgcacgcattattgattgaaatgttgcaaggttcttggggtgtacctgcctagtccgtacctgtgatggtccatttcttgctttggatatagctcccgttcttgtgctaaagtcatatgatgttcgttatacgggagcttgcacaagttgtactttccgtgatttgtttcgtgactcttctactttatcccccttttttgttggtggttcaatcttacgtgtcgcacgttatacacgtacttttgtcagtgatattgagtttagtcttgagagagtgcatgttgctttaagcgaaatttgattatgatcactggctcaagcaattacttcgtttaaatgttacattttgttttctttgcccatcataatgtatagcccattagctaacttaagcttgacaaatgacatagaagctaatgctactactcaaatattaccgttctgatccagtaatctttaactaccttgaacagatatggcagattgaatcagtaatctcagatatccagggatgttctctacagctgtgccagcttgttaactctctattaccttctttgactggccgtgcatgcacatgtattgaggtaatgcttcactcagtcatttctctactatgttagtttttaactattgtcaatttcagaccttagttgctgttctggatccagctcatctttatttctttttgtatttcatgtagaaactccaagacataaattatgaaaacatgtttgatctggtaaaggagtcttcattggagctagttgagacggacacaacaagtcctgagaatctgtcgagactatctagttcattgagtttgtcaactaacctggaattttacatggaagctgtttcccttgagaatctcagagcaagggcaatgcggagtgagaaccgtgaagaaatggatctggctgacaagatgatccccctggtcaactatatgcatgaccaccttctgagggaaacacaactgcttagcatcaatggggtgcccattcctgcagatttttgctgcccgctgtccctagagctgatgtcagatcctgttattgtagcatctggtcagacatatgagcgggtttatatcaagttatggcttgatgagggttttactatctgcccgaagacacgccaaagacttggtcactccaatttaattccaaattacaccgtgaaagctttgatagctaattggtgcgaatcacacaacattaggcttcctgatcctatgaaatccttgaaattgaacttccctttggctgcgtctgctctccaggattcgagcaccacaggaagcagccctctacatcctactgtcgctgctaagggtaatattcctgggtccccggaagctgacctttatatgagaagcttgaatagagcatctcctccacacagtgtagtccatcagaattctcatgcgcatgtgaaccgtgctggtcatgaagcctccattaagcaatcttcagaaaatgctaatggttctgcatcagatgtttcaaggttatctcttgcaggttctgaaacaagagagtctagtctggaagaaagaaatgctggttctatcggtcaaacttcagaacagtcaattgaggaagcatttcaagcatctaatttggacagggattcacatgaccatgtgggtagttcttcggtgaatggtagccttccaaatagcggtcaacttgatgcagaatgtgacaatgggccaagcgaaaggacaaattacagtagtgatgcatctggagaagttacagatgggccttcagcatcttctgctcctcagagggagcatctaatcccttctagattggctgatgttcgtagtagaggccaatttgttcggcgaccatctgaaaggggtttccccagaataatatcttcctcatccatggatacacggagtgatctttccgccatcgagaatcaggtccgcaagttagttgatgatttaagaagtgattctgtagatgttcaaagatcagcgacatcagatatccgccttttagctaagcacaacatggagaacaggatcatcattgcaaactgtggagctataaacttgctggttggtcttcttcattcgccagattccaaaacccaagagcatgccgtgacagcccttctgaatttgtcaatcaatgataataataagattgccattgcaaatgctgatgctgttgaccccctcatccatgtccttgagactgggaaccctgaagccaaggagaattcagcggctacattattcagtctctcggttattgaagaaaacaaagtgaggattggaagatccggtgccatcaaacctctcgtcgacctactaggaaatgggacccctcgaggaaagaaagatgcagctactgcattgtttaatttatccatattacatgagaacaaggcgcgtattgtgcaggctgacgctgtgaagtacctagttgaacttatggaccctgctgctggaatggttgacaaagctgtggctgttttggcaaaccttgctaccataccagaagggaggacagcaattggtcaagcgcgtggtattccagcccttgttgaagttgttgaactcggttcagcaagggggaaggaaaatgcggctgcagcattgcttcagctatgtacaaacagcagcagattttgcagtatagttcttcaagagggtgctgtgcctcctctagttgcattgtcacagtcaggcacgccacgggcaagagagaaggttagccatttctcatcatttcctctttcaattagaaatgcagctaagcacatcctgaacatttatgcgaaagccagacattttagtcacaatgttttgaacatgctgcttggtcttacaggcacaggctcttctcagctactttcgcagccaaaggcacgggaattcagcaaggagatgaccttctcagaattttttgtaggtatacattaagcatctcctctgattccttcaggcatcggcttggctcctcatattgttgttgttggctcttgggtggccctatgtattgtttatagtcaaattgagattgtgctcatgtcatacaaatgttgtgagcgatgggttgggtgtttgttgttgagatggtgtaacttttggttctcttttcttttttgaaggatatctttgttcttgtataggttgtccattggtagcaacttacctattcaatgggattttgctttgtatatgctattaaccctgacattatgattgttttgaatggttgtaaaattcgatattgccctgcatgttgtaccagataacaaagcttcatctgctccgatgcttttcgtcatggcgacccttgaaatcgggatatgagaatttcatggcagtcctgagataattataattacagtctaacgcaataaggccgtgtttagttcccccaaatttctaactttccatcacatcgaaaactttcctacacacaaactatcaactttttcttcaaactaccaactttctccaacttttcaactttttcatcatctaaacacaagcttaacatcattttgcaacgtgctcctagtatgtggtatccccataaaaccagattgatcaactacacaggaaagtttgtattcctgttccaaccaaaatatctactactcttctgaacaactactacttatctagacgtatagccagaaatggctatgccgatttatcattaacacattctgatcccactttgtcatcatctattgcatgccaatcatctattctttttcgatttacatacaagtttatagttttggctaccatatttctgatgaatctctcccaagaaagggcaaaaaaaaaaagaaggttaaactagaaattaattaatgagatgagctaattatctcgagaagtcaagatgatccatcacaaaccaagaaagtcctcttgggtgtgctcacaagcttcttcttctgctgcctctgccactgcaagtgggccccaatcaacccccctcctcctaccctacggcctagccctagcttcgtcacctccatgccgccatggccgatcggcaacaccatcgacctgcccttccctaccacctgcccatagctgcaaaccctactgccatcgccatggccagacctcgagctccagctcgtcctctcttcttggaagacgttggtgaccacgacgatggcacccatggggtccacgtccacggccccgagcacctcgccgcagcgctccacgccggcgtccacgacggcgaagtcgacgcggcgcagccgccggacg

SEQ ID NO: 388 - DNA, 6148 bp, Oryza sativa
tatctagagggttatttgtgtatatatagtaatcttaataaaagaactcaaaggctaaattgcacttgttgatattgtcaacaagatattcgagcatgagggtttatatctttaagttctattcatcgagaaataaatcaataaaatcgtgtacatattattggcttgcatgcgatatattccatgtggcttaaggtcaaaattgatcaatttttttggtacgatgtacaatatcttgtatgatgtgtgatatattttgcgtggctcaaggtcaaatttgatcgatcctcaagattttttgttatgatgcacaatatctcgtatgacacgttttttccccaataaaaatataaacttgtaagtattatgttggcatccttggaatagtttcatagtatgacaaaaattcgggcaactttgctagtctagtctacttatgaagtgtgaactaacctatcattattctcttttgccacttatgttcctttttctcataaaagaattgcccccatattttctaaattactagtagttttttttgggacattgcacccatctttagtattactacctccgtctaaaaatataagaaattaagataagatgagacacattgtattactacgaatctaatcagggaaaccgtctagattcatagtagtaaaatatgtcccatcatttttgaaaaagagggagcagaagaaaaggggcatagtgtccatcgtgtaccctccattggacgcatgtccagattcatacttagaattattattattattttttaaaaaagagagtatataccaaacaaaacaagaaaaaaaaaagctatttctaagagataacaatgtcatcacctctcatgtcttggggcccatccatccatcaattcagaagtcacaagccaaataataatatccaaggaaaaaagagaggagggaccaatctacaatttcaagaacctcacagggctgtatccgaaaaactcccccgatcgaataacaaccaccaccacaccctgagcccgcggcctcactgccatcgagaggtcgtcgtcgtcgtcgtcgatcacctcgtcgtcgacgcaccaccaaagcaaaggcaaaccaaaactcctctcctcctcctcgtcttcgccgcctgcgcgcgtcgccgtcgcgtccagccggggcggagggagggggggttcttgaggatggtggaggtgggaggaggagcggcggaggcggcggcggggaggaggtggcggctggcggacgagaggtgcgacctgcgcgcggcggagacggagtacgtgaggcggttccaccgccacgagccccgcgaccaccagtgctcctccgccgtcgccaagcacatcaaggcccccgtccacctggtgaccttctgcagcttcccctgaatccatcgctgcttcggtttcttggtttgtttattcttggggctctcttctttaatttctcgatcaggaaggatgccaacaaatcgaaaagcttaatttggaggctttcttgttctgcttttcttttttttcttcttgttcccctttctgattagtgtgcggcaattgatcgaaacagttttatatacgcgatgcttgcgattgatttctgtttcttgcaacaatcgtggagctgttcttggattgggcatgctactttgctggatttgctctgcaggaagaagaatgcgcagatgattgatcgcaatgatatgatggctagtacgaaaatcgcacggatttttaattctgcctttcgtaccgccatctcacgtgggaagatgcttccccccacctcgagatcccggctttatctgatttgttttttgtttgattatttttggatttctggatgttcttgcattggtttctacttactactttattaacctttttcttagttgtacctttattctcttaataagtaatactcctgcaaagaaatggtagagatacccttgagttggattccactcctttcgatatctattgagtggttctaagaagattgggttgaaatttagctttcttttttgcgttttgttttgtttttttgttttttttttttttttgcagaatcatgtgatgcctgtgacactgagagttaatcaaatgatataaagttatcatttttgtcaattaccagcaacagtaataatcagcatattcttaaaggatgcctaattccaactccaaataggagtatatttctatagagatcattggcattctctagagtctagcctctgtttctccatttagaaattctccatttagaaattgtgtgtctctgattaaaagagctgtcctattcaatctgtcttgaatgaaacttttgcaccatccttgccagcctcttcagttaatttctgttttttctttcaactgttcattgataggacagcctgaatgatctagcacagttgggatctttatgcaagaacatttaatatcaactgccctgtttgttgaaagattattaatttctacatattttttttgcctaatatacttttgtgtagtcaaccaaactgcagctaattgaatttgtggcaaccaaacctgcaggtttggtctctggtgaggcgttttgatcagccacagcttttcaagccatttgtgagccggtgtgagatgaaagggaacattgagattggcagtgtaagggaggttaatgttaagtctggcctgcctgccacaagaagcactgagaggctggagctgttagatgacaatgagcacatactcagtgtcaggttcgtgggaggtgatcataggctcaaggtatgtttccatgttgatcaaccgttaataatcttgtaattaatttgctgttcagatgttacatgttactatggatcagacatgttaataactgatatcttacatgtgactattgtgcatttttcgattttcctttttctgtttaggattgaaacttccttgattactaaggaagcagtaatcatctgttctccagatttctaatcaagattcacatagtaccttctaactgaacttcagatgggcactagagattttatcagctacagcagcttcctgaattttcagattttgttgacaattagagcatttcatacccttgcagcagctgctgcatttttttatgccaaattagtactccctccgtttcgaaatgtttgacaccgttgactttttagcacatgtttgaccattcgtcttattcaaaaacttttatgagatatgtaaaattatatgcctatataaaaatatatttaacaatgaatcaaatgataggaaaagaattaataattacttaaattttttgaataagacgaacggtcaaacatgtgataaaaagtcaacggcgtcaaacatttcgaaacggagggagtatactttaaccattggttactagaaccttatctgcagcttggtgctgcaacatattctgcatgatctgtcatcttaaaccattttactatctcagtgctttgcatagtcaaaccgtatgcacatgacgggttgattccactgattagagtaatagactctcttgctttgaaaaagaaaaggtttttgctggatacactgtccctggactagcaaacagagcacacttgaaacaatagacaggtgtacttttttgtcatctgttctgctcatgtcctgttcagttattgacaacaaggaacatgcacgctaatgcgcttacaatgatgaggttaatccgtaatttgttattttattagtgctctaattcatgcctccccactggccatgataatggactgtgggggagatatttcctgctggtctgcgcaacctgaatttttcaattgtcacatcttcaacgaacttttgtcgtctaaccacaaaacaagctattggttgtattgtattcccttggccatatgaactaacagcatggccctgactggccatttctttgaccttacctgccgaattcgttgcatgaggatctgtcacttgtttcaaaacaaaaattaaatagaaaatccaagaaataccattgataaacacccaaatccaagaaatgccatcaatgagtgcgagttctataaaatgccatcgtacaagcgattttgtcctagaaataccattgtcgttagggttccatccatcccacgccgttaacggaaccttaacggcgatggtatttctgggacaaaatcgtttgtacgatgatatttcatggaactagtagacatttcttgaaattggatgcttgtcaatggtatttttttggactttctcaaaattaaaacaaaataaaaaaatgagaggatctgtcacttgttccaaaacatttttttttaaaaaaaaggatctgtcacttgttttggcatggactcatggtccattatccgtttgctttgctcagcggcgatgctggcacaaatggcctcacatgcactgcatctggataatggaaaccacttgtccgaatccgagggagaaccttatctctgcctcttggtgttagctcaaggacactgaacttgtgagctgaataaactgatcttattgtcatttcttttttccttctttccacagaattactcctccatcctgaccgtccacccggaggtgatcgacggccggcccgggacgctggtgatcgagtcgttcgtcgtcgacgtcccggaggggaacaccaaggatgagacatgctacttcgtggaggccctgctgaaatgcaacctgaaatctcttgcagaggtttctgaacgcctggttgtcaaggaccaaaccgagcccctcgaccggtgattgttgccaagattccaagagctattttgtgttgcaaatgcttaattagattgtgcagagttgctattctccaatggagcccttaggttctttttcttcttgttgttgttgaatggttcatgagagacttgtgagagagtgctgctgctactgctgtgctatgttcaaaccaaaagagaagaaaaaaaaatattgtgcctcctctttgagcctctgttgctgttctttaccaccctagtatgtcacaagggcctaaaaaaaatattgtgtgtttcgttagtgttgaagtacagggattattagaaccatataagggcctaaatgccagccggtttcgaggcttggagggctctctgtaattagttttgcctttagttcaattgccaccttaatgtaaatttacttctctagatctctatcatggttaagagagagcttgaaatactgtagctgctgagcttgatcaattgtttctggctcatttaacttgtagctcaacaaattaagagctctgatgcatagtcaaatccaaagtggttggcacaaaagtcgcctagaagtaattaagggggtacagtaatcacttgtaatgtgaaagggagaggcataatatgatcaacggttagcaacgcaaaagctctccgctgttgacattaattaatataatgaaatcctcgaagaagttgggaaatggtcgatatcaaggtgagcgttacacatggctcactgcatccgcatgtctttgtttaatgtctaatcatggttatttcccgtttgttgtttagtggtgtaagtggtcacctcagtgtgaaggaagcgtgaaattagtcctattggttatctgtgtatgcaaggtcaactactcaactgctagctacctctaatacgttgttttttttttgtttttttgaaaagaaggcaagaagtttgtcttatatattgatagagaagaagagttcataggtacaaaggaattgggagttagggtcattccggaccaaggaaaggaagatgactactcacacaaccagtaaatctcagttaggcaactcaccccgccattacccatatatgcgcttcctcctttactttatttttgccatgatggaggttggagtgtttcccagatttttgaagattcttgagtttctctccttccacagttcccatgcaactagaatagttatcgacttgagggctttctttggcatattttgcatggaggtgacttccatccacacctctaatacgttgtgaagtgcttctagatccttagtaggttttgatgataaatgacaatgtaattagaggatatatcatgttgaatgagattagtgtaggtattcatcctatgtgcttaataatctaaaaaga

SEQ ID NO: 389 - DNA, 4767 bp, Oryza sativa
aagtttggttgaaattagaacgatgtgatggaaaagttgaaagtttatgtgtgtatgaaagttttgatgtgatagaaaagtcggaagtttgaaaaaatattttgaaactaaacacggcctatgtatatgaagtccacgtgatccaattttcaagcaaatcgatgataataagctgttggtaaacaaatgaagcaataatataggtaaaagtatatctctgtgcttaacaattgaaaagataatgatgtaaaataaaaccacaatattaaaatattaaaaacataattttaaattttgcctgtgactaataataactcaactggtaaacgatgagtctatacaaattgagtaaattttgatgggcaaatgtctaagggcttgtttgaaatgcaaaatagaaaaaaacgtaggaataaaaaaagtatatgaatatgataggattgtatatgtaaaatagaggaatgaaaacatataaattttttgctctccgtgcgcaaaattcttacaacaaatagactagagtggattttttctttggaaacatgggcagggaatagtattcctctggattcaaggtagcaagccctttgaaacgaatatatgtacattatccaatttaaaggaatcatcaatccttccacactcttctcttgtttggtgtgtttaacttgtcttgaactacactctcttttgaagtggatctttgcaataattggctgtagttctttttaacaaaggccaggatattatattccgttataaaaaaaaatcaatccttccacacatttcctctatttcaaatgagccctaaaattgcatgctcacgaaactggagagaagtttaaattgtgtaactcctacgcctacgcatcctatctctgttgccaagcgtgtggtcgccacctcacacggacacgcatccgttccgttccgttcccccgggtttccggtctcctccccctacctcgggatcgtctcgggtgtgcgcgtgcgcccacaaaaacgccgcacgcacccacgcacgcacgcaagcaaagcaaacgcgacagcttcgcctcgtctctcccccccgagtccccaacccctcctcctcctcctcttccccttccccgcgccgcggcgagatcgctccccccgggggcagcagctagatcccgatggcttcgcgccgccgcaccctcctcaaggtcatcatcctcggcgacagcgggtgagcgattcggatctcccccccacctccccatctcagtccgcggccgtttttttttcttgggcttcggtttatcgctgacttggtttcgttgcgatctagggttgggaagacgtccctgatgaaccagtatccttcgattcggataggggatggcggatgatatagcccgcgtcgtttcacgaacacgggcgggtttttttttcttcttcgatttatttgggggttttgttttcttgagctgtgatttaattcagatatgtgaacaagaagttcagcaaccagtacaaggctacgattggcgcggatttcctcaccaaggaggttcagttcgaggataggctcttcactttgcaagtaagatatttcttttcccccgcactggttcttctcctcatcgcgccgagattaattaggtccgttcatgggaagcgaatttgtatgagcttgattagttacttaactgctccactccgagctcaatgtagagaagatgtttctagctgtttacttctgaaatgtttgtttgtacatgcatcattgacttgaagtttgcacgactgattgagtctcaatatggtctataactctaaactctacggttttggtttatttagatgttgtgatttaaattttcaagatcgaattgcgtggcattaattgattgaacaatgagcaggcaccttttccattaatttcgtggtttcatggattgattgaagtacttgaatttagtcttttttgcttatgtaaattggtattttggctggaaacaatgtacaaccagttattttgcatgatggaaataatggcaggaaaagttattgtcattttaagaatttattcactttatgctttgtcagagaatagaaatcaagtgccagcctagttcctactttcttctgtccgatactttgcaaggttataaaaagtacttccgttatgtcttttggaattaccacacatgtttttgtgccccaagcctgctctttaccaatcctaaagctcttgctcctgcttaagtaacaaactacatcattttcagattagttctgcgtattctaatggactaaacatctcttctaggtacctactgcatgtttatgttgcttcttatctctatttagagcatgtctattgtatgcataagaaatctatttgtcaagtttttctgatttcacattctgttttatttgaagtctatgcatgccccagtctgatgtgttagatgtacggctgtcatgcatacaaataaattgggaggatcaccatctcttatttgctggtttattttgctgaaccgtgtattttgttgcagatatgggatactgctggccaggaaaggtttcagagtcttggtgttgcattctaccgtggagcagattgctgtgttctagtttatgatgtcaattctatgaagtcatttgataatcttaacaactggcgtgaagaatttctaattcaggtaatgtgttttctataattagtcatgaatcatgtcatttctgtctcactttggatgtttgactttacaggcaagcccatcagaccctgataacttcccttttgttcttttgggcaacaaagttgatgtagacggtggcaacagccgtgtggtaattatcgttccttcttcagctttctaacagaagttccttttaatcagattccatatcttctctcggtggctgatatggatacgccaaactggataatattttaggtctctgagaagaaggcaaaggcatggtgtgcctctaaagggaatatcccatactttgagacatctgccaaggatggtacaaacgtggaggaggctttccagtgcattgtaaagaatgctctgaagaatgaaccagaggaagaactgtaagcacactctctccttactctctttgatcttttgtaaagatttaacaacctttattgcaattggtggttgatcatttgatctacctgaaagtgcaatagttctttcagttggccattgcttcaatcattatgtacattaaatagtcaatagcgagttgcttttgttttttagacacaatgcactgtttctgtttcatggtaccgtcttctctttgcatggtcatgggactggcttagcatcaccacacatctacatttggttatatttctgccggtttttgttttttgatatcacgaaatgctcttgaaggtatgtgccggacaccgtggatgtggtgggtggcaaccgggcccaaagatcatcaggctgctgctagaacatgatggaccatgagggctgagactgttggctatgcggtaacagaactacctttggacattgctgtgcctccatggtgactctcaaggacccattcgtaaccttttcaatcacctcatgtacccagttaagattgatgcgtctggcctgagttgtcaaatttgtggatgttgtgcagtttatcagtagcgtcatatctttgtgaatacaatcggtgaaataagtcgagtgtaaactgaagtttctccattatggttctctctgaaacgaacaagatgaatttgttttgtctgcattgaggctgcatttctgcattgaccatcctagttgggtttctgttgctggttatgaaaccttatgtagttatgcaacgtaagaacctgttcggaattttggaggcgaagaatcacgaataggaaaatttcctgaatttgtatcgttgtttgcttgagccatatttatgttacattttctgccgaaaaagaaaaagaaaaagaaatttgcttcgacctcttcatcatatttaaatcaaagaaaacgattttctttttcttactacctccgagtataagaagttggacatggctattggtagaattaaattaaggaatattgttatttgttgagaagtagagatacgtggagtaattaaatggtggagagttgtgattggttgggaatgtgatgttattagaaatgttatattttgagataaattctaagagctaggagctattattattattatattatattttgaatgctttgggacgaaggaagtatgtttcaaatggtagtaccatgcattttgacgagagcgaggaggccgacgaaatagcaatgatcacgggccggacatgtcgcggacgcggcgcgcacacgccgacaagcagttcgctctccacccattccttccacgtttcccccctcgccccaatcacgcgcgttaactcccgcgccgcgccgccggccactgtgctcgccgcggcacgcgctccctccctatataagcaggtcgccgtgcgttccgtcgtttggcgtagtgtgcaggtgtagctaagttagcagtagtagtagtaacttgtatggcaatgcctatggcggcggcggcggcacgggcttacggcgttgccactcctcccggcggctacgtctcgtttgcgtgtgctgccatggcgacgacgcgcaccggcgcgaggagagcggccgccgccgtcgtcgtcctcagccacgcgtcggggggtggtggtggccgtggcccccggggcggcggcgagcgggaggaggagcccaccgacgcgtcgtc

SEQ ID NO: 390 - DNA, 5761 bp, Oryza sativa
aataaaacggacggtcaaacattggatacagaaatccagggtttggtctttttttttttttttttttttacggagggagtatgatagtactacatatatgtgcacatatatatgtttctcggcctgacagacagggttaggacaatgtaacgagtacaccaggttaggacaatggcatcaagtcatcaaccaccggtatataacatctgtaaaagctacagtacactggtaccatttgacagtttgtacacaggtgagctggaattaactacacaactaccaattgcaattggtatatactccgtagtagtactgtcacattagcaagtaatatggtctccatgggaaactgaaacaaaggatattaatgaaaaaaattgactcatatgaaaatcctgtaaaattttacaatgtcccaaacaaagctttgaataaacgagaaaaatataaaagctatattcagtcctaatgaatattgttggctacatatgtgctcggtagccactggtgcagtattaatctatattggtttgtagctgtagtggcaacaatttacatccataatggttgatattttgaaccaaaatcatttatttcaagatacttatattatcgtgcatgactttttaattaattgaaaggatataatttctttctcgaattaatgatgaccctgatcggtatggcttaccgtgttatagtagccacccagtcagccgcgctaacatttgatcggcgttggttggttgctacaatgtaaacaacaattgatcgatattttgaacccaaataatttattcattatcatattacatgagtttagaattactactaaagaagattgaattttcgccctaactatagaacaactaatatactacaaaatgatagggggggggggggggcgagaaagagaaataattaatgggcatatgcgtgcgtgataatcggggaggagcggtaataaagaaggaaatgatgcgcgcgcacaacgtggccacctcctccacccacctcacccaccacctctctctctactcctcctcttctcctcctccgtctcgagcgagctctctccttccttgtctcgggtctcggcattgcatttgcattggggggcattgctattgcttcgcttgcgcttggccacccaccatttcggcgcggagaggagaccgcttcacccgccgatctgcgagaaaccctctccgcctcgcctcctccacctcccaatcttaacccaacctccccccttcctctcgcgtcgaccccttgctttgctcctccttcaaccttcttctttcttggagtttcttgagagagagagagagagagagagagagagagagagagagagaggggggagcggtcgcaggaggaggaggacggcggcgtctgctgcgaccgacggggagcggcgaggatgagcgcgtccaggttcataaagtgcgtcaccgtcggggacggcgccgtcggcaagacctgcatgctcatctcctacacctccaacaccttccccactgtgcgtattcttcttcttcttcttcttcttcttcctccaaacatttccttttcttcttcttcttctttcttttgcttcttctttttttaattatttttgaaaaaaaatacttgtgtgctcggaggcttggagctaggattatggttcttgatctggatttgggcccaaattgtggggcttttctgattcgtccgccgctcgtgaatttgggacaatgcggcttcgaattcctgcctagggttgccattcgagtttgagtaaaaaggggatcttttgcacggcaccccgtaccaaatcaaaaaccgtggctcaaatcgaagccaaatgctgcctcattcgttcctcgtgaacgctcaaacaaaaaaaatgcagtagaaaaacaaaaaattcgtccttgattgcttgcagcatttatggattgtagcagcattagcggcggaaaaaaatgcaggttttttccccccacgattcatataacgtcgaatcagtttggctggcgtttctctatcaaaggtgggaaaccgcggatccgccaggtcgagagctcgatatcgctttcccgactttctagttgtcctgtaccctcctccactcacatctcacaccttccccatggttggtaagcgcattctttgttcctttcacgcaaatccacacccaatcaattacacaccaccacccttgcttttcgcgcatggttaatttcccaattgcacattaatttccctcttttgaggagagatcttcaaaagaagagaacatttcagctgctttggggggtagattagcttattagagccctgagacatggtgaccatgtagtgggggtagtgtatccattggaccacctgtggacttcttgccatgtataataggcctggtaaaatagtaatctagtggagtatatatcagttttgtaatcttatctttaggcaagagtttgagaatggactgcacatttaccatagatatcttatcagttctgtaacagtaggattcacctcattttgtatcttatgaatcggttgtgccttgagacgatatgtgcactcattgttcgcgtcattgcttttgacaggattatgttccgacggtgtttgacaacttcagtgccaacgtcgtggttgatggtaacaccgtcaacctcgggctatgggacactgcaggtaatctggttgcgctgctatctaattctgcatgcttgttttcttctaccaagttattaagtttttccttcggaataccacaggtcaggaggattacaacagactgagaccactgagttatcgtggagctgatgttttccttctggccttctcgctaatcagcaaggccagctatgagaatgtttcaaagaaggcaagggactcactttcattttctgttaataatattgatgtgctctttttttcttctttcgctaaagaagtttgttggtcatgtttaatttgagatcgtctgtgcaatgatatgttgcttctggcatttttcttgtgtttttgccttcttcgatgataaaactattaccatgctgggaattaggctccacaaaatttagagcaggcctagatgcatccttcaatggattattccacccattagagatgatagatgatgataataatctcataaatttatgttcataggtcattgtcttatgttgatacttgatttgatcatttttgtggctcgattcacttttttagtctccacttatggtacttcttgttgattctaaactttgttatatttcagtggatacctgagctgaagcattatgcacctggtgtgcctatcatccttgtgggaacaaagcttggtaagaaccgtgcaaggctctattttgagaaatctaatcttttgtacctgtcacaagttcggttttgattttggatggaagtagtggcatgggatttttaggttgatacgattttatttggtgtgtgttcttttgatgtcaatgcttggtactggtgacgtcatttagtgataatacatgaagcagggtgctctataaaagaggaaaaatatggatatatagtaccagtatatcaatcagccatagtttttagtacttgcaagaaattcttgtgataaacctatttgaactgtttgctcttttggttctacttttgtactattcaactttggttcaacaacatgcaacagttatactctgtctcacagatttgtggcattgcacgttgtccctcagtttgctattgtcatgatggattcagttttgttgtctttttttttttggctggtgtttctacctgtcttatgaaattaaattccaatcattctacagataatatccccttcgacctgtaaagatccaactgtagcccacttacatttttcacattgtttattgcactggcagatcttcgagatgacaagcagttttttgtggaccatcctggtgctgttcctatcaccactgctcaggtacagttgtggcattgtgggttgtttaattccttatttactgtagcatcagagatgtacttgcaactcctgtggactacattgccatatcttgatcatttttttgttccttaattgccacttttgtagggagaggaactaagaaagcaaataggcgccccatactacatcgaatgcagctcaaagacccaactagtactgctttcttcccatttctttgctaaatgtgcaataacatataagatactaacagagatatcctgcccccccctgatctgcagaacgtcaagggcgttttcgatgcggcaataaaggtggtgctgcagccacccaaggcgaagaagaagaaaaaggcgcaaaggggggcgtgctccattttgtgatctaatcatcagtagacgacgaagaagaagaacgatgaagttgccaggctttattattgttgcgtcttgcttcagcgaaacagcattcatggtccggggatcctagtttactggcagctgcagcaaggcctctttgtcgaggcaatgagcgatccgtttgtttcattttctcctttctgccttgtgattatctcgtgtgactgacaagtcgtggcaattaggtaactttcctagatggtatttcctgtgtttgagaaaaaaaattcttgttatccctgtttcataagtagacatgatgtaatcgcactcagtttattcttttccttcttatttcacttcaatggaaaattatgtttccccttcatattctgttctgcaaatggagcaagatctgtgatgttcttctgacttgtccaattgttgcatacaagtggcctactcaacttccaatggttacctggagtcaacatctagctctagtaacataatgatttttctggagattgtggagagcatgtttgaactttgaagtagaggcctgtttgtaaattataatatgtggaatctgctggaattctgtatctttgccagttacatttttaaaggccatctatgcaacagcctagcagaatcaatatcatacatgcgtacatgtttgaaaattgttaaactggatgcaatttggtgggtggttgtcaccaacaatcagtcaaaacctatcatctcagaagatcaccaggttaaataaaactcagctggaagtgcctggaaccaagatatatatatctcaactggttaattggcaattgtcccctgatttcaaaagacccgattgaggccttccttttgtttttctaagattaaatttagctctcgatgtcgctgcaaaatttaagcacaaagttacaaacacatggattataatatcgagagctgttgtattatatttatttatttttcaatccagcagctggactgttcgcaattgggctgtggtagcgttcgattcacacaagggtaacgcaaaatccccccccaaaaaaatcgtctcgaagtaaccgtagggattctgaaagaaagtgaaaatatatataaaaaaatattacgagttggttggaaaaaaaataaaaaagttaatcgacgcctgagagattcgaactctcgcggggaaaccccatgtacttagcaggcacacgccttaaccactcggccaaagcgtcggttgtgtcagtgaaaaattttcacttttaaagaacaataattccaatttcacttctgacgaacaataattccgtcaaaatcgcagacttttattattcctcctcaccaagaagacgatggtttttgattataggttagatgataacgatgattcagatttgcaacaacaatcctaataattgca

SEQ ID NO: 391 - DNA, 4731 bp, Oryza sativa
agccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaaaaactatactctctttgtctcattttaagtgcagtcataattaaaaggcaacaaaagtaatgtactcagattattaaaaggcaacaaaaggaaaaacggaattaaaaaaaaggagaaaaaggcctccaaagaaaaaaagggaaaaaaaagaaaaaaaaaagccctttgacgttggaacagtccaaacgtcgagaagctactagccccgctagggttcgccgccgccttcccctcccccataaatcccaccaaccccccctctcctcgtctctcgccttcgccaccttcgaatcgaaactaatcccccacacctccgcgtgcctccccccaatctcgagcgcacggaagccgccgccaatggtgatcgccccgctcccctccatggcctctctcgccctatcaatccttcgatctccccccaatctcaccctcaccgtcgttgcgtttgttttttttttacttttttttaggcgctcccgaatcagcagacggtggactaccccagcttcaagctcgtcatcgtcggcgacggcggcacgggttagcctcgcgatcgccctcccctctcttacgatttttttcgatctgtttggttctaggttgcggtataggtgtggtgatgcttggttgatgcgaccttgataatggttcgctgaaccctagatagattgaacggagagatacagccacggttgttttgatttgtaaattaagatcgttgtagtggttgttttgatttgtaaataaattaagatcgttattatagttagagatagagaaataaggctgtgttattatagttttgatctggcaccgattaatctggcagactcgctcctcttcgagtacatagcattgggactcgggaaggggatggtggggaagggaggactgtgttagatttgatttgtcacggatgaatgtgaactctctggtttttattttcgaaaatttataggattaaaaatttcttgtttcctgtgctcgaaattgccaggctcgaaaatttctgtctgttctgaaaccaggcaatctttttgatttgcaggcaaaaccacctttgtgaagaggcatttgactggcgagttcgagaagaagtatgagcgtgagtatctgctcctattttgcattatcatgtattcttatggtggatcattgtgtttttcgtgttaatttgactgtggttgctgcagctactatcggtgtggaggtccaccccttggatttcttcactaactgcggcaagatccgcttctactgctgggatacagctggtcaggagaaatttggtggactcagggatggttactagtaagtattattacatcgattgaatttgaagtttgtctcattagttatttaggatcttcagccattttgtcattctttgctatgcctagcctagtacattgtaatttgtatgaggaatataagcactgttagaattttactattgtgtgagactatttctgtgattttagttgatcctttccaatcctgtatttaactattgtattctcatgacactttatgtgaatcctggattttgttgatagtgccttagtgggtgaattagaaagatatatatagttctttgtttagttcttgtgttctataacaatttgtgatgcacacgatgctgatatatgcttatggagagaattcagtttagctttgactcataatatgcatgaatgctggatttgagcatcatatgccatgcattttatacaactttagtactactaaatttgtgagaagacttcttatcttgtggcattctgctgtttgattgcactcatgggtaaagttactgtatgctgtgtgtaacaaagctctgaaattctatttattttgtactaactgtaatcatgtattccgcattgtagtatccatgggcagtgtgctatcataatgttcgatgttacttctcggctgacgtacaagaatgtcccaacttggcaccgtgatttatgcaggtatatcagtggaactgagcaaatacatttaccacaaactgatggttgaaactaataggtcttgattaattacagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctgggtaacgacctcagttatcatcaatctttaattattcagcaacccaattactggattaaaccaactctgttctctgtctttgtcagcgatggtaacctccactttgtggaaacacctgctcttgctcctccagatgtcacaattgatctagcagcccagcaacagtgagtgttcttacgaaattgctctaccaggggtgtttaatttatgccttcaaattgttgaacgatttctgattgctctgtaatgtgcaggcacgaggctgaactggcagcggctgcagcccaaccactgccagatgatgacgatgacctgatcgagtagatttgcaatgtgctactttacatcgtcttgcgaggagccctgtttttaagcacagttatatcctaagagatcttttttgcctcggagaaattttcgtggtgtccaaggttaaatatgggagttttgtcggatatttgaccagttcagacaagttttggttatcgttgattgatgctataaggttacttcgggttaacatatttgcgcttatagctgtcgtatgatcaatgtgtatgatccgctctcgatatttggaggaaggtctgcgtgatgcgttagttttgagcaaatatttatcttcctttgccttcgaagcaaatattttatcctgtaaattcgggcgtcgcttatttatgctgtatggatcgcgcttaatctctgaagtataatcaaattctacgtggatagacggcacgattactgctagtctgctactactaattctgttcgaaggagttaacctgatgagaaactaatttgggatttctttacaaccgcacgtgtttgatgagtttgggggattcccttgcaatataggcgggagatgatcgatatcgagtgagaggtgtgtggactctggacgggagcccaacttggcaaaaccttttgggctttcaaagctgctcgacgggccactgccatcctctacaagtgatgaagtgaacacgataagagagaaaaaaaacatgataaccccccttaattaagtctcaaaacgtttatgcaatgaagtgcgatacgggcttcagcgagcttctcctccaaacccaataaccttgatatcttcgataatgctatcccaataagttaagtgttcggggtggggatggggggagtaagagggtaagatagtgttcggggatgaggagcttagaggtgagcacctgagcaaaggtattgtggggatagtagacagagaaggatggtggggtgagaggcacctcgtctgacgagtggttaggtggcaacaggtggtggtgacgaatccaggtataggaatcgttggagaatggaaaagagcctagaggtgagcacctgagcgaaggtgttgtggggatagtagacagagaaggatggcggggtgagaggcacctcgtctaacgagtggttaggtggcaacatgtggtggtgacgaatccaggtatgggaatcgttggagaatggaaaagagcgtagaggtgagcacctgagcgaaggtgttgtggggatagtagacagagaaggatggcagggtgagagggacctcgtctgacgagtggttaggtggcaacaggtggtggtgacgaatccgggtatgggaatcgttggagaatggaaagatggtagtgaatgggcatgagaagtgatagtggcacgcggaaaagctgctgctgga

SEQ ID NO: 392 - DNA, 4285 bp, Oryza sativa
cgagcacttctgcatccacgccggcggccgcgccgtgctggacgagctggagaagaacctgcagctgtcggactggcacatggagccgtcgcggatgacgctgcacaggttcgggaacacgtcgagcagctcgctgtggtacgagctcgcctacgccgaggccaaggggcggatcaagaagggggacaggacgtggcagatcgccttcggctccggcttcaagtgcaacagcgccgtgtggagggcgctccggtcggtgaacccggccaaggagaacaacttcaccaacccgtggatcgacgagatccaccgcttcccggtgcccgtccccaaggtgtcggccatatgatccaaccacacgcgttggctgtttgcactgaaacattattactagcagtagcttagtagtagtagtagaaatgaactaggatctattcgttattgcttgtgtattgatctgatcatatctggttcgctgttcttatgtgaagttgctctgtcggtctggcatgtaagaaggtctgatcataagttcacttcaaaagttaatttacatcttcataaaatggcaagtaaattggctgtcaacctggaaaacaacaatgaaacagaaatgtacaatttaggctctcttttttttcacttaacgaggaatgcacaacttctcaattgccctgtgacgaggaaaaaaaagttaaaataggttgtcataaaacggcctttttaaaagggccaacagtttcagcacccattgggctgtcaacaaacaccgaactggggctgtacagtaaaggccgaaacttccaagtggagagcatctcggcccattaggcccatatcccacagagccaacggcaacttccgaatccgacggccgaaaatctcgcgtgcgacgaaagctagaccgatccgatccacacctgccgaccaagatccaacggccacaattcctgcgtccatccaaagctaataaaccccgcaaccttcgagaaaaaaattgatgccaccgcagctataaaaccctccgcctccgcaaaatacccaattccatttcgaattctagggttttgttggcccccattcctcccccaccccggtgtcctcccctccgccgctcgcgtcgccgcctttttcccctatggtgagtacgatctcgatttcgccgcgccgtgtgggtttggatctcggggttcctgtgtttgatccgcgacgttttttggcttttttttccaggcgctgccgaatcaggggaccgtggattaccccagcttcaagctggtcatcgtcggcgatggcgggactggtgagttcccaatctcgattcggatcctattccgttctgaaacggcatgttatgatatgtttgatgcgtctactcggtgtggtttctactagatctgatgggctaagatttgtaccggtggctgaaatccgatggatttttttttatttcgccattagactgggatttgggtattggatgtttccattttatgattcagcttatcccagggatgggttattgctctatttttatatgacgtctaaaattttgctactcctatcttgatgattaggatcttgagagttattttaggatattgaaatcggcataaatatgatgctatacaggtcgtatttagtcagatgtatttattatcttattttagaatggaccatcgtgctatgctgttattctaggattcgcctgggactgaataaatttgaggaaaaagtaaaatagtatataaataccttcgcatcagtaaactattgcgctttttgatcagttgagattggtcaaaacattagttgcagtctgattagtttaggccggcaatatgcctgaatggcttcatttccgtaagaaaagtttacttattgccttctatatcattgttattggatggattttgatggtatgccatgtttgattgcaggtaaaactacatttgtgaagaggcatctcactggagagtttgaaaagaaatatgagcgtatgtactatgactcttatttttgttgttcctgtattctttgctaaattagttattgaactgttatgcaaatttgtcacttcagcaaccattggtgtcgaagttcaccctctagattttaccaccaactgtggtaagatccgcttctactgctgggacactgctggacaagagaagtttggtggacttagggatggatactagtaagtgctagagaagtgcttaagccaattatcatagcttcccttaatatttttccatgcatatggatgtctccttgtgcttgcctgattgttctgtccttaacttctgttgtgcagtatccatggtcaatgtgcgataattatgtttgatgtcacttcaaggctgacttacaagaatgttccaacatggcatagggacttgtgcaggtttatttctgaagacacgataaactttacctaatatattatatggaagagaactcttatgattaggtatcaactcttgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctgggtaataattccctccttattgttttccttttcatgctttcttcttacattgtttgtgtttattatgcaacatattttaatctgtgttaatgcttttggtgtatgtagtgacccgaacctgcatttcgttgaagctgttgctcttaaacctccggaagttcccattgacctggcaatgcagcaacagtaagtgtttatgctttgtccaattcattttcagatagtgttgatgaaatacctagtttctgcaaacatttcaggaactaattttaatactcatgcaggcatgaggctgagcttgcggctgcagcagcacaacctctcccagatgacgatgacgatctgatcgagtagagaggatcatgagtctatcatgcttcagcctgagtctcttcataagagtctgaattaggccaatgcatgctagtgttagcttgtctgtggaatgtggacgtttcctgcgtgcctgatgggttgaaaacttttgatgtgtggtgttacatgttgctgccatgaatttgttggctcttttttaacactgctgtgttacttctatggttatgcttaaactatttgtatcatcgagctggtatttatttatccggtgttgcacaatattcttcttcactgccctaactgcgagtgctgaccgcccaagattatgtaatgttcgcatcgcattaagttttgtatatctgtgatgaaagctaggctcaactgttcttgagaacaggggtggtgactggtgggtgtccggtgtccctgtatcggtaaacaaggacacatttgactgctggtcctcgttgtcgttggtggcgatatactgatatagtgagtatgatggcagtatagtagtacagctcctctaccaacttactcactataccgtatgctcaactaaaatacaccatttcattcgacctggtaaagctgaactgaaaatgagtaagctcttccagttaccaacttaccatatgctcgatagaaaatgtagcatcatcttactgcaactctaaaaaattaaaatccaaagggagaacgaaccgggcgtgaagttatgattaagagctttgatggggaacgaacctggaggcacatggacaggaaatcaggattaagtgatcacttaattaatcccaattccaaacgtttccgacattgattaaatcatcaaacagcattaatcgacctcatttcaaactttgccaacattgctcaaacaacataggagtacaccgtattagtcctggcagaaaaagaacagcaaaccaaagagagatcgtcatcgatgatgaatacgagtacaataaagtagcaacgtttctggaacactccagaagtcactctctctcgaagaaaagatactgcaccgaaatcaccttccgaaaggcacaagccaaatccatcgttggtgcaggcggcaggtccagccagtgtagtgcgcgtcactacgaactctagtgcgcaagtggcctcggccagataaccacacagtcacagcaacagaaaaaaaaaatcgcctcggcgcggcgggcggagacgtcgatacccccgacgaatcctctctctctctctctctctctagatcccatccaccccttccacctctcctctatt

SEQ ID NO: 393 - DNA, 14514 bp, Oryza sativa
cataaattatgtttggggacatatattcacaatataactaatatatcatgatatcttattgaaaaaagtcccttttacacccaggaaactatttcaccgaaacacttaacaccataaactattttaaaacttattttacacactgaattattaaaaacggttcaatttactctctaatgtgatatatctctcttttctctctctaagtaaattatattttttagtattagacttttggtatggtaatagatgtgttacaacttatgcctacacattttttttagatttttttctcactatttacgtaggttggagcttggaggtacctgaggccaatttaaaacatcaagattttaaagttcgagcaaacaaccatgataaaatttaaaaatatttttaaactttgataatcatgctatttacgggtctaaaaaagtttcagcttaaagtacgcccccgtataaaaagtaaaaaaaagagaatattattaagaagtaaagtgaatcatttttaatagtttagaggataaaatgagctaaaaatagttttgagataaagtgattaaataaattggtttgacagagtaaattgatcgttttctatatattttattttattaagaaagtaatattggggcatattttattgtgccaccttgaagggtataattgtaacttactgcgtgactaaaaaaatctagtgggttataatgcaggtagaaagagaaaaaaagacaaaagaagaaaaaagaaactaccggtctaccgctagatagaagcgtacttgtaaatgagatttgttgtatgaacgaatcgaagcagaaaagagagagagagagaaaaaaaaaggcggttgtcattttctccagcactcgacttccctttctcccccaactaaggtttatgcgagcctaatcccagtacttaagctaagcgtactcaacttaactcaactcacttttgttaattttgtatattgtttgtgcttttggtcgacctgtctgtcacccatatattgctctcccgctgctcttcctctttcctcggctcggctcgtctcctctcccgctccgacgcgtcgcgagggcgccttttcccagagattccacatccatccagcccgcggccggcgagcatttggcccatcacgcgagctggagaggttggcccggcggcggcggcggtgatgaggggcggcgcctcctcgggaccccagcgatggggctcggcggggacgacaccgcggtcgctgagcacgggctcgtcgccgcgcgggtccgacgaccggagctccgacgacggggaggagctggtcgaggtcacgctcgacctgcaggacgacgacaccattgtgcttcggagcgtcgagcccgcggcggcggcggcggcgggggtgggggcgggggcgggggcggcgtcggcgcggggggagctcacgggtggcccgtcgtcgtcgtcgtcgcggtcgaggtcgccgtcgatccggaggagctcgtcgcaccggctgctgcagttctcgcaggagctcaaggcggaggccatggcccgggcgcggcagttctcgcaggacctgaccaagcggttcggccgcagccacagccgcagcgaagcgcaggcgccgtcgggcctcgagtccgcgctcgccgcccgcgccgcgcggcggcagcgcgcgcagctcgaccgcacacgctccggcgcccacaaggcgctccgcggcctccgcttcatcagcagcaacaaggccaacaacgcctggatggaggtgcaggccaacttcgaccgcctcgcccgcgacggctacctctcccgctccgacttcgccgaatgcatcggtatccctacccaccgatcgcccaccaccaccatttttccccccaccgaattgctttctcacgcagcatccgcgacattgtcgtcgtgcagggatgacggaatcgaaggagttcgcgctcgagctgttcgacacgctgagccggcgacgacagatgaaggtggacacgattaacaaggatgaactccgcgagatctggcagcagatcaccgataacagcttcgactcccgtctccaaatcttcttcgaaatgtaattagctacccaatccactatctctgcaattttgccattattaccagtactactagataaacagagtatcaactctgctaaattttgtggcgattttcgtctgcatttttaccagggtggataagaacgcggacggccggattacggaggcggaggtgaaagaggtgagcaaaacataatccacgcccatgtctatgctgttcctacgcttggtggtccagcagtacgagttcttctgtgctttttttctccattctttttaaatttgctatttcaggatatcaaatcgaataatttagaccgttttgacaaccgtagttgtatatttggtcgattgagctgtcctcgccttgcttgggccacaccaatatttgttttctccctccaaaatatgcacacatctaagtcgcgattcgcaaccttaccggataggattacttcttaattctgattagagggaagaacagttcttaattaacacgtaacaatccgataagagaggacattttagatcagaagcgtactacgcagggaaaggagagaggcatgcagtacaaaggtacgagaaaagaagaaaaaatgcttggcttccaatcggagtcggtgagcgaaaccggcggggaaagcatcacggcgacaccaactcctacctgccagttttgggacactcattttctttaacttttaggaaaagccgaaaaggggtaccctttctagaacgtgtgagggcagtttcggtaatccggtgggcttcgtggcttacagaagccctgtgaagcggcagtaggtgaggggcatttctgtcaaacccactaagggcaagttttatagtagaggtggccaccacatccaatttcatgcatgacatatataattaaattaagaggtgatatgtataatagattacctctactacacaatccccaatatctctaatactctcacatgtttattgaagtttatccccaatatccccaatatcccttgtatgagaggtgactatttctctctcatccttgttctctcctccacctcactatttagtcccatgtggcatcttagggcttgtgcttggatgcccatagtacttgccctaatgctctctgatcagctcaaacgatgcgttgacaagatgagttataaagtagccttttaaaaaaaaaacgattcgctaattttttgcctctcactgatgtcactaacagtgctgcggagcaaattgagttggtaggggtttttttggctgctctgggttgctttcttgaggtttggaagatgttggatcatgttgactcagctcgtgtttctcctttcacctacgcgcagattattatgttgagcgcgtctgccaataaactgtcgaggcttaaggagcaagcagaagagtacgccgctttgatcatggaggagcttgatcctgaagggctcggctacattgaggtaagctcgatgttcttaagcagttaagctggtgtaaaccctcataatgcgcttatatctgtaatagttgtactcatgcactgtaaacccacactatttacttccaccaaacctttaggaatagttgactgaagctgtctgttttgggatggtagtgctgtagtggggtagtaccagtagagcctaattgatgacttcgtgcagttctattttatctgtcacattgctccggtgatgggtgtcccccaaccggccaagcgcgcttgttatgataattaaacaaaaatttgtccgtcacagcgtcaaggccaactacttgcaaagggacgcatcattcataacaaaaagatgatgctggtaccccacaaacttcttgcccacccatcatcatttatatcgaagttgttgagcagacgtagaccagtgtagctgtgtagcatccatttcagtttgggaacagtttcgcttcgctcccctgcctaattcaatgccatccttgctgcccacagcttgttgccgcaccatttacaaaggaatcatttacaatgccagaaatgttccatcacggttccatggctcttggtcgtgcattgctctgccttgcccgggtgcaagggtagggaagctgatgtagtaactaataagcagggtagcaagtactagggatttaggaaccaggattaacccatgcgctcatgtactagtaggaatgtcgatcaagggtgtttatctggaccatgcagccagtggctttggtgattgccatccatgatccatgttaggcctcatttgttatggttttagttcaccaggtgattcaagtcccaccttttctagcagtgggatagctacaacttcagtttggtggggattcatatttttgtgcaaccgtaccaattagatcgccgtgtagtgttaacttgtctcgtactttttttaccctcatagtatttgaagtaaattaactttacatgttcgataagttgacgcttctttttcaaaagatagcaagagataactagttgacacaattgtttcatttgagtcaacactgatttaatatttgtttgtccaaaatggttagttaagcttgagaaagttcatgtacatatttcatagggtaatttcaggacacatttgccaatattagtaaagcagcaaactgtaaattcgagtttctcttaaataaattattgaactatgaattatatacatctgaagaaaatgtttgatatcttcttgatgagaagcgttgcatctattcacaaatcacaagtaccatgtactgcatctggtatgactgcacaactttttacatgaaagtcctttcatatataaaaaaggaggtgttttacaatgatctctactagtagtgcaacattttattttttgccattgcagcataattctgttgttatataatcttgatattattatgtattggatggtgaaaattgatgtgctgttgttgacatgctcatgtgtttcttgcaaacaatttgttgagctaatggaagtgtgaggacgtcccaaagcctaggtggtgcaacgctccgaggcatgtcagcgcgaaatatctggatggatgggttctcaaataaagcccaaataaatacggtaaccatccaacctcatcgcagaccccgacatgtcttgaagagtgcactacataggctctaagccatcggatatgaaatagaagacacaactgttggaatagccacaccagtcatctacgtcatatgcccgtcaaccactcgatggtggcgacaaaaaacataccccagagactcgatctcaacagaggcatattccccggttatctcaaccatttcaaacccatcctcatgtgggactagtcgcccaggaatgcaacatagtctcacataaatcatctcaagcatgatatccaaataataattggttctaagcaataagcataaatagtcttaataaggttctaagtagtacttggcgacaagccataaatattggttcatgcggtaagcgtgctacccaaaagcccataggcaaaccgactagggtaaatccctagttagaaccatcctggaaatctgcaacatcacaagctgcatcaaactcctcatccaaacagtcattacctgcagcgcggtctgagcataaacaagtaaaaaaaagcaagaaatcagtacattaatcaaattaatgtattggcaagtcggaaacaatcctagcatactacatgttggccatattcaaggataagctgtgtataggttaatttgcataaatgccaattttagttcacaacatgtttcgcaacggaattttataacaatagtatagagtaagtaaaacttgtaatgtgaatgaataaataatacacatctacccctcaagtcatcacataccacatatcattaatcaatttcatcatatcacgaaccataggaagttccgataagttaccaaaacccggtaacccatacccttcggcctaccaagatgcaaggctaaactctaaacaacttaataggttgaggccagcccatacttagcacatgtggtttgtactgttttcattagttggtgacatagagtggggtccttaatcgacccgggcgaacgctccccctatcggtgtacaactaccaccctatgtacactcgccgcccaagtctaaaaacaagttatttccattttcagttcacaatactcacacacttaaatttctgtccagcaacatcaaaataaccattttcacatataacatttatcaaaacgagtaatttgcaaggcggtaaccaaatataagcatatagcagcaatataagcatagtataatcccaaagaacacaataattgtattcaaaagcactctatggttacaaccagcaagggttcaatatttcaaggtggattatgcagcaattaggtcatatctaccattcccacatttatataatattttttttaccaaaattaatactagctaacgtatgcatgtttgcaatagaatcatttagcccaatagaacataggatcaatgtggtcaaaggaggggcaaactttccttcgtctgcaaactcctgagcctggtcgtcaacaaactcaccctcttcttcttcgacgtattcttcctctatacaaaatacgtgtatacgataaatacaaaaatgcataaaaaccaaaatgcatgaaaatgcatgaaatttatgcagtgagtgtgtgctggtctcaggtggtctctggtgaaggaatttttattttgtcactttttatttacagagatatgcattttacaattaaaaaggtttaaaagggctaagttttattaagcaacatttttgtacagaagtgaacaaaattccttttacaaagttatagagcatgattttagaaagttaacagaagtggtttcacaatttttagagctatattcaattcgttatggatttaacaagttctaggcaacattatggcaaaacaaaaataaaggaaaagtttgtacagaaagtacccatttttatatttttgtaaaatatttcacagctttatggatctaacaaaactggtttcacaatttttgaagttaaaatgaattttctacaaattttagaagttctgctcattctctgctttaaaccaaaatagaaatcaaaatttgaaattgcattccagccgggtccacaggtcagtgaaagaagatttgcagagaggccctcggaagttgggggaatcatcccgcacttcttctgccacctggacagcaaactttattaagagtctctattcttttgtttatttccatcaaggtcctgctatagtaatatgagtcatggcagttttcagattggaccctagagtcgatcaaattcaagaaatgaagtccccagctatctcacatcgggagcagccatggctgagctcggtctacggctcaccggcggcgatcagtggatcgaatcggttcgagcacaaaagagaaaatgtagagaacgttcttgcgcatccgtgagtggtgctggtgagggaaatggtggtctgtagcccatagaacatgagctacagcggtggtgtgtctcggtatgcccatgtatgtgcatgcagaggcttggttagtgcaaagggttagtgcatgtgctctcatatggtaccagggtgctcaccaagcagagaaacggaggcagcgaggtccagggagcggcggagacggtggttgatggccaacggcggcaaaactccggcgtcgacgtcgccgggtcgactcaaggcgcgaactgtaacttcgagagtacgggggtgttagagatgagccacagagggtgcatgcgcgaggaatccggcggaaactcaccggagcttggtgttgcttcggtggtgaggaacggcggccggagcggcgtcggcggttcgggtggccggcggcgaggacggtgacgcccaccacgtgctcgacagattggtcctagggcaaaaggggtacgggtgagctcggcgtgatgcgtaggtcacgttccataggaggaaagagagagggactcaccggggatgcacggcgacgacggctaagtcgccggagccggggaagatggccgagctctgggcattctgtgcgtggggtgtgttttcttggacttggaacgcgatgtggggagcgagctgttgcttctggtgctttggcttgggaaataaggaagagtggagtgggggagtgagagagagagaggtggctggtgcactcattgtgttccttgggcatttattgggcatgaggaacggtggatgctgtgaggggagagtgggaggctgtcatgtgggtcccgggggttgtggggcccactgtcagtgaaagaaattcgaaaatagccttggaggctaagtcaatgagggttacctgccaaggatctttggaggggattcaaggtggattttgagcagcaagaaatctggctagatatcctcttggtcaggggtgatgtggagagtaaatgtgctgaagtgggttgggttagaagtctctggtttaggtttgatggagtgatgaacatgtgttgacagtgttggttagcagcagttgacagtgcagttagcagctgattggatttttggagggagagaagaaagggttagagagtgatccagggtatgccactcctcagggtgttagaagaaagttagtagaagactttggctgaaaccaaacttcaaaaagaggttttgaaataaattttacagagagagcaagtttgaatctgctaagcagttttttttttcaggattttggagagattaaagtagatcaacaagttagcaaaccttactgaaaaactctgaaaatttgtgggttgatttctgacatatcaaggtatttttgagaatttttgtggaatttttggatgcatataattaccagattaattgtttttgtgactctaggcctatcaagatgcatgtgatgatgagatgattaagatccaaaaacaattaaaatcactccacaaccacatgatgcatttaaattaaatttagttctcaggtttataggcttgggtatgttacaggaagggaccaactttcatttttaatagggagtatctaaaaaactgccgcaagtttttttgagtgaaaaactttcacatgtaactatagtataatcgaagtgtaactacattgtaactatactataactgcattgtaactatactgtaactatgatataacttatataaaacttgtatttaactatggtttgattggttagcaccggaatattacacgtgacatgtgcgcaaatttctttctagcaattttttcccttcatgcacaaatctcgaggcaatccgatggctacaaatccgaaagttttggaggcaaaagaacttgtggaagttttctagcaattccattttaatatcacagaacactatatatattaatttaggcggtcttgtgctatgtattcagtatcctccatgtgtagtacatgtatagtggcccagtggttgagcttatggaccttcatagtacaatttctttctttaggaaccagttttgagagagtagcttatgttttgttcatagaatattatcctcaaatcaactaaatgtgcttatagttttgcatcaatgaaatgtgaatgacatgacttctgaaaaatacactgtttttttttttgtttgtgttacagctatggcaattggagacacttctgttgcagaaagatacctatatgaactatagtcaggcccttagttacacaagccaagcactgagccagaatcttgcagggctaaggaagaagagttcaatccgcaaaataagcacctctttaagctactatttcgaggacaactggaaacgtttatgggtgcttgcattgtggattgggataatggctggactgttcacctggaaattcatgcagtatcgtaaccgatatgtctttgatgtgatgggctactgtgtcacaacagcaaaaggagctgctgaaaccctaaagctgaatatggcaattatcctcctgccagtatgccgtaacaccattacttggttgcgaagtacaagggctgcacgggcactaccttttgatgacaacatcaacttccacaaggttagcaaatagtctgtcattgcctctgttatccccttgatacaatctagcacagtgatctgtattgaaatcaatgaatttagaccttgacccagtactctagaatgtagatgctgcatttgagatacaagcacaagtaatagggtcatgacacaactgaaaaatttataatataagtagatatattgaacattcttctgctgacaaactcgaaaaagaaactaacaacttgtgtttttgttgtaacggcagactattgcagcagcaattgtggttggtataatcctccatgcagggaaccaccttgtatgcgattttccacggttaataaaatcatcagatgagaagtatgctcctttgggccagtattttggggaaataaagccaacatattttacattggtcaaaggagtggagggcatcactggggtaatcatggttgtatgcatgataattgcttttactctagcaacccggtggttccgccgtagcttggttaagcttccaaggccatttgacaaactgactggcttcaatgccttttggtattctcatcatctgttcatcattgtgtatatcgcgctcattgttcatggagagtgtctataccttattcatgtctggtacagaagaacggtaagatatttttgaatttatcttcattcattggtctaagataattcgaatttctaatgtcctcatgcttttatttcaatgcagacatggatgtatctttcagtgcctgtttgcttgtatgtaggggagaggattctaaggttcttcaggtctggcagttattctgtccggctattgaaggtcaatccaaagacattacaaaattgagcattgatactttgtgccttgtactaattcagtaactttcttagcaggtggccatatatccaggtaatgttttgacactgcaaatgtccaagcctcccacgttccgttacaagagtggacaatatatgtttgttcaatgtccagcagtgtctccctttgaatggtacttggtgcttttcagctgaaatttaattgaattatgtacactggataacattgctaagatagattacttctaattttcatgtgtagtgcatatgtacgaaaggcaaactcagggcaattaatctaacattaacatttattgtctcttgtaggcatcccttctcaattacttcagcacctggggatgactacctcagcattcatgttcgacaacttggtgattggacacgagaactcaagagagtatttgctgcagcttgtgagcccccagcgggtggtaaaagcggccttcttagggcagatgagacaactaagaaaatgtatgaacactccctatgtttaccacaacaaaattttgtactttgtgtgcactaacatttataattttgtccttttggctatgcagcttacccaagcttctgattgatggaccgtatggttctcctgctcaggattacagcaagtatgatgttttattacttgttggattaggaattggtgcgacaccctttattagcatattaaaagatcttctgaataacatcatcaaaatggaggaagaggaggtatgttttctgcagttgtcttcctagtattgcaagtaaataaaatattactcttttccttatcatgcttatcttctttgtgtagtatagtaaccatttacgtttttagctgtgccttatgttttcggtgtcctctgtttctccgtatttgcaggatgcttctactgatctttatccaccaatgggtcggaataagccacatgttgatctgggcacacttatgacgattacctcaagaccaaagaagatcttgaagaccacaaatgcttacttttactgggtgacacgtgagcaaggctcttttgattggttcaaaggagtcatgaatgaaattgctgacttggatcaaagggtaaatagaccaattgttttttttccagtgcagtttgtttgtcttcagaaatttgccatgcatttccttgtgaacttgtagttacggttgcctttgattcatgctagaatatcattgagatgcacaactacctaacaagcgtctatgaggagggggatgccaggtcagcactcatcaccatgctccaagctctgaaccatgccaagaatggagttgatattgtctctgggacaaaagtaagtattggcaggacgtttaacatctccacacggatgctgtaaagctgttttgtttgatattaagtttttcacctcactggttattatcgtaaagaactcaaagttaatagaaatcacatttgccttgtccatttaattgtcactgcacttgtttttcaggtccggacacattttgcacgaccaaattggagaaaggtcctttctaaaatttcctccaagcatccatatgccaaaataggttagtttacatgcttcaagtctaactaatctttatcttgatttcctttggtcattcatgcctactacctaactctgcatatataacttattagatgtactgagtactacataaaagaaacgcaaaacttccaatgatatataataaaaaatgggaaaggggaaaacttgaaattccacgccttctacactttcagctctgttgtaaatgagcagatctgtaaacaagttaccacctcgggctgagttactcatcaacatttgatctatatagttaatatagtgatatcgtagacacattatatatggtttgagtacttatttgtgttgcatacaggtgtattctactgtggagctccagtcctggcacaagaactaagcaaactttgccatgaattcaacgggaaatgcacaacgaagttcgaattccataaggagcatttctgaaatcaagtaaatacttgaggggaaacaaggatagattatgttatgtgtatagcatttttgtcttcgtatattcttcattataatggacaggagatagcaaggtgaggaagcaagcatatagttagcccaacagttcttgctaccaatcaataaaaggagcaacaacaagagtgatttgggataatcatataaatttgtgcgatgtccatcatggcttttgcagcatgtcttatgcagtcatgaatgtacagagctcacttgaagaccttgagcttcttctgattttagttgagattataagtaggatggtatagcacataggaaggtcacaaggctaattaactgtatattattcatgcagctgagtgtctggctaaggccagaagcacgttttacttttgtatttatacataacagaaaacgagaaaaaaaaagtgaaaagggaaaggtatactcgaattgagtgtttgtaatctgtaatttatacagtgcattggcagttttattggctccaggttgggcgcaccgcgcaccaaccacatcatttcggctctgttcattcctgtgatttgtgagtcagtgctgaccgggaaaagaaactgaggatcgtaatgtgcccgtataagcatataccgacatatactgcattcagttcacgacgaaatgagctgcgaggcacctgaagattgcaaccatcttttcacccgatgtctctacactaacagggtctggtctctgctgagaacatggctgagaatcagttttgatttacctgggcgcaatggggaagaactgggcgtctggtggccaggggcgaagctacagcaaagcgttggggtcagtagaccccgacgattttccacaaccatcgtataccccgtttatcttaccagccatgaccccggtatagaataccggaactgcatatctgtttgtcgacagatttttggggcaaaatcacccacatttttccagcctttagatctagatccaatgcatagaaaaaaatgactacaaacaaactttttaccgtctgggccttaggaaacaaaaataaacaacaattaggctgaaaaacaagcccaaaacacagagcccaatagaaattagacacgaaattatcattcaaaactttgacacaatacaaatggtcggaaccatacaaaaacaaaccaaaaaaaactctatactagtgtagaaaacagattcaacagtaatattttcactgcagaaatcactgcagagaaaacatgtatcaatcagtgatattttctctaatacctttaacaaccgatttgatcaaatgagcacatctcatatgttgagcttgaaatgccaccatgaaactcagcttctgcctgaacagcacatgtcacgattgtagaaaacagtgcatcagtaaacagctaggatatacaacgagatatctgcaaaaatggggattttctttgtgcacgaaattttctttgtgaaccaaagaactgaaatcatataatcctttatgccaaaattaactctgaactaaaaattcataataactataa

SEQ ID NO: 394 - DNA, 5326 bp, Oryza sativa
tccacccctggtttttcacttggcggttctgcttttgctttcagccctgtttcgggtggcacattggttcgtagaaccagtgagtctggctgattgcagcgttggccccccaacgctgttgcacgtacgtacgtacgcgaccgtgaccgcgacaactcgctcgtgagcctacctgccaaagcgaggtgtatggtggtactctgagcgccacctgtttttccaagcttttcagattggaaatctcgtgcttgttgttaaaacacctgcggctacagagcctgtgaggctcccgtcgttgcttacttttgcctgataagttgttggaataattcgagtgcaccatgccataaagtgataaaaccacagggacatgataagtctaggaaaatataatgaataaactatgcacggtgacaacggaaatcataatttggaaagaaaataatattatactcctatattattgcgtgtgcagtgcagtgatgattgagaaaggccatgccatacgctagggcacgtctgctcaatcctgagcagacgaactatctccattcgaactgtacgggccataaaaactgtcacaaatactacaatcctcttccgtcgaagaatttcataagtcataaaccatgaattcgatgatattatcgtcaaagtcatgaaagaatttcggttacaagagagatgaaataaaaaacagaccccacgttaaccgaaacgcgcagaatatcccgcagcgataatccttttcactcccaccaaagccaccgtcctcgcgacctcgcctcttatcatcccgcgaataaataattccacgggaagcttccgccgagagcaacgtgggaaatcccctcggggccgcccgatcgccgcgaccgacggctgtgatcggcgccccgtcccgcgcccgcacgatcacggccgtccatcgctggatcggacgctcccccacgcgccggtctccgcttcaactatatatatttctatctctcggccctcgtcccgtcccgtctcgcctcctccgcaagtgacgtcgacgcctcatctcccctccctctttttccccgcagcgatacggcattcgtgacctcccgattgttgccaacccccctcgccttccgattgctgccacccccgcgcctcgccgcttgcccgtctcctgttcgtccctcgggagcgggaggctagggccgacagcagcgttcgcgccggcgcgggattgggttctttgttcttgtcaggtcagcgggatgaaatctcttgtttccttttgatgtttttttttgtttttgcccgaaagattttgcgttgtctggtcgattggaggaccggtgtgtgtcatgggggttgatctcggttggattcttaggttgctgcctgcccttgggttagctccgaaaggttctgatgctttgctgctgctgctcctcctggcttgtgctgttcgtgcttggggttgtgatgcctttgtccttctcgaggaacaagggaagatcgttgttagctctgtcggtggtctcctttcctttcctcggtttggccaattgtgtgttgatgcgcctgccgcactaggaaatcgacggtgctaaaatcgtttttctacccaatgtccaaccgagaaattgtttatgtttagatttagtgcagtatcaatttgaaccgcactagggaatcgacggtgctaaaatcgtttttttacccaatatccaacttccaaacttctaatttcgtttgtgtattgacgaatgcgtgccctgtgttagacatgagcagacagcatttggaggatttactaccatacacaaatctgaacaattttaacaaaatgtgttcgcactccaaaacatgatttatgatgtaatacactgtttctccacaacattgacttcttgtgtgaattcttaatggtgatagcggtggatttgttgtgtgaattcttaatggtgatagcggttgatgctgctgagcttagcagatccgtgtgcttgattattgtttcgtttcgtagtctcacattcaggatcagttattttgtttcttaaggctactcttattagccgtctatctaaattttaacactaggaatattgatgtgctcccacatttatctaaaatactcaatgtaacaaaacaacgtgtctgaatttgcgatagcctgagcttaagctcaccagttaataatattacacatgggatgagagcaatcaagaaatttcgaagatgctggtggacaaataattcagtgttccctgattctaatacagtatattgccattatctcttggttataattattttagtcggtcactagatatgtgaagtagtggtcttttcggtgtatttgatttaattcaatatgccaaatgatgtagctaatccatcattgttgtgtccacatcactttccacaccttgttttttttttcaataattcacttgtcgatggaccttatcaaccacataaagttcactatgtcatggaagcatttattggagattgggatgggatgcctctcaggcttagtcaactctgctggtttattcgtccatagctgcttacctgaatatttctatagaatcaattagaagagaggcagtattaatctagtcaggacctgccaggctgccatccttgtctaagccgccgtttgtaaactgtgggtgcatattaaatgctaactgttttgtactatgccttttcttcccaaggcatagtaactttaagttggcaatgatggttaatcttaatagtattgactttgcacacataggacataagctgtttcatttccttgctgacaaaagttccccatttatcctgatagataatacttgtagcgtagggataagaatgtcatttgtgataaaaaataaagggcagtgtatctagttcctattgaaaaaattggataatccattccatgactgctgactcagcctgctaggaaagatgatggattcttccttgatgtatcaattgattactaaccaggataatattaagtagtttttttctggcatatagacacggagttttggagctttacctaacatctgcaccactcttcagacttgttaaatgtatttggatagacttcgctggacaggatgatgtggtgtgggccaaaaagctgcattttacctggacccgcttagtttcatataaatctgttggtaccatgtggcttgcgttgttccttccattctcatttctggtgtgttttaagtttttatttctgtacaatgattagtaaagtgggccccactcagtgatgctttacttaactacatgtcatatgcattcctagtgacatatttttgtttgttgaactgcagtgctgtgtttgctcgcaagggtcatcgtgagaatggaccagatttacatggctgctgtcaataacaagacttcattgcctgatgatgagccaatgaagaaaattagtggagatatgcctgtgactgctggaaacgcttgctttgactgcaacatttgccttgattttgcagcagagccggtggttactctttgtggtcatctctactgctggccttgcatctatgagtggctatgtccaggggttggatcgactgccagtaacaacagcagtttggcaaggcgacagtgccctgtgtgtaaggctacactctccccagacatgctggtgccattgtatggtcgtggggggagtctgaagaaatcactgaatggtgtgcccattccacgacgaccaaccgtgcagcgggaggcggttgagcatcaaaacacacacaataacatcgatgatcggcaccatgagaacatggaacccagccctccaccacaaccgctgcggcattcgagccatcattccagtgcaactgaatttgattttatttacccgccatcaccaattgggcgtggcttgatccactcgacggctggtggtgtgcttggggggatggcagtggcggtgctaccatgggcattccgtggccaggtgccaccgagcatgttcatgagtccccactatgtcacggcacacaatatgagctctagagcgaggagacatcagatggaagttgagaggtcactgcatcagatctggttcttcctcttcgtttttgtggtgctgtgcctgctcttgttctgaagcaagatggtggtgtattccttttgtaaatacgggaaggcaagacactaatgggtggatgcatatggtaaaagagggtggttaacactgttggtctgtatcgataagcatgtgcctaaagcatgctgatatagagatgtaatgtgacaagacttaaggtgaaatgcacatttcattcttctcttgtcctaagatcaggaactgtgtgcctcgtccaaaccatctgagctttggtctgtttggtttgccttgcacctgtcccttaggccattttcaacccataacactagacatagttttgataaactccacattttattttaattgacgttttggataatgacacgttctacaagatatatctttgaccttatttttcttttataatatatatattaaataaatgcatatttatttttattatagtactttaaaagacaaatatatatgtatacaaatatatatgtatatgtatatatatgttattctagttcctttaaactaaatatttttaaagttattgatggtcaaagttataaaagtttgacctcaaccttgtccaaaacgtcaattaatatggaaccggagggagtactagacactactctttcaatgcaaacatcactattccatacttcaatttaatactacttatctcacatgatgtcttggatgttgtgtagaaaccatgtctcatgcaagacatggtttccttctctttcctcatttattcatttgccacatcattttttttcatactaggtgccaacttatttaatgctatggacaccatcctagtcattgggttgaaaatagcgttcatttgccacatcattttttttcatactaggtgccaacttatttaatgctatggacaccatcctagtcattgggttgaaaatagcgttactgctttacagtacttaacgcaatttgtactattagatggtgccagaatttttgaaacgtagctgaatcataaaatgagtaaacaccgattaattgaactttatgcccccacaccaggcaaattaaagtgactgactgtattgaagttcaaaaattacattttgttccgtaaggttgcatctttgcatttcaaaaaatggttagcatcttgtccatttcacaaaacgtgctttgtcacgtttgcggcagagtctcagattcgcaaatgatgaatgcagtaatacattg

SEQ ID NO: 395 - DNA, 6047 bp, Oryza sativa
tgttattagattgtggttaatacttcaaatgtgtatccgtatatccgatgtgacaaccaaacccaaaattattctccaactaaacaaggcctagaggtctcttccaaaatagaattgaaggctagactaggaattaatctcttacttatatatcgtaatccatttatcgtttcaatttccgttaccattatccaaaatatacatatttatttgtctagctatcgctattacatattaaaagaatcatagttatttccattaccattatcggaaaaaacattcatatttatctatttaattagttgttgctcctatatgtattaaaaaaaccattaattatttatatagtaatccctctacaatttttcgtggtgatggaaacatgatcaccctgtttgtatttttatcagcagtgatttatcatcagactctctttcacccttaggtttgctgaatttcagtggaaaatttgaactccaaacctctcctgtttaagctcccattggttgcccatttggccaaaatagcttatttggcttattagaaaattaaaattaatttgtaagtaaaacttttatagaactattcgtagcgacttaaaagccaacattaacaaaaaaaaattacgttaaaaatatttcaaaatcaaatttaaaaattcaaattttgacttattctttggctgtttaggccaaacaatatagctataacattgcgacgcacgggacgtatcagtactggtatcaaacaagcttttctaattttgtaactgatcttttactatagtagtttccagcgatcaaatgcaaatagccctcgaaaagaaagcagagacaaaacataataatcactcagaaaacccatccggagaggacgaacttgcaaacacagaactgtatgcctacccacgtactcctacggtcctacctactaccgtcaacttgagattttctccctgagaaaaactgattttaccgattccccccacgcacaacgcacgaaccttctcagctctcaccggtggatagatagatgatactcctcgcctcgccgcttgcctcccccattgcgctcccaccggcggccggagtcgtctcccaatccgacccaaggtggggaccaccctcctgctcggtgggcccgagcagcccggccaagtggccgccgaaacccgctataaatcccccacgctccaccagcctccgattccacagcctacctagcttctccttctcgctcgcttcgcccgcataagtctagccacaaacccgccgccgccgccgccgccgccgccgctagcttccgcggagcggggcgagatgttcatcgagagcttccgcgtggagagcccgcacgtgcggtacggcgcggcggagatcgagtcggactaccagtacgacacgacggagctggtgcacgagagccacgacggcgcctcccgctggatcgtccgccccaagtccgtccgctacaacttccggaccaccaccaccgtccccaagctcgggtacgcacccattaccctcgccgatcgatcgatctgtccaccgatcgctttcgatccggcgtccgtcctgttctcgttttcgttttcgtctcccgtttggtctccgtgtttttcctagctatagctagcgcccgatccagcgagatgtgggatggcaaaaggccaaagagggggactgcgagtctgcggcgccttttgttgccttgctgctcggccaccgtggaaatttgcctgtctctgggattcgatcccgtctgctcaaaacgacatttcttctgagttttttttatatccgctagtttttattattatggctttatcccatggctgcacctgcactgcatgtgaggtttccattaaaattttgcatctgcaagatcgagcagggggacctacctagtaccatatataccactggcaagaactcccaaatttatgactgtttattagcttcttttattagttcaccccatttgttttgtttttttttctgtccatgttggctacgtgccagcacacttgtcgatcatgtttcttgacccagttttatggctgtgggtgcagggtgatgctcgtggggtggggcggcaacaacggctcaacgctgacggctggggtcatcgccaacagggagtaagtgatcactcacgctctacttttctgcctaagctagcttcatctgttttttcttttctgaatttaactgatgatggtgtgagtttaatcaggggaatctcatgggcgaccaaggacaaggtgcagcaagccaactactatggctcactcacccaggcgtccaccatcagggtcgggagctacaacggggaggagatctacgcgcccttcaagagcctcctgcccatggtaatctgtcctgttttctttgacatgctaaccacggaaaagatggtagtagtaatacactgctaatgtgatagtagtagtgctagtacaatcataacatggccttggcctgttttaaaggccaaggttctaaatgaaaagaagaaactttgacttgtggtcatgtcctaaaaaagaaaaagataagtcctgtcacaaaagggtatcaaaagataagtcctgtcataaaagggtgtcaaaaggtgaccatcgtgtgtcacctttgtcatgttgtgatgatgcaagtcaaaatgttgtggtacaaccacaaggttccagcatctttggacaatgattgatctgttgaatacatccacaaatagttttcagatttgcagaacctgtttttccgttttctgatggttatgaaaaaaattcaggtgaaccctgatgaccttgtgttcgggggctgggacattagcaacatgaacctggctgatgctatgaccagggcaaaggtacttgacattgatctgcagaagcagctcagaccttacatggagtccatggtgcctctccccggcatctatgaccccgacttcatcgccgccaaccagggatcccgcgcgaacaatgtcatcaagggcaccaagaaggagcagatggagcagatcatcaaggacatcaggtatactggcatgcatggaattgagcccattttacttcataacaaaaaggaatagtattctgaattagttatgtctacgaggcatgaacactaggggcagaaataacggaataccttcaggcaccagcttataacagaaaatagtattcacatgatatggtgtcaaagcactaaatatatattggcactttcatatatcaaaagggctccccgaagagttatactactgaagtgaacttgtttcgtaagattagttccagtctgcattaagatggttggaacaacatgacaaacttgtgactatgaatgctgtaaacattagacatgatattttttttattacttaaatagggagttcaaggaaaagagcaaagtggacaaggtggtggtgttgtggactgcaaacactgaaaggtacagcaatgtctgtgttgggctcaatgacacaatggagaacctcctggcgtctgtggacaagaacgaggcggagatatcaccatcgacactgtatgccattgcctgcgtcatggagggtataccgttcattaacgggagtcctcagaacacctttgtgcctggtatgtaattttctgtgtagagtagtatgcggtttattttctcaggttcatggcttatttgtttactgtgtacagggctgatcgatcttgctattaagaacaactgcctgattggtggtgatgatttcaagagtggacagacaaagatgaagtctgtcttggttgatttcctagttggtgctggaataaaggtaccaaccatatatcaaatcctttggctagcttttcgcattgaaacgtcgatattcttccggaaacttttttttatatataacctgataagaactttggcttttgttttcgtagcccacctcaattgtcagctacaaccacttggggaataatgatggcatgaacctttccgcacctcaaacattccgatccaaggagatctccaagagcaatgtggtcgatgacatggtctcaagcaatgccatcctctatgagcttggcgagcatcctgatcatgttgttgtgatcaaggtttgcaatttgtccatggattcttctgcagcagtatgccattaaaaaaaaacttagttttggattaaaacttgtccatgtattcttctgcagtatgtgccgtatgttggagacagcaagagggcaatggacgagtacacctcagagatcttcatggggggtaagagcaccatcgttctgcacaacacctgtgaggactcactccttgccgcgccgatcattcttgatctggtgctccttgccgagctcagcaccaggattcagctgaaagccgagggggaggtaagagttctgatggactgagatcaattgactctctgctgctctgcaattgccaccctttttgccagcaaaattgactatgttgttgtttcacttgttatcctgtgcaggagaagttccattccttccatccagtggctaccatcctgagctacctcaccaaggcaccccttgtgagtgcatacatgcatctgtactgcccattaaccgttatgttctttcatgatataccaactgatttacttatgtcacgaaaaattcgtctcctggaacaggttcctcctggcacaccagtggtgaacgccctggcaaagcagagggcaatgcttgagaacatcatgagggcctgcgttgggctggcccccgagaacaacatgatcctggagtacaagtgagggaggctgccgaggccgagcagccgtggcatgtggcaaagaggcgaatgggatggagcaagaaagacgtgattagctagctctaagaattgttttagcttctcttgtgatttttcggtctttcccattcttaaccttctgtgctttgtgtgagactcttatcgggctatgcaactagcagcagccttactatggtactggatgatgttatggagaatgttagctagttcccctctatttataacttattagtatcggagatttcagttcatcgctgactttgtgctgagcgttttattattttctcgccttgtaacataaccaattcccccttctctgttgtgtgctaaactgctaatccgcgaggcaaacaatgcaggaaactaggcatagcatcttgttgtgattttgtaaacaagatggtttatgcagaactgcactatatgcttcgttgctcgcgttattagccaactattatgcaacgaagaggagtagaggatggtgtgatcaaaactgaaaaccgcgggcagatggcgaaatttataggtgatgcccttaccgcatcaaactagattttctatcatacacctatatgagtatactcctatatcatcctcgtaagagcatctccaacagtctctccatcctactctccaagtcaaattttagccattctagcctaaaaacgtgctctaacagcctcttcaactggccaaaaccccctatccactagtcaaatttggccagccagaaatcactggccaaccatgggtcccacacagattcctcctcccctctccttcagctcggatgatgcaggcagccaagacctcgccaccgccgcgagcatcggcttccgtgcaccaggatggtacggcggagctcctcggcgcgggcgctaggccgccgccggcggcaaggagggggccgtggcggggttgttggggagccggcggcggagagcacgacggcgagcatcttgaacccacgctggagcgccaccatcgttgtcgaggtcgctagccgctgtcgccgtcgtctgcaccgtcgccagtcgtcctcgaggttgccgttgccgtcgtctggatccggcggcgaccgacctccgttgcctttgtccccaccggcgcgacgtggattcacgcggcctccgccgtcttgccgtcgccgccttgccattcgccgccgccaccatccccatccactgcggtagccgtcgtcgtttccatttgccagtgttgaggaagaggagagggagaaaatctagagga

SEQ ID NO: 396 - DNA, 3034 bp, Oryza sativa
agaaatctacggtcaaccgacaatcaactcatggaatgagcatatatgggatcaagatgaagggatgaggctaaattaagggacacataaggctaagggatttgaacgttcataggtgggtaaaggattttctctataactgtgcgtatcataaactataaatatagtaccaaatttaaaactatagattaaggctgagtttaaaagaggttgtgattgagcttttttttttgacacggagaacaatacgagttattagcacatgattaatttggtattagttattgtgagcttggaaaatatatttatttaatttttatgaaacttctatatattgtttttcaaaaactgcaccatttaataatttggaaacgtgatcactggaaaagatggattagctcactccaacttcactttagaattcagcttttaaagcattatatctcaaaactaaagatttagtgataaagttaccaaagatcatattttagatgtaaacacaaagtatacatgcataaaaatatttaatatataaactttatacatataaatatttgaattaaaaaaaagacacagacgtttatatgggccgttcaagcccacgtcgttttgctcagcatgccaccacctgaattcggcacaagcccgcacggccgcaccgcacgcgtgtgagaccaaataggggaagtggccttcccgaaattgaaatagcccaaaggttgaaaatggaaggtggggggcgtttgtgggcgcgcgacctgcgcgcatgttagagtagaagtagctaggaaatgatctgggatcagaatatcaaatgatgttgagttgcctacttgcctcctaccaatcatcaggtaaaaagattgtgctacaattaatatgccatttggttgatgatgcaaatggatgagccaggttctctttgcatgagtacgtgcaaagagtacatcggtgtacatgtatttatagtagacatttgtagcgtgattgataaaaaaaaagcccaaaccttcaagttcacctttgcttaattgcaccagcttagccgtcatggtgaagcctgcagccgtcctcctgctcctctaccttccccttctcgccaccccgacgaggatcggcctcagccgcaaccccttcgtccctcctcccaactctgtacctaccatagacaggacggagatggacgtgagcacgtcgccgtaccgcgacttgatcaagaaatggcgagacctcgtgctcctcaacactcgcccggaggtcatggtgccggaagaccatccggtgctggctccccagtacgacgacaccgtcccgccggaacggttgctgttgccgaagctggtggccaacggggacaagacggccacgctcgccctccgcgactccaacatctacttcataggtttcgccaacaaagcagggcaatggttctctttcaaggacaggaacgacctgccgccttcctttcgggccaggcctctcagctttggagtggactacgcatcgatcgccggcttccggaaaaaccttccaaactaccctctcggtaggcgtcaaacggagtgggcggtaaaagttctttcagaatacgatccaaatcgcactgatgaagcaaccataaaacgtgcggtagtgatcatccttcttaccttctgcgaagctctcaggttctttcctataagaaatgcggttgaaataggttgggactccgttgcctacattacctcaaccgatgcggatcgtctcgtatgttggggacaaatctcatatatgcttgaatatagttttatgtccggtcattcatgggactcggaggaacaacgtactcgcctcaagaatctagcacgagattgtaaaatctttaacgaacctcaggcacttgaaaccgttgatgtgttagagtacggagctatcttaggtgctaaaagtacaaattggttgtattaatgcaaggtgtaagcgccctcctagctaatataggcgcacttccacaatttatgtactccaatattatgcaactcacatggtgtgaaagtcctgtgcaactttgcttttgagtttgactactccagtttcctatactggcctgctcgtctcgtctccatgctccatttttatttaaaaaaagtaagaagacaactccattaattaatcagtagcccagcttaatcgctaactacctaattacaaacaacatctcggaatccttcaagccaaacaaagtggctttcaagttccccagctctgtcattcgccctcccacttcacccattgctgagaaacccaagggaggagagatttcttcagctctctttctcacttttgttgccggcggccgtggagaagttgttgcgccgctcgtatgccacagctgctgtatttatttcgttctatttctcactgccattctccaggaacgccgacctggcgacctcgccacgggagcatgggagcggggccacgccgtcgacgccgcgggatcgcgtcgccgttcccaccgcctcaaggcgaatccggatgagatgctgcgccactagctttgcctcatcatcctctccgaaatgccccaagaactaataacggtgcaccgaggagggagatcaaccaccgtcttctccgactccaacctagcgcccccgtcgtcgattcccgtccaaccggtgagccattggacgattgcttgcagcagtagcaacctggattagtgtttcacatgttacatgtgttattttcagcatgcatgctgtagatcaagccatcactgtgtcgccgtcgccgcctgtctactccactgccacccgcgctgcccaacctcaccggagctcgcccatccttggccgactcttggtaagcttcctgtgagcctcagggtgctcttgcatgcctctcggattgcggcagggttaaacctatcggtttagccgatttgatcgatgcccaccgaaatgctgaaattccgaaattttgaacaaactttacttgaatttggaccaatattaccaaaattcacggaaaaaataaaaaactagaaaat

SEQ ID NO: 397 - DNA, 5339 bp, Oryza sativa
gaactgactccaactcgaggttgcagattcttccggtgaaaataaccaagaagagctcaagcaaaggcagtgcaggatcgatgcccaagcaaggcagctctgacctgatcgtcagcgacaacggaggcggctccagtttttctcggctgccctttctgccgaaatgaccattgctagattgacactctgatctgatcaccgttgcccccaaactgtacatcattcttctttcctctgcattgtttttttgttgtacataatacatacctgtgcagtgttgtaaatagtgtttgaatgttgaagaatcgaaagagcaaagctaattgtaattgccttccattcttttacagaaataaaaatatcacatttctggtgtcttagccagattaactcacagttgtaccctcatttttgtttggctgatgtttactaacgctctttgcatttcttttgtttggatacccggatgacaacgcacacactgttaggcctcctttggaacacaaaagttccccgcatcacagcagtcagcagtgacatcttcaatttcccaataaaacgaatattttacctttacgaaacccgtaaaacgaatatctcattatctaaaaaaaataaaacgaatatcagtattcttgtatatatgtatgtaagaagcaaaaaaaagaaaaaaaacttttttttcttaggaatgtctcaggagtctgcaggaacattgtttttttattctttggagaaattcaggaacattgtttatgtaaagtaggagagtaaacagtgtaagacctttgctacgaaagcaaaaaaaaaaaaaaggtttctcaaaaaaagaaaagaaaagaaaaactcaaagtagaaagaggtaacgtaccactcccgtgggccggaccaacactccttcccaaaaaagcccaaaaatatccaatcgtctcgtaaagggggctcaaaacaaaaaggcccacgaaccaatttcgcatgtgcgacccgtgcagcccatctcacgaccatctctctctatatatagaaagccccagatttttctcctctcctcctcctcgcctcattccatttcatcccctcctctctctctcaaaaccctaattccccgacccgagcaagccctaggtcgccgccgcgccgcgaggtaggtctcgcctcccgggagctcgcggaggcgcgaattggtgccctgattggttggtgcgcgtttcgggttctgaggggttatttggtttttttttggtggtttgtgtaggttggaggagttggatttgggtctgatttgattcggattgggcgtggtggagatggcggagaaggaggtcgggaggatcttcgtgggcgggctgtcgtgggacaccacggagcgcacgctcgagcgcgccttcagcgagtacggcaaggtcatcgagacgcaggtataatgattgaaataaattttgttcaagcggatgcgtgtgagcctcttttcgtgcgggaggattgttttgtagggtcgaggaacgaaggttctttttgcttaatttttgtccaattcttctgtctgtttatgcatcgcatggttcctaggcaattcctcatggatttcaattatggtttaacttataacctagaggtaacctcttgctaatttgtctcttttgatgaaaagatggtaagtgtggtagatccgctttttgttggcccgattatgtgataaacagagtcccggactataccttaacttgaatagagtatcgatgaaaaccgtttttagcaatcaattaatttttcattaataaggaaaaaaaagaagaaaagtagcagtggaaccatgtttattgagattcacgaaaaagggtaaactgttgcctacctgttggtaactgatatattaggttattaggtggatagctaataaagtcctatcgaattcacgattacaggaataaatgctctacgaagcttccaaagatggagcacagggtgtttattttgtttctgcttttagtaaatgctcttttggctttcttcattttcattctaatagcaattattgattttcagagcctgcagtcccttccagttctatattttaggaagttaatgaagttgaagggaaaagaaacacattaatcaattgggcccatggttatacattttcggggtgatgggttcagtaaaaatcaatttcaagtatccacaccgttagtcaattgacagctgtgctctgttttgtgggcagaagcagagatctgtctttgcgatgctagttctgataactgatgtcagcttaagattgcagcaaatgaattatcattgctattattaatgaattcaacagaattaaacatgactgcgagtgtggatgtgacatactgcaaaaaaattctgcataatggttctggatccgttttgataagaaaggcagaggcagatttgtttgaatcctatgattagtcaggtggtacagatgatgctgatgaatgagtgctatatgctcttacatgcttctcatttgcctggaagacaattatacggtgccttgacattgccacttccttgaaatggacatgcttaactgtgcacgacaaagaaacagcagaagataagaattaagaattagtttagatactgcaagtattttgccttgaaggtatatggcagacccaactaacatatgaccatgttcttattagaacttcatctgtaactcctttctttgcgtctgtagtgctggccaaatacttgatctttgtgtcagttagtttgatggtgagcttacctgttcctgcagcacataagacaaagaagcctacatgttgttttggcagtgtgcagtgcctaccgatatcctctagactctggcacatacttaaagttctgatctggagatcactagcatactgtaccattgggcagttaacagatttgaacttccatagggtgtttgagcagtggtaaaaggggatttgcctgttatcctttcagagttgtctgagatggtttgactggttgcatgcatgaaatttgcttcagctgttgtcacttcatgtgtcccaatttgtatgtgcatgccattgttagcgtttgattttttaggttcattatcattacagttgctatgtacccatcagttcactttcattgtatgtataggtcgtattggaaagagacacaggccgctcccgtggatttgggtttgttacattctcagaacctcgggctgtggatgctgcaattcggggaatgcataatggagaactagatggcagaaccatttctgtgaacaaggctcaacctaggatgaacactgatgatggctatggctatggtggtggtggtggtggtggtggtacttactcatctggtgctagaggtggatatcgtggtggaggtgatgcagttccctctgcaaatgatgactgcttcaaatgtggccgtgcgggacattgggctcgtgaatgtccttattccagtggaggtgggggtggtagaactggaaggtactcacccccttccagatatggcagtggaactggtggtggacgtggtgaccgctttggaggatcagaccgttttgctaaccgctatgttgatgaccgatatgatggtgggcgctatgttgatgatcgctatggtggtggtggacgtgatcgatatgccactgatcgctatccaccaactgccgatcgttttacaggtgacagatatggtggttctgatcgttatgcatcaagtggatttaccagggaaagaagctatgaaagagatggaggacggtccggtggaagttactatcgtgatgaacctagaggctctggtggttatgacagaggtggcatgcgcatggggagtggtgacagatacgggaccggtggacctgctcgctttgctgggagttacagagataggcctgccccatatgatcgtcccagccgggcagcagcacgcacttatgatgaccgctactgatggaggttacttcggagcattgcagaagaccagaattacaaatatatgttccagttcgcagttcctactttatttgccttcctgtattagtacatcgactctttgagtgttgttcttccatgcagtttgtttaattactagtgagacaataaggcagttcttgaattgttagtatgttggcacattaagctccaggcagtgggtgattctgattccctgttatcgtggtactgtgtaattaccctccagtgtaataatcgtgttccgagtgtgctgtcttatataattttattctggatagcattgaagattactgtgacacatgtggtttctggaacctggatagatgttacatctgctggaaagaaaattcatactgttcttatctgaaatgctcatttggcatcaacattccgtagtccatactacatcagatttgctcttttctgatagatattatgggctgagtagaaatggtgttatcaggccttatttttgtgaagacagtggtaatcagtgaggaatgtatgtctgcttccagttttagatgagaacagttcgttgagatcagaaggagcaaacagaatcatgtacattcaagcatatgaaatgccacactgccaagcttcagcttcacgcatgcatcattgaagtagtgaagtatgcatcccgcaaaactgaatgaagaaaagcagaatatcatggtagaatttatttctagttgccaggttcacatactggagatgagtacatgtacatccgacaacagcacatccgaaactgttacagcacctgaaatttattaacttgctgggttggctacaatccagtgccgttctaactgtttattattgtaaatcagttgagtagtgaggcagtctctcccgcgatctctctgtccataatgactaacttcttcgcaatcaccatcttattctctcgaggattgtatttactgatttgtcttctgtagctcgtagtaacctgctggtatataaaatgaacgctggaatgattaaaaagcacgctattttgtgttggttggtagatggccgatgtaagaacaacggaagacttaccgtttccagctacaggacggactgtgggagaaccttgtaggggttcaggattgaatttgggtcgagcaacttcttgatggaagccatcagttgcacctggcaacattagaacattagttgcacaattaaatggcaatacatagctagagcttaatggagaattcaatgtcaaagttaggttggtcaagtaatgcacaatgaggattactctgaagaaaacaaacaaacaggccctaagcaggacgaacagcccttaattgaagtagtttgccaacataaataagcagtccatggtgacttattgtt

SEQ ID NO: 398 - DNA, 7494 bp, Oryza sativa
ccacgcgcgtgtccctgccgcgtagccgcgccgctgcacaccagctctcgtgcccagtcgccgcttgttgatctcatgcggggagctggatgcggatgcctcccgcagttccaagcggccgcgccgtcgtcgcctcatcgtccgccgcggcggcggagatatggggaatttctgggctagggttaagtctagtgaatcacccacatatgcccacattaacacaaaacgagcccaatgggcctacgattcagtggagagtggcccagcagcgagtgctctgtctttgcccatcgcctgacgccgcacttcgcctctgcgcctgactgccgtcagcggcctgccggagttggaggttgggggtgttggtacgagcgggcggcgcgaggtatggcctcgccataccgagtcctccgtcactgcttggatgttgtgtaaaaactatgtcttatataagacatgtttttttctcttttctcatttatttacttgtcacattattttttatactagatggcagtctatttaatattccctccgttttgaaatgtttgacgccgttgactttttagcacatgtttgaccgttcgtcttattcaaaaaatttaagtaattattaattattttcctatcatttgatttattgttaaatatatttttatgtaggcatataattttacatatttcacaaaagtttttgaataagacgaacggtcaaacatgttctaaaaagttaacagtgacaaacatttcaaaacaaagggagtattatagacaacatattagttattgggttggaaatggccttacaataaagcgaatcctcatccctgttccgtaggagtaggccggatgcgcaacaggctgttgccaatgggagcaggataaggccgagattaacctcatccgcggcccactaggcgacgtccacgtcacccgaatcctctggaaaccgcgtccccctctcccccgccgtttaaataccctcctccttaagcttcctcttccgaagccactcgccactgcaaagcgctctctctctctctctctctctcgcatcgcgcgcagccttcctcatccccgtcctgatccactccacctccctaatccacagcgcgcgccagaggaaatccggcgccggtcgaggcggccgcgccgcgccgccgtcacgcccagcccactcgattcggtcgcgtgtgcgctaggaagttcgtcatacgcctcgcggttttcacttcgtgtgtttttcttttaaatttttacctgtgcttcgtttaaagcctctcttgatcttaggtatagctttgctcgatctgattataggtatgttgtatgtttctggtctcccgtgattgcgcgtggattgtgattatgactaatttgcttgatctgaatatctgattgtggtggtggtgtgtgtgtgtgtgtgtctgatttgtctgatctgttgtggattattattgtatgatttaccgtggttttatgttgtttatatataagcgtttgccatgagtctgattaattgtattgttgcggtttttcctaggtgtcatactgtcatgctcgatttttacaaggtttagtgcaaactgatagatgatgtccatccccaaaactccgtctaccagtattggttcatgtgcgagcacacgggatagttcgagttcctgtttgatattgattcgctggcgctggttgtttggttggtttattagctagagttgtttgtgtgcaaaggtgggatcatggttgcaaaggcatattgatgaatgacgattcataagcgtggaaagcaatctctgtgcaaggggttattaggattctttgtgcgtattcactctaaaccgatagtcttgtattgctatcagcaccacgttatctatttcctaaccaatgttttctgcatatggactctgcattttgcttcctctccttgtaccacacccagtaccctatgtttgtgcctctcccatggtccatctctcctgttaaaaaaataaaaataaaaataatagaatagaaaaattctagaccaaatacagggaagaaaataaattttgtcaggcaagagagcgacgaggcgatggggaacttattacttttctggacaaatccttcaatttgcctcatctatatcaatggaattgggaaagcagtggactacttaccatgtattggctactaatttccaccactccttgccagagaattgggaaagtgaattctcttatgcaggttctgtcagagtattgtaccagtcattgagatgactgtattcagtagagaagttttgtagataggttaaatttcaggtacaaaccaatgaagtaaaaaagtcttagtatgatggatgtgagaggctcaagaagttccctgattggagaagcaaaggaataagttttttatatggatgtgctatggattttaattaaaagaatggagaagtttcttttgttgaagatgaagctgttggcagctggaggtaggctcccttatgatctaacgtcctaagtaacgacgtatctgattggtgtaagctaataaccaaagccttatcatgaaaccgtcacgcttgtttttttcttttttctttttcttcttgtttcctggcatttgatgctgttacgtgttcctcttgccagagaatgggggtggacaccacagtaagtttgatgcagatggacactgttcgaattgcttgggaactcttccatggaatctggatggataccttattgagtagtaaatttcttaatacagctcgctatccagatagtgctagctgtgattgtttggtgatcaatctattgggattgtgccgactggagctgttcgacattgctttggtcttttgttgatttgcctggagttcggcagtatacagcaaccctggagtgcatgcagtggtttcctcattttttaggacctgactgcattctgtagtgagaactatcctgctaaatgcataatacttgcaggtgttttctgttgtattggcaacgtgatagtttttgtggtgcaaaacattcaagatgggcgccatggacgtacaacttgagtctactgctgttcaacatggacaagctaagataaatgtggaggaacatgctctagtttctctgttgtctgatgagaagtacgcaactgaaaagaccgaagatgtggaccctgatgattatgagaaacttgaggaagggataatgcagtatgggtatgttttttttttttgttctctggttaggcgttcttgataagctccttaagtgccaacaagtttgtgcttaatgtactatgtcaggtgtgcacattatcgaagaaggtgccgcattcgagctccatgttgcaacgagatttttgattgtcggcattgccacaatgaaacaaaggtatggttttcgagttgatgtggaagtgcaatagttaaaaagtatgtactcttttatccatactttcctaggtggttttgatgtaggaatagtcagttactcacaaaggctttgattaactgctgttcatattaatgcatatgtttgaagagcactagtgagtataaaacgtttcctttaaaaaaatcaaatagtgagcataaaatggtttaaaaaaacctaacaatgttctgatcattaactcattttatagctggatatgatttagaaatcagataaatggtatggttgtgacataaaatgaagacacagaatagaactactaaactgctgccagccgtccattatgactttggattatcatccatctgtaacagttgaaatctgttgtattttccattcttacattgaaacagtaatttgatgtatttgcttatgggctgttacatgtacacgacttatttgtattgtaccagcaatttgttggcaactataatatatccttttgttcttttcctggtgaaatatctgaatcgtcactgttttggtttatactgcatacttggaccttccttgggcagttcccaagctgaactatacaagtatctattctttatcatggtattaactgttggtttaaaaatgtggaaagttgttgacatccaaactgttttgacagaattcaattaaaattgatgctgtgaagaggcatgaactcccacgccatgaagtgcagcaggttatatgctcgttgtgtggcacggaacaagaggtacagctgagctatccttgttgcttgcattgtaacattattaattatctggcatctagtgtaatcacgataactcttttatgttaccaggtacggcaagtatgtatcagttgtggtgtatgcatggggaagtacttctgtgaagtgtgcaagctctttgatgatgatgttagtaagaagaataactattttgattgccttgtctatttgtaataagtagataggaaagcataatgacacttctttctacaatgtcaggtttcaaaacagcaatatcattgcaatggttgtggaatatgcaggtttgcatctcttttttgttgtgcaatcaatatgaactggaaaatatacttacattcgactatgtttgcagaattggtggcaaggagaatttctttcactgctcaaaatgcggtaatgcctcttgtctccaacgttgcattccgaagtactataatttaacatagcgccatttaaggaataaggattcttttagtccctgaactcttaattgatgggaaaaggatactgattgatataatgagagatcttgtttatgctacttttcccgatagagatatatgcatcatgcatgggttgtatggacttctgctatgataagattgcagttttttttcccaaaattttctctgttatacactgtatattactagatgaatatcctctacctttctggaagtctactaagatcttgcatcgttaacgttgactatttaaccctgttagctgaactagttcaaaccctcacttgaattttatgacttgatttctattatttatatgcatatgaatgaattttgctagtcacttctcttgatttgtgttcacctttgttatctgtttcatgcaggatgctgttattctatagtattgaagaacagtcatgcatgtgttgaaggagcgatgcatcatgactgtccaatctgctttgaggtaggcattcactgttcttttatgaatggttatatgcagcatactgtggattatattgttgatgagtgacttatcaccttgttttcaagttgtttcttgagtgctgatcttgttacacatatttcagtacctttttgaatcaaccaatgatgtttccgtcttgccctgtggtcataccattcatgtcaagtgcttgcgagaaatggaggagcactgccagtaagtcaatccttcttggccctttgtttactatttgtaatgatattatgagtggttgattttgacagcttaaaattgatgctcagatttgcttgcccgctttgctctaaatctgtctgcgacatgtcgaaggcatgggagagattggacgaggaactagcaacgatatctgacacctgtgacaataaaatggtaatgctctcttctctgctcttctgttgtcagtaggaactaaggaaaccatcgaatgttgtagaaaggtgttctaacttctacaccaatatgctatcatatgcttgcccttaggcatgtcgataaagtaacttgaagtatcatggagaattgtatttgcctcatgtcagaaatctgagtcttacctgcctgaatttcatccaaatgttgagtttgttgacacttgctaatttggttcctttgcattaccctgaaggtgcgcatattgtgcaacgattgtggggcaacatcagaggtgcagttccatttgattgcgcacaagtgccagaagtgcaagtcctacaacacccgccagatctgaagtggcgaagttttgatgtgattcattttgtatgggaagagagccctgggggatgctcattttgcaacacaaatcccgctaacgcctctgggaatctgatgagctctcggtcgttttcttgctcattggatgcctcagccgaggcaaatcactcgcatctgaaattcatctatgaagtggatgctgttccctcctgtgttcaatttattacctcaccatgtcgcagactcagagtcctgttcagcttaagtttctactagcactagccgagataataagtgcacgtctactcaagcttctgggcataaatggtggctagcttgtgtgttatggtgtgtacttgttgagtctcgggcaaacactgtaacggttagtggcatagtattacttcttgctcgtgtgcgtgtgtagtaggatggcggattgcaggacgtgggtgttatttactggtaggaactgtggtacttgcagtagccaccatttctcatgttcaatgccggtcccatatgccggtcttgttcagttcctataccttgctcggttgagaaaaatggcaaatctacctcagttcattttgttctgattatttaacagagggccaagtattgaattctttgggtttgcctctttgatggtgctagtatctgggctctagtagggataatggctttttctatcttttgacttgtagcatgtagcatataagcaactttgaaagttttaaattttaaatttgatagaattctaatctatatttttttatatggtcctttgaaataaatgattaaaaactattgaatctatgaaaattataaggatgtctcaattcatacaagttgtagaggatttttgtttaatcttatgagaagttccatatgtgtctatctcttatctaattcatacgtttttcttgcggtataatcaaatcttatatttttatcttttgacgattatctgttttgcccttgaacttttgtgagtccttttttctcttatttatttgttttcttaaatcttgcgtttcgaagaagtactcagaactgatttagatgttacttgctgtgtgaaagcgcttcctgtcgtcctcgcgcgggcaactggggacgaaccctagcccccgccgacaccacccttccctcctctcccccgccttcccgcggccgaagcgtgtcgtcggatctaggctacggcagtgcgggcgtggcgtcatcgacggcgagacgaagtgtgtgctggtgcggcatgacaaggtcggccgcgcgtggtggtggtggccggcgcggtggcctgcgcagcgggaggtgaggccagtcgaggcagagcccaatgaggtgacatcacgtggagattagccggcggggcgcattgtgcaatggtgcccgtgcgccggctgaggtttagatggcggtggagcaatggtgcattagtgttagatcggcaggcgatggacggcaggtgaaaacctaatacggccttgggcggaccagcaacgatgacgttcaagggtcattcccctcttgagggcgttgtcgtgccgtctcaccccttaagtgtggctgtcaagcgaaagcccagtctcggttctctttgcaacgttgacgaatgacatcggt

SEQ ID NO: 399 - DNA, 5362 bp, Oryza sativa
ctcgttctttttctttggaactgtagattcttctttattttcttttcctctttttttcgtgcaaggattgaaactgaatgttctagaccaacatcaattctctttattcatttaatgaatcaatagtcagaaaaaggaactctataaagtgaggcttgatgcacacgccgagcagccaaatttgactcacgagtgaccaatttccctgcttcatttttttttcctctcctcgtgaggctctcgtccctttgggcagaacagaacagatgcgagatgagattgcaaccgaaagaaagaacttgagcaaaacagatagaaaaaggcggaggtaattcggcacgcgaacctgatgctcctcaacacagaaaaataaattattaataataaaataataaaataataataataaaacgttggaatccaccggcctccgctacttttgtttcggtcccacactgggccgtttgcaagatgacaaaaccaaacgcaatctcagcgagaagatccccgcctcacattctccatttgtttattacgaaaatatcgcctttcttataaaatatccgcctctacaagatttcaagggcctacttgggattaagattttaaaacacctattttgatagttatgagattctttggcttttcagtttttgacttcaaatttatattctaaattgtaaaaatataaattactataatgcaggtgtaaaaaatattataatctgggtaagaaagctatactgcttaccaaaacttttaattatggaggagcttcaactgttaaaagctccgcaaccagatactaaggctggttcactttgatgcttatgaaatcctatcaaaattttagcacaatggcttgctaaaacttggtaagatttattttggatagaataatccggatagccttaaaatacccttatctacctacccctctgacacgcgggccccacgcgcacggggatttccacgctaccattaacgaatttcgtggaaataataatacaagagaccgaacgactagagattagagaaggcggtgcttcttcttcttttccagagactaccaagcccaaaccagcaaccacccgccgccgccgccatgtcgggagggatcgcacgcggccgcctcgcggaggagcgcaaggcctggcggaagaaccaccctcacgtcggtgattttttttctatttttttcgcatcttctatggccgccgattgtgtttcttctgacctggtgctttgcttgcttgctctggatcaggggttcgtggcgaagccggagacgatggccgacgggtcggcgaacctcatgatctggcactgcaccatccccggcaagcagggggtaagtaaccaaactgctctagccgaggcgccgacggcgaaccatcccacccctcttcctgtttcgatctgtttcgattatgctgctgcggatgctggtgtgtgctcggattgtgatgcgaccacgcaatcggatgcttcctctgtgtgggggagaatttaggtttttgccgcgctgttctgttggtaggtttgggaggggggggggggtagatttgtagattggattggtatctgcactggaatctctataacctgtgggagaattatgagtagttatgttggttggagggtttgaatgaagtttttattgatggatcgtgttgatttgcagtggggatttgctagggtcttacagatcttagtatgatttttttttttagaattttagtgttatcatcaattgatctagtagtaccttttatttctggacagctgggaggagttttctctgttgtttgagtgttaattacgtgattttgtagcatgagttgccttcaaacgttctaggttcagcgtatcaaatagttcttttccatcactagaggtttgcacagttgcctgcgtgctttgctttaccacctgtaaaccaggcatggagcacacggactcatgaatcccgatgcaattgcacggagtcacgggcacagttattgaattaacagggtacaaggatctgaatgttgtaagatttagttgctgaaagatggattatagtcaccatcactactgtcttcataatcaacatcacttccaaaacactttatcttgcatatggggggatatatagtaatcttcagtggcggacccaggatttcttcatgccctaggccaaatctaattgctactatcccataccataaatgagacccacactaatacataataagaagtacaatacaaattattatagtttcgaaaggaaaaaaacaacaacgcaagaaacagcatctaacctcaaaatgacagctatttgctctttgaaagatgcatctccatcatactcatcaacaaaaatggcggattttttttccaccgaaagcatttagaatggttttacccgtctcaattgcacaagatttacactgtagattttgtatttttagtgaagtgaatagatgattcccgggagaattttgaaatgtttctggtcattagatgattcccgggagaattttgaaatgtttctggtcatctttattcttctctttataccccatcaatcatctatagatttcatcgctaagcctcttcaccttctatctctattaagtttaaaacaaattgaatggaatcagaagatctataggtgatctaggccatttaggcatttgagaaatgggaataccagaaatagattatgaaaaactcacctgtcaaggtcctcgtccgctccttgcccgacagagtggaggtctgagactctgagcacctgccgcttgccgcaggcgcaccgtgcaggggggttgtgcagaaagagccttgttgccgggccgccgagccagcgagaggagctgaggaggcagtggacatggacggagggagggaagtgaggtggctgggcagggtggtgggtggctggaagcggggagactcacgtatggtggcggctggccttggagggagcgagcagggagggaggcgaggggacggacgcatcggcgtcggcgcatctcccacgagcgcatagcgttgtagtggtagcagggggaagttagggttagacaataaatagtattgggcaatagatgctagcctgacgggcctcgggccaaacctttgtgagccaaaatttctaagctgtaaccaatggggggatccattgctagttgggccaggccccaggttgtggcctaaggtgcccgggcctgggtgcgcccctggtgatcttgtgtattagttcagcatgctgctgctcaacttctattgttatgtaacaatcactctcttgacaaaccagcctagtaggctaacaaatactaattttccttcaataaatgtattattgtcatatacttattgcttctttatgttgatatatgtatattacagtgtatttttcactctgcccatggaacgccaattaggggttgcttttaagcttttcctgtttctttccatccagagttcataattgcttatgttatttgtgtgtattgctacatttgtacagaccgattgggaaggtgggtactaccctcttacccttcacttcagtgaggactatcctagcaaaccacccaagtgcaagttcccacagggctttttccacccaaatgtctatccttcaggaacagtgtgcctctcaattcttaatgaggatagtgtaagtcttcaagctgtttcttcagtcttatttatttccagtctaccgaatttatttacagttgcatcttctcagggctggagacctgctatcactgtaaagcagatccttgttggaatacaggacttgcttgatcagccaaatcctgctgatcctgcacagactgacggttatcacatttttatacaggtcggaatgaaaaaaaaatgagattctggcattccttgttcttacattacatgtcattcattgacattattttgtctactttgcaggacaaaccagaatataagaggcgtgttcgtgttcaggccaagcagtaccctgctttgctttgaggacattggcctaataaagttactacccgattcatcatgcacatccgcatagtagtttgcaaaatctcagattattgcaccagaaaatatcggattttatgggatataacctaaaatggaatgtttgaagaactgtccaatatcattgtggactttttgtgctgtcattaccatttgtgctgtgtgaagaacagaaatagctttgtcaactgttgaaaccgcttgagtgatggatgctaatttggataacaaatgaactaaatccctggtcgtaccaactctcttgaagagaaaattgccttgtactgttttgcaattcaacttgcttgtgagtcctttcttcgtgtttccataattccatttataaagcgttagtgtatctaatccaaaccataattgcgttgtttttgcatgaaatgtggtgaagttttcttggttataccgaggatgctggaagttgcagcacatgtcttttttttttgttgtatatggtagctttgctacaattggtgattaggtggcctatcacaacaaataactcggcaaatttttttgccttgcttgcatcatcacaatgtagtttacattccaatatggcaatattggagtacatcatcaatgttgtcgtcaaaccccgctgttccacatgaccatgttgatgttgtggatgggggcaacgggagtaactacgatacagcgacagagcagacgatagaagagagcagcagagccgagcattctcacttatcaagagtgagttctcctcgctgcttgctgctactaaaaaaacgatctaggagaagttcacgcgggcctggtacgtgagcccgaagcaccagctcgccggcgtgacgccggcggccaggatggtctggccggtggtgtaggaggtgaccttgaagctgagcgcctggccgccgagctgcgcgaacgcctggtacgacgcgccccagttgtggctcatccgcacccaacccccgccgccgccggccttcacccacatgtccccgacgtcgccggcgccggcgacgttcatgacgtaggccagcagccagtacgggttcccctgcagcgcgaaccgcaggccgccggcgcgggcgcacggcacgcggcggtacatgacggggacgatgccggcgcgccagtcggccatccgcatgaacgccggcttggagaggtcaaagtgcgcccgcggcgggttgcaccagccgccgccgccgcggtcggggtcctccgcccagttgggcgggcacaggttggtcgccgtcacggtgatcgccggcgagcccctgtagcaggacgccgtccccacgcaccgcatctggtagcacgtcccgcacccgtagcc

SEQ ID NO: 400 - DNA, 2851 bp, Oryza sativa
gggtaaagtaatatactctcaattgattgattctgtagctatatttatacgtacgtatatactcccttcatccagtattaaacatttaacgttgggttagttcattaaattaaaaaaagagccggctgcgaaagctacgtaatactagtcgtacgtgtcgtgaaagcttttgtgcaggtaatgttagtcgtcatctcagcgatcgatgcatactaattactttaatcaattatatataataataatataatcacaaatccaattaagcaagtccaaattggcaaggatcgataacctcaatcaaaatattaacaacacgtaggacaagattatatcatctatatacatagattattctaaaataatccagacaatatgcgtgtcaaaatgatatagttacctttgtttgaatttctccaccggccagagagttttcttccacaggatcagcatctagtgctactccatcttcattagtatattcttccacaaactgatcctaatgtactattatctcacaggcaatggatgcatcgatcgatcaacttgtagtttggttggtcattcacgcataatatatacgtacgtcatatccaaacacggatcgaactcccgtgattattaacgagataattaattaattatttaattaattaattaatcttcttgaaccggagctaagctaggtaagctatatattggctctgttcatgcactcacgtagccacatgaacgatgaagcaacctcttcaacttttcaaattatatatatatatatattcccccattgcaatactccatggacaagtgtaagtaattaattatatattgccattttaatccaatataatcctgtcgatggcgtgcatggaaattctctgctcctgccaaacccattggagaaaaaatacagatattcttgtaccagcaacagtttactattccattatggcttgcacaagtcatcgctccatcactataaatacatggcatatgtatagcaaaatctaatcacacaaccatactagctagtgatctctcgatctccatcatctcttcgtctactaacaaagttataatatcaaattaaggtatatatatatatatatagtagctagcttcaattaatggcgagttcgtcgagcaggttatcctgctgcttgctggtgctcgcggcggcggccatggcggcgacggcgcagaactcggcgcaggacttcgtggacccgcacaacgcggcgagggccgacgtcggggtggggccggtgagctgggacgacacggtggcggcgtacgcggagagctacgcggcgcagcggcagggcgactgcaagctggagcactcggactccggcgggaagtacggcgagaacatcttctggggctccgccggcggcgactggacggcggcgagcgccgtgtcggcgtgggtgtcggagaagcagtggtacgaccacggcagcaacagctgctcggcgccggaggggagctcgtgcgggcactacacgcaggtggtgtggcgcgactcgacggcgatcggctgcgcccgcgtcgtctgcgacggcgacctcggcgtcttcatcacctgcaactactcgccgccgggcaacttcgtcggccaatctccctactgattaattaattaattatattatcacactcactaattaatcatatcgtatgctatgctacgtgtttatgcatgtatggacatgtagtgtcatatggtatatcgtatatgtgtacgtataatatacgtacgtatgctggtgagaataaatccgatgaataaataaataaagctgtactgtcagccgtatttgcttagtgtatataccgtgtatgcatttacactttagctgtccttcgtggttacatgcatggtctgatggtcatgtacatatatagctggtttttgctggttaattaatttgtccttaattttgagtttatggggtttgtacgtactggttaatttatcaagccccgaatatggagattactccctctgttttctaaatatttggcgccgttgattttttttaaatatgtttgaccgttcatcttattcaaaaaattaaagtaattattaattattttcctatcatttaattcattatcaaatatacttatatgtatacatatagttttacatatttcacaaaattttttaaataagatgaacagttaaacatttactaaaaagtcaacggtatcaaataattagaaacagaaggagtactatattagatatagtcaacattaattgtggacgctgagagagaaatatatatttggctcaaagaaaattttgtggaggaatacacatgcgggtcgatgttgcacgtatcgatagttccaagctgaaaacaattattgccagggtaatttactaacacatataaaactcagttaaagttagaaaagtttgatttagtacaaattaagctaaaataacttacaatggaacagagttagtactagtatttattcagcaaacggtgcatgttaccgttccgacttacactctcatcctctttaagtaatttacgatgttaaaacatcaataattcgaagaaattatggttagacacacttaacctatctaaactctctgcgccaaaaggtaaaaggtgtgcatggcggagagagataacacgtgtaaattttggaataggattggtggaaattatttaattagtttcattaattttattagtactatgagattgttaggaccttttatctcacattgaatcaaaatcgcaacaatatctagtacagctcaaaaggtatttggaggaattgtcgaagtggaagctaagatacatacttctagaaagttccatgt

SEQ ID NO: 401 - DNA, 5623 bp, Oryza sativa
cgtcgttatggcatttttctccaccgctaccaatctccaggtgaaaactgtgatccggtttccggacgggcggtggtggtatttcaagtcgtttcctccttgggggcatcgtcttggagaaccttacccatgcaccatttgctgttggtggactcctgtgtcagctcgatgcactagatgcctatgtgcttggcgaggccttcttcttcttgtctcctttcttgtattggtggcatccagcttcttcgtctgtctctgtcgggtagagtcggagctgctacgtcgttggggtgcgatgaagcttggcatcgataacatttgcagtttctctttaggaatgtggttgttgccagtgcaggctttggcgcttcaggggcttggctgatgtccaaagtgtgagcttggtgttgctttgcttggtttggcagtgcctacaatgatgtcgtgatcgccgtggagtcggagctgctgggtcgctgggcggcttgctcggcaacgatgacacgtgccttgtgatgtcaacgctatgtgccgcctcttcagcatctcgacatcgatgttcgtccttggattccgctattgttttcgttgatagttttggctagagtggtatggagctccgtgctttttaagcctgtctggatttttactcctacttaatgaaatataattggcagttctcctgtcggtttagttttttataaaaaaaactctctaaaaatttctatgtttttctccaaatgaaaggcactaaatagagcaatttctgcagaaaccacatgttcttgccgtttcccatcccagctggaagcacaaaaataaccgtttctgttttggcacgagaaaaaagtttcgtccacccatcatccaataggcggccattatgtagccacgtgtcatccaaatttgcaactaggaggcagaggctacgcagcgcgcaggatctgaaactgcaaaaagaaaaaagaaaaaaaaaacttccccatctttctagcagctcccccccccccccccccccctaagtcctctctactgctcgctctcgttttccccatccgcaccggctgctcctcgtcgcgccgacgcctccgcgcgccagcgaatcgccgcctcgagaggcccctcgtcgccgatcaggtgagtgcccctcctcgagagtcacgctcgttactcgattccgcggctgtttcaagatcaggcaggccctagaatctgggcgaaggttctcttgacttctggtagccttcgggggtttatctgggcgtttcccgcgttgaggcgtcatggacatgggagccgtgggggattttctaggtagggttttggttggggcgtcgctttcctcatattttgtcggtggctttgctgggcttcaggggcgtggcctcgtcgagtttttttgttcctcggaggggcggcaaggaggcggatttggagcaattcgtaagactagtggtggtggtggtggtggtggctggttggcgccatgagcttcgtgttccgggggagcagaggtgacatcgaggccggaggcttcccggggttcgccccggagcgccgcgccatggtgagcgtttctgcttaaatgtaggttttggcatcctaaagtagatctttttttgttatgaatttctgactcccatctgtgtgggggggcttgtatgcagcggattcatgcgggtggtcggccggtgaacagcaacctggcttttcttgtcactggtaatgtgggcatgccctttgtactaccgatattattaagctgtaaaaaatatcgattttctagttaatgcgatctattattctttttgggcagttcttatgttgttcatggtactgaactcacaccagatgtctccgaactttttggtaagttatcaattgatggtatgtattatgcttatatagcttgatggagaaatttcatgatttgtcgggttgcgcggaattgtctcttgtaggtttggctggttttgggtgtgttcctaatggccaccagcctaaggatgtacgccacatgccagcagctccaagcgcaggcgcaagctcacgctgcagctgccaacggcttccttggacacactgagctgcgggtgcatgtcccgccgaccatagctctcgccacacgaggccgtttgcagagccttaggctccaacttgcgctacttgaccgcgagttcgatgatttaggtgatacactttattcacttaggttaattcatatactgcttcttactctcctgcaagcattacattgtagctgatgttttgcttgcagattatgatgcccttagggccttggatgcagacaatagccctcatgctccttcgatgagtgaagaagaaataaatgctcttcctgtattcaaatacaaggttcaggcacatcagggaagtgcctctttccgaaaaaggtaagatgtattatccttttggctacattttttagctggcatagcaaacgcatgataagtctacaactgccttccatctctgataagtaaccaaccatataattccgaatttgtctactttgtatgggatgtaactaaccatttaattcttttgattctatagtgatggaccatctcaaccatctgtttcttctactgaatctggcaatgaggtaataaataaatactgacatgattatgaagaggttattctttgaatggcatctactgttattgtttgcataggcatgttgacatcctggcatgactaagataggagcatagaatgtgccatctatgtgttctttagcttgtattgatggaaatcattgagcgttactccctccgtcaacaaatataaaggattctaggtggtttagcagaatttaaggtcgaggtgaaattacttcgatgctgctagcagttttcttgattgggaaatatcacgcctagcggtgcaaccatcagtgagcaataaatacagtggttggatggatttggatagtagtactacaaaatctcttatatttgtggacatattttgaaccccaaaatccattatatttgtggaaagagtacttggttactttgcggttatttcatattgtggtggtatttcttagaattaaaatgcttttttgatgttcactatagtcaaccgtggtagctccataacaatcacaaagttgatgcttacacttttatttgtctattactcagcatgcctagaattacaatcagctgtgctgtttggtctggattatccttgttctagtgacttgttttttttgctgtgtagaaaaagcaggatcgtttcaaggctgatgcaactgacaacaccctggaggatgagttgacatgcagtgtttgcttagaacaagtcgttgtgggtgatctattgagaagcctaccatgcctgcaccaggtaatcattatactagaattatcttttttttagacatgtatactagaatcatcttgagcttgttttctttgtatgacagcaatagcaggctttatttcctagttatatctgctgtgctatgatcatggtgcctgttagcgtgttatatagtaactgtcctgacattttgttaaccaaatcccaaaacatgctaggaaaccactatatttgatgccatttgcaatttatgtgtgtttagtgaaaaagcaaagggaaaacttttgcatcatttcctatagctatcgtgtttcggaaaggaattgtttctttttccagtatgctaaatgctaagtatcttactctctcctgtttctgtaaggtgtggttcgagtgtttgactgtgatggtctttgatgttgaaccttggccactacacaaaatacgtgatctgtgcttggtttggctgcttaatcttgtattcaaatttgtaccggtctgagttccaaatatgtcatatatgctcacaatttttagtaaaatttaaatttgaatgaccatagccacatcaatgacaactatatactgtgttttgttatgttcgagttttcatagtgatacgatttatcctatatgagtgaaactatcatacactggctttttgctgttgtctttcaagtttttagctttccatcgaaggattgacattggtgctattagttttttgtgtcatgaggtgggactgcaaggtttacttactttcccacttgttttgcagtttcatgcaaactgcatcgatccatggttgcgccaacagggaacatgcccagtttgcaagcaccgtgtaagcgatgggtggcatggtgaagcagatgcttctaacatggtataagctgctgggagtggccagcaggtcttaagctaaaactactgacttaacccacggaatgaggattagctgtttagtcttgaggagtgtttttgtacataaaaaaacgttcacttctctgtgatgtttatgcatcaaaaggttgtgatatttttggttgacctgtaccctgttcagtatgaactcacatacaatcctttttactctgtttccgtggggaaattggcgtattatgggtgtttaaggctgaagatcagtagaggatttaagatccaagagtagtggtctggtctctattagtcttaagtaaaaatgatcttaactgttagtattatcacaagtaaaaaggagaaactgatttatgagttctaccatcattatatttttttccttatttagggcaattaagtttttgactattttaaagactcttaactactaatttagctatgcttctatgagtttactaatgtagcctctatactacgcgcacgccagcgtccaagccgagcagcgatgctgtgcactcccactcgacgcggtcgtgctgcgacgcttcagcctgggccttggatggcaattagtctgggtttcttttatgtttcgactgaatcatttgttttgaactcaaatatcccgtatatgaacatctgggaaaaggataaagaaatggcgatactttatctcggtgaaagaaaaagtggcgctagtttatctcggtcatatccagggttttgaatctcctgctatagctgtttaacaagtgttctaactattggctctcatgtacaatttagccgctatagctccgtttagctcgctatagttgccgctacagctgtttcagaagctaattactaaatgtcttagcccgctatttaaaacattggtggtaccagattacatggttgctataaccaaaatttcgaagtactcgtacaagttattccagcactctggcgcaaacgaaactcgtgcagttcggaagctatgtggcgttgatttgtgctgggccgagcattctccgatgataagcaagtagtgggccttcttttcattgatctgtgactgtgagcatgggtttctctgcgagcacatggtttcaagggatcttctgcgcacgagataagagtgcgactgacttcctttttagattgcgagatcgggtagacgtcttagggtgctttttgtttcccttagcatccagcctaactcatatcgtttgatttgtcccaataattttatcttagacgtaaatattatcgtgcttaattatccgtattagcttaaccaagccaataagagaaaatatctgcttagttatagacatgtctatgaaaatgaaaaaaaaatcccacttaaaccatactccctctatct

SEQ ID NO: 402 - DNA, 3075 bp, Oryza sativa
cctcctaaaataagttcatttgtagactgatatttgttccaaaataacgttatttataaccctttatctatcctgatccataaagtaatatcccttgactacaaactcacaaatacttggtatagttgctcgtatttacagctaattttttcagtgctagacgatatatccgtccacaatgatatgtcaattagatatgtcatgctagtttcttagaagagcttattaaaaagatggggtgttagtgtgcacgtacatatgtaaacgctggccgtgttccttttggaaagagacgctgatcttttttctcttcaggtcaatttgaatcacgacgagtaaaattgaacttattttgggacagggcagcagcagtgagaacatgttttacgctggttttatgccttgacgcgcacgagcgcacgcgtggttaatccagaagagaagaacaaactcatgccgttagctaccggtgccggccgccttgacgacagccagctaccgagggaagagggaagagaccgcgtccccgcgtcgaggggcgacccgtcacgcgtgcgtgcgtgcgtgcgtgctcgcgtcgcccttgccttcttcccttgcaaggcaactcagactactagtactagtactagccacccatcgaatccaattccatagctcgcactttttctattctataatctacgctatctgttctaaaataaatttatttaaaagtttatatatctaatgtttaatcatccgtttgattttaaaaaatatataaaaaaaactttaaaaagataagctatgcataaaatactacgtatattttattatctaataacaataaaaatattaattattaaatagatttaaataagatatgatgattaaacgtttgatatagaatatacggtgaaaccgagggtgtagtagtttcttgctccccactcccgcgccgcgtcacgtcacgcgtgaatccaccattcccttccctttataaacctcaaactccaaccaccttgtctcacacaccacaccacaccaacatcgagcgcgtcgagtcgaatccaatccactccactccaccccgcgatctcctctcctctcgtctccggcgaagacgacgtgatgccacccagcgccgccgccgcagccgcgatggcgcagtcgccgcgcagcctccacacgctgatcagcttcggccgcggcgccgacggcgtcgacgacgatgaggccacgcccgcgtcggtcgacgttggtgacgcggagggcgccgggctcgacctcgacttcgcgttcgcgccgccggtgtcggcggccgagctggcgccggccgacgacatcttcgcgcacggccgcatcgtgccggcgtacccggtgttcgaccgcagcctcctcgacctctcgcccggcgacgcctccacggcggcgccctccgccgacacctactgcgcgtggacgccgcgctcggcgccgggctcgcccggccgcgacaggttccccaagagcgcgtccaccggcggagagtcgtcgtcgtcatcgcggcgctggcgcctgcgcgacctcgtcggcgccggcggccgctcccgcagcgacggcaaggacaagttcgccttcctgcaccaccacgccgccgcgccgccatcatccaaactgaagactcctcctccccctcaacaaccacagcagaagaagcagagcgccgtgaagacgaagccggcggcgaagaagggcgtggtcaccgagatggacatggccaccgcgcacaggctcttctacagcaaggccagcgccggcggcgaccggcggccgcagcaagcctcgtacctgacgtaccgaccggcgttcagcggcctcttcgcgctcggccggtcgcaacaccacaccgcctattagtttaatcacttggtcaataaccaaaccaactgattactagtggtagttgttgttaaattaattgttttgttgtaaaagtgttcaaaattttcggcgaaattcgagtcgagatttctcgtttgtactagaaccttatcatgtacataaatggaaaaagagaggaatgaaatttgagagatgattttgtctcagaatctgtcaaagcatcagctgctggctgcatacgcaatgtactactggtactattagcgattatttttgtcactttgctgaattgtttgttaatcatggtggatctggtttggttcgtgaggtggtggatcagacgaaatttcgcggccgcgcacgaggaaaaagaccggtcgaccatgggaaacttccattgagcacaggcatttgcagcctattcacacatgcgtaaataggaatactccacaccccagcgtatgcaaaagcgcgtcccttatctttgaacagcttttggttgctaaattaatctggattttggttactaaattaatctggagatgttaatctacatgtgtttgttatctcatcggccacaaccaaattttgaattgcaaaattcaattttaaggttgatctgtgttttttcattctagtgcatggttgcccatattcccttaactacagcggcggatgcatcgcccgacgacctcgggcaagtcagcggataatccactaaaattccatgtaattaagaaaaattgagatagaattctgtagtaaatactagctatagtaaggttagccgctactgcttaattaagaatccgaataaaaattaatttgcatatataacttttatatatgtattcttaataaataaaaagttaatgttcaaaagaaactacgtgagacatatcttaaaactaactttaaaattaaatttaaaaatttaaattttgactttgactttgatttaatagggcaaccaatgaggctgtaagtatatcaggtggtttaattctttcgaaatcaagaaaattacgatcatgaataaaaaagattaaatttccatttattaaatccaaaactattcaaaccaaacgaactttagccgaacatggtattgaccggacggcgtgtggtgtctggtgtggcgtgactattctcgaagggtgtataaaactagttcaatttccggattccggtcctcttctcatgctgctg

SEQ ID NO: 403 - DNA, 5385 bp, Oryza sativa
tttgtctagggaatttaaccttaatttatctctcgtagaacggttaggagcgatcactggaatacaaaattagtctacttcttctgataaaaaataataaaataaacaaattaattttttatttcaattttagaataaggaataaatcatgtatacatctaaacaaacatttcaccgattttaagggaagtgtttgtagtacttcatccatcagagtttacttgtgttttcaattgaatattagtaagattacggagctatcgttggtgttcatttctttaagtgagtacacagctaacatattcattgatctatatgctctttttttaggtgtgtatgcatatgtgtctttcatgtagtgtagaaaaaaaaactctcatactgtattatctcgatttaagaattctagagaattttcatatgaattgaactaccttgaaagaaaatcatgcaaattcatttcaaagatggttaaaacgtgacgagcaaacccgtcaacctattcaacatttcaacccgtactgcattcatactcccgtggtactctctccgtctcaaaataagtgcaaccatgattttccgcgtcaaactttaaccgttcgtcttatttgaatttttttttaaaaaattaaaaacataagtcacgagtaaagtactatttatgttttatcatcttatagcaataaaaatgctaattataaaaaaaaataagacgaacgactaaaattgtgcgcggaaacttatgactgtgcttattttgggacggagatagtagtagtagaacatactcctacaaatccaaacatggttttgacttttgaccttgcctaatcattcaccctgcacagtccgcatgttttttctcctcgccacaagataatccaaaaaaaccgctcaaatacaaatttaaaaagcaccagtatgctgacccaaataaataaataataaatatttttattatatacaaaaacagccgaaatgaagcgagagagagatagatagggaggctgcagcagcaacagcatcagcagcggcggcagcatcttctcttccccccctcgcagcctcgcgtctcgactcccttttcaaccctcctcccctccagtctccttccctctcttctcgtctcctctcccaccaccaccgcgccacctaccctcgccgcagcggcagccgcggtacgtctcctctccccctcctcctcctcgtcttcatccccttctcgccagatttttttggttcgattttgacttttttttttctcggattctggcgatcgatggcttcatgtgtttgtgtgtggggtttgatttgggttctcgggtgtagcgggagtagttgattttgggggagtttgttcgttcggtgtggatgttacggagctcgggggtttagtctcgggagtgtgctgatgatgaggtgtaattttggtgggggctggcgatctcctgatctcgtttgcatgtggttcgtgtgcccgaggttagattggattggaagagctggttgggaatttggggtttggggtctgatcagtttccagatcgagttttatggggggttgctttgcaatttttttactggtatttgtatttggggaatggaaattttggtttggattctcttatttgaattaggtgtagttcccatgcgattaactatagagctcgttctgtagttgtgcggattgctttcgcttgtgttgcatcctggaggagactggtttttggtggatttgaccaggtgggtattgtagttttgggggatttagggaagatgatatgaacgctgagtagttgaatttgttgggagaaggcttactaattcaaccttttggcaatcatatgggttgatgtaggagagattctagtttgtgcagttcaaaacaaccagttggaaccaaatatccattgacatgattctgtgataccgttaaactcatgttggatcgatggaaatgctaaactttgttgtgtattggaaatatactatgtttagaaatgatgagtctcaaactaatctattttcatcttgatgtcatgcaggttttaatgaaaagtagcacttgttaaagctactagttttgttagaaaatctaacatggggtcaggaaacctgatgatgaagaaggtggtgaggcccagctcttttgatttcgacatacagcttgataaaagttggacagaggatgttacttgcccaatctgtcttgattaccctcacaatgctgtcctgctaagatgtacatcttatgagaaaggttgcaggccatttgtctgtgatacagatcaaacccgctcaaactgtcttgagaggtttaaaggtgcatatgagctccctgccaatatgaaagtttcaaccattgcggtggctcctcttgatagtatccatattgtggctcctaatgtgaacaaccgcccaagctgcccattgtgtagaggagatgtcattggatggattgttatcggtgaggctcgtctacatcttaaccagaagaaaagatgctgtgaagaggattgttgttcattcgttggcaacttcaatgaacttcagaagcacacacaacaaaagcatccagactcacgcccttcggaaattgatcctgctaggcaagttgattgggagaacttccagcaatcttctgatattgttgatgtgctgagcacgattcatgcacaagttcctaatggaattgttctgggagattatgtcattgagtatggggatgatgaaactggagaagaatatgaagttttcaggcgggtcagaaggcactggtggtcttttatgtttttcaggggattctctagatcttcaagaagacgaagaagagcaagggcaagggaaagaagaggcagtggaaggaggaacagcaatcaggcacatctcgaaagctttaacctcgaggttcccacacaatctgttgacttgagagaaatcagatttgatgaaattgatgatgaatacatagtcacaggggccatacctagtattgcaacacctggaagaatggctagtttccattacaggtctgtagaaacagtctactgttaatcttccttagttattggagctatatctatcatttttgtaagaacaaagaacacatgctagtccaatgaaaaaatattcaggttgtagagaatatggaatacaaacataccgcacttttggaatcttcttgttcctgatgcacttacttttacagtacctacttgagctgccatgttatgcatagaaaatacagccgtttacattttttactctttgtcatgttccctgttttcttcttgatggcattatgcatagtgaaagcatctttgaggtagctccttttaaccgatctattgcatatttatgcgctaggtgttaagacttttggtatgtttaggtggggttagtaaagtttcaggagaggattttagtgcctgagacatgcatgtgcagtacaatactgaaaacatgaggctacctaccctaaaattttgatttcattgtggagaaaacaatttgatactaccttccaaattcagcatgagatgtaaataatatagttcatgtttttctttaaatttaaaactctaaagcatgacgctgtccttgtttcatttctgacgagttgatatatgatgttctcttgatggatccagggatacaagatatggacgataaatggtgtacttgtaggaccagctattaaaaaggagcatagtctttatgtgatgcagcgatcatgagaacattgtacctctgctcatttacatttcttttcgacctctatcgttgctaggtgctgccctgccccccagcctaaacttcctgtgcatataaattagcaacagaactctccattgatcgttcgcaacaggtttcatgattctagtttcattttgtatatatccagcacccatctctatagcgatgttggtgaaaacttctgtttttggaaaatgctggaaaaatgctgcttggatgtagcagacttcataggacattcccagaacaagattgagttcattcccagtggtttgcctggagttgcttctgtttcgatgagtagacagttacagttttcagttgtacaactgaaaactgcaactgccactgccactgccactggtcaattgctcaaaacggccttagccacaacagttacaagatttctgctgcttgacccgtgaacagccacagtggctggcagctttgagctcacgacgcatcaggcaagcgtctggaaagagtgctgtgctgattactgaagaaaagttgttctttgcttgtgatgatagcgtttgctgatgtacttgcgtgttgaaggcacccaaaagcaaaccaaaccagcaatctctgatcgatctataatatgcagtgtgttgtggtttatatttgtttaggagtcccttacagtaagacgtgttgacacgagcaggacagctaattacaatcttcttggaatctcccgtgttgatcctaccaatctccttcaaggtttcaattctaaatgcgaataatagcacgattcgatgccatgtacgatgcatgtttcatcctgatgtgatgctttgtattattgaagagcatggcaatcgtgtcggggcttcatttccattttatacatgttgctttcgtagtttcgttgcgacatttgtgcgcaaaggctagcgctgctacgtttcgacggcggcgatctatcgcgaccgtcaaatcgtggtcgaacggctgcgatttcgagaagactcttccgtgatgggcccggaagagacggagaccaaagctggcttgatgggccggcccagatattcccatttgtcacgggcgtcgctggcccatgcttataacgggcttccagcccacgactactaagcctcaggcccatgtagaagcctggtattcgggacaaacaagccgaagcttcactccgagcagaaacagtgctctcgcccctcaagccgatcgcgatcagattgacacatactacaatcacataaagaaatttgctcaattttcacaaaaatatatcattgatttgatagattaaacacgcgagtaatccaggacgagcaggataaactcgataaccaattacatacatacactttggggattttctttgttttttttttgacgcaatacactttggggatgatcagttgatcatggacacatcactgttacaccggaggagaacaagaaccctagctaaaacctccgaagcgatgagaatccagagctcttcttcgccgtggaggcggcggcgacgaagctcggtcggcttcgcggccgcgtgatcgcctgcatcttccgctgcctgtccggcgcctggatcacctggatcgtgcgccgccgcttcgcctcctctgcttcttggtacccttcccggagctt

SEQ ID NO: 404 - DNA, 8884 bp, Oryza sativa
attagtctacgtttaatattttaaatgtgtgtccgtatacgtaaaaaaaattaaaaaggaactaaacacagccatagtattttagtttacccatatttatatctcacctccatcttcacgaattaataggaataatctcaaaggtgcatatgtcaatcagctagctcatgtgggatgcatgcatgtgtacaattgagcaaaccctactccagggacatctggtctaccgagaccaccacctaccacgattcatacgattgattggtttagctagccagaaattaattggcaatcaaacagtacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcctcctcctcctcctctttctctctcctgccaccaccaccatggcaccagctcagctcagctcagacacccacacagtgagcccctctctctctcttctctctcctctttctctctcttggttgctgctgcgtgctgcggtgcagtgcagtgcagcggctgcctcccgaaagcaacaacagtcacgtcgctatcggcaccacccccacaaaacaccattgctcccccccatcgatcgatcagagctcagagaaagagagagagagccatggtggtcgtggtggtggtggtaactcggccagggtcgatgcactagtgacacaacgagtgcgagtgccctgaaaggggggaggaggagcggcttgagagggaataagctaggtggtggtggttcttggatcaatggcggcggcgagggcgccgtggctgtggtggtgggtggtggtggttgttggtgtggcggtggcggaggcggcctccggaggaggaggagggggagatggggaggggaaggcgctgatgggcgtgaaggccggtttcgggaacgcggccaacgcgctcgtcgactgggacggcggcgccgaccactgcgcgtggcgcggcgtcacctgcgacaacgcctccttcgccgtcctcgccctgtacgtcctcctccctgcgaagctcggtgttctttcctgggcagacatggcgcgcggcggcgcgggtggttgcgttcttgttcttgcaatcttctcttgtggtggctgttggttttttcttttcttttctttttccagcgtgcactctgtgcttcatgtgatttttctctcttgccgtgctcgctctggcattctgatcaggaggagcaaatagttcaactgttctgttctattcttgcctcccttttttttctgaataaaaaccttttcttggttggtctatttgtgcctagattgctgtgaatgtttcttcttgataatcttgttgttatcgtatatatctaatggaaaagaaacgggtttttcttgttatcttgcgtaggtctttggatattagtgaggctatcttgtttgttatgctaaaaaggatttttgtgatgagagtgtttccctgtgtgaaaaacaggaacttgtcaaatctaaacctaggaggtgagatctcgccggccatcggagagctcaagaatctacagttcgtgtgagtacggatatgagtagagagtactatttccccttgctttgcatctacctgagtttttgtgcatttgactagcctgtattttctttttataatcctgcacacttcacctgatttgacccctcatgccatgatgtgacacagttctttactattttactttaagcctgtggatttgctcgctgattagtttatttgtgctctaatgatttgcctctctgcagtgatctcaaggggaacaagctcactggccaaatcccagatgagattggggactgcatctccttaaaatatttgtacttcacctaatctaagtcttcttttattctgttactttttgtaacagggtgttctagctaattttttaattgggctcttttgattcttgccatgcagggatttgtctggcaacttgctgtatggagacatccccttctccatctccaagctcaagcagcttgaggagctgtaagctctactttttttaaatcttttcctaccttttctttagcaagagctatggcctatagctgttgagatatgggcacttcctctcccttctttggaaagttcaggctaatactgagacatcagagactaattgatttacattaagttttggaacatcttgttctagaatccagattatgatactgaacatcttgttggagtagtagtagtttttttcatggttttgcgatgcttgggttgtagtggtaacattttttctctctcatttattgatgcaggattttgaagaacaaccagctcacgggacccatcccttccacattgtcccaaattccaaatctcaagacattgtgagcctcttagtaccttactctatccgtgactatttacttctttggggttcttggacaaactgggtgatctgacttctacttgtttaactgtttttgtgttataatgtgcgtgccacgggaaacatggcttgctgtgtcattttttgcatcttaagtactactagttcttacttactgataaaatccttccttaattatcttggaatagggacctggcacagaaccagcttacaggcgatatcccaaggctcatatactggaatgaagttctgcaatacctgtaagaatcctataaaagaaaattgtctaactgttttagctggtagtataagaaggtatttttcaggcattaacactttgcttctcttaatcttcagaggtttgaggggtaactcactgactggaactttgtcacctgacatgtgccaactgactggcctgtggtacttgtaagtcatctcctctccctttggagatgttgctgcatattgtgcaacttggccttgttgacagtggttactgttcttaatctacagtgatgtaaggggaaacaatctcacagggaccattccagagagcatagggaactgcaccagctttgagattctgtatgttcttgctaagatttcagtaatatttcagtgttcatgagtttcagacaccataatgcgagtttcttatttgtattgcagggacatttcgtataaccaaatctctggagaaataccttacaacataggctttcttcaagtagccacactgtaagtgttcctgagttattgcaaatcctctaacatgtaatctgctgtttcactcttatgcatatagatgctttacttacagcctttatgttgaaccatttctattcatgttcataggtcacttcaaggaaatagactgactgggaaaattccagatgtgattggcctgatgcaagctcttgctgttctgtgagtagagcacgacatttcaatccataggttttagtagtttctgtaatatttttttgactgaaattcagtagtttctgtaatattggataatgaattcttatattcattttttttattctcagagacctgagtgagaacgagctggtagggcccattccttctatactgggcaatctatcctatactggaaaactgttagtatcatcagtcagactttctttttcactgagattgctttcttctcttctctaacacctactgtcaccttttccttcagatatttacatgggaacaaacttactggagtcataccgccggagcttgggaacatgagtaaacttagctacctgtaagtgattatatggtatgcagatattgttgtgctccagttggtgtggaacactataagatgttcagaaatttttccatgcagacaactgaatgataatgaattggtgggcacaattccagcagagcttggcaaacttgaagagctttttgaactgtaagaaattttatcatgtctatgagttacgtagtatgctttattttattctgtgcaattgttgaccaaattttgcatgcagaaatcttgccaacaacaatcttcaaggtcctattcctgcaaacatcagttcttgcactgctctaaacaaattgtaagttagccggtactaagtcaacttataagttaacagggcattttttactccacatgattaaacatgttttttttttgcctctcagcaatgtttatggcaataagctaaatggttctattcctgctggtttccagaagttggagagtctgacttacttgtgagtaattgtatctgttgcattatgcttacagtaatcatttaattcactcggcgaaattattgtatttcacctaatgtttttcttgcttaaaaatacatttaaaaaatacaggaacctatcttcaaacaatttcaaaggcaatattccttctgagcttggtcacatcatcaacttggacacattgtaagtagaaactttagctataattatttacctggtgttacaagacctgtgggcgctaaatgatgttcctttattattattttttgaacagggatctttcctacaatgaattctctggaccagttcctgctaccattggtgatctagagcaccttcttgaactgtatgttgcggaccaacctcctagaaaccatactgtttttaatgaaaaaaccataacttatttcatatggccattattacttgatgcctaaatggttatgctttgactgcaggaatttgagtaagaaccatcttgatgggccagttcctgctgagtttggaaacttgagaagcgtccaagtaatgtaagtgtgttcccttgaaacacatgtaactaactattatctgtttgaagccatcctatcatcatgattcagctgaaccaaaatttaaattctcagtgatatgtccaacaacaacttatctggtagtctgcccgaggaacttggacaacttcaaaaccttgatagcctgtgagttgtatatcatcataaattcatattatgcgtgtgagatcgaaaatcacctaaatattttactgagctatggtgttatcatgcaggattcttaacaacaacaatttggttggggagatccctgctcaattggccaactgcttcagcttaaataacctgtaagttttgtgtgcaagctctgctctgtagcattgtatactggtgataacttgggcaggattatttatccttaagtgcatttcaggaatttgtcatacaacaatttatctggacatgtcccgatggcaaagaacttctcgaaattcccaatggaaaggtataagatggcaccatgcacaatctctgttatccttctattagcatcttctaatttctgattgcaaccagtacataaatcataaatgcagcttcttgggtaatccattactgcatgtttactgccaagattccagctgtggacactctcatggacaaagaggtatcagacaagaagctaaccccttgtagcttttcactccatttgcttttctgctaaacacatgttcacttaatttctattgcagttaatatttcaaagacagcaattgcttgcattatcttaggctttatcatattgctctgcgttctgctgttggctatatataaaacaaatcaaccacagccacttgtcaaaggatccgataagccagtgcaaggtatgtgtgcgctatatctcacccctccagttgtcgtcgatgaaattaacagcaagtatgctggcataatggaattcatcttaaccttttcttaatcatattcaggacctccaaagctagttgttctccagatggacatggctatccatacttacgaggacatcatgaggctgacagagaatttgagcgagaaatacatcattggctatggcgcctcaagcactgtctacaaatgtgaactcaagagcggcaaggccattgctgtcaagcggctttacagtcagtataaccatagcctccgagagtttgaaacagaactagagacaattggcagcatacggcacaggaatcttgttagcctccatggcttctcgctatctccacatggaaacttgctcttctatgattacatggaaaatggttccttgtgggatcttctccacggttagggcttgaaacctttggctcatggataatttgttatcattatgcatctcccttatgatctatatatgatccttttcaggtccatcaaagaaagtgaagctcaactgggacacaagactgaggatcgcggtcggagctgcacaagggctggcctatctccaccatgactgcaaccctcgcataatccacagagatgtcaagtcctccaacatcctgctcgacgagaacttcgaagcgcacctctcagatttcggcatagccaaatgtgtcccctctgccaagtcccatgcctccacttatgtgctaggaaccatcggctacattgatccggagtatgccaggacttccaggctcaatgagaaatctgatgtgtacagcttcggcatcgtccttctggaattgctcacagggaagaaggccgtcgacaacgaatcgaacttgcatcaattggtaagccaccccacttccacagttccactccatcctctcatcacattgtgcaaaattatcaccaattctagaacttttctagcatgatccaatggatgatttgtatgacaagatcttgtgtcaatgttcagatactctccaaagctgatgacaacacagtcatggaggcagtggactcggaggtgtcagtgacgtgcacggacatgggactggtcaggaaggccttccagctcgcccttctgtgcaccaagaggcacccttcagaccggccgaccatgcacgaggttgcaagggtgctgctctccctgctgccggcctccgccatgacaacgcccaagacggtggactactcccggttgctggcgtcgacgacgacggcggccgacatgcgagggcacgacgtgaccgacatcggcgacaacagctcctccgacgagcagtggttcgtcaggttcggcgaggtcatatccaagcacacaatgtgatcttctccaaacctccaaaattttctcctccccaagatgctaaaaggatagtagcacagtgcaggaaatagtagctagatgtaggatctgaagttagatgaccatgatgatgatgttaatgccattgttcttgactctttcttcttcttggtgttgatctaggattgcccaaagattgtccctaggaatttgcagtgacatactagtgttgttcatggtattcaagagagagtgagtagatcagtgtcaggttcagagatgtctcgtgagcgccatgaagtcgccgtctttatgatgtaatatattttgatcagagaggcagagggaggccatcagttcttggatcctggggtgtgtgacgacgccgcattgaattgaaaccatgcattcctgcatcgacaggattgtgctaatgtaaatgccctttttttgacggtatttattagttgctctgcctcactcttgctgtgctgttagtgtacgtctgtttgctgctgctgctgctgctgctgctgcctctgaaactctgaatctccatgcctagtatttatgtcctgcttcgttggctcgttgctgtgtctgttcatcagacatggagtgtagctggctggctgctcttactgttgaatgatattcatagctgctgcctgtatccactcctaggcatgtcactgttaacttttgcattgaaagaacagtaatccaattccttgtccttttacttgtttcctaggctaagggtttatgatcttgattggctagcgaattcccgagccccttcaagacatcaattttccattaattttgaatgaatttcagaaaattttgaacaaaaccattcgatatgcacatttcgagccagctcaaaagatgttagaaattcgtcgagacgttaacccttcctagcagtagcaatcttctcggctaggactagggttcaccttttggattgagtgctggatcccagcccccaacgagattgcatttttctgcaaattttgaataaatttcatttgaatttaaccatttcaaatttgaattctcaaaaaccattcgacatttcacccggaatctactttcgtcctgcgttggaacctcgaaattccgtggtttttgattggttttcgtcaaatgatgttgaatctgtcacaggttctagcagaaactggactggactgtgaactcctattggggcgtcaaaacgcaagccgtcctagtgtcctccacggccagggcgtcctgaccattccgtgcatcatcgtctgctagtcaatggcagatctgcgagcaaatgtcccttccatgctttagccggcctggccccggtcgacgcgacgtgccaacacgcagccacagcaacagcagcagcagcagctaacttttgttgagatgagatgcctgagccgttctgatcccatgctactccagtatgatggctacac

SEQ ID NO: 405 - DNA, 4514 bp, Oryza sativa
caaacttccaattttgatgtgagctaaacacataaagccaattcagcaaatgtgtcctatgtggaaacacaaatacagaggtcatggtttgattcgaagtcgtataaaaccattagtttcttgaacaaattaattttcacaatcatcatgccgacttgaatgtgctctgctcttctatctgcaggacctagtagacatgtgaaccaacatgacccgcagcatcgtacgttgccgtgtcgagtaccgttgtacctctaccaggccaagttgctgtctgaaactctgaatctatgagagtgaacaaacatgaccaaggaaggtccttgcagctcctgttctacctgtcagctgcctaaattaaacatgcatgtactccaacctgcagcatctattatgctacattcgttctaaaatatagcaacatatgagatacgtcctatgtttcatattataaattgttttgacttttttcctaatcaaacttcttcacgtttgactaagttcatataaaaatatagtagcatttttaacacaaaataaatatattatcaagatatattcaatgctagatttaattaaactaatttggtgtttaaaatgttactatttttctataaacttagtaaaacttcataaagtttgatcagaaaaaaaaggtcaaagtgacttataatacaaaacggagtgcattctaataatacgaatttaaacaggcccctgtccagattcatagtattagaatgtatcttattctatactaggctgatatattttaggatggaagaattacattaaacctcatgtgttccccatgatagatggataggctgatgcagtcccccgcgtgtgttctctgtatatacatgcattcctcatgcattcctcttacttgtccaaataaaacataaaagcatataccagcactacatagctaaaccgttactaagcatatactcctcccttctccaattcagccattattcacctatcttctccagccatgccacctcctctctatgtcttgctactactcagtgggcttctcctctcctccctgcacactcctccatgttccgccgccattgcagatggcgacactctcatggtaggccaagcgctttctgtcggcgagaagctcgtctcgaggaacggcaagttcgcgctcggcttcttccagccacaaccaactgcaggcatcagtaagtccattaacaccaccaccaacacattgcctggctggtatcttggcatatggttcaacaagatccaggtttttactacagcttgggttgctaatagggagaatcccatcactggccctgagctgaagcaagcacagctcaaaatctcaagagatggcaatcttgccatcgtcttgaacaacaacaacaccagttcagagtccataatctggtccagcactcacaccattgtcaataggacaacaggatcatccagcacaaacaccagtgctctcctcatgaacaatggaaacctactcctcatggctagtagcaatgttgtgttgtggcagagcttcgactaccctgcagatgttgggcttccgggtgctaagttaggtaggaacaagatcaccggtttgaaccgtcggttcgttgccaagaagagcctcattgatatgggcctcggctcttacatccttgagatggacacaaacacggtgttgcgccttaggcgtcgcaaacctcccgtcgtggtgtattggtcttggtcatccggacaattggcgtatacgcttgtaccattgctcaatgagctgctagacatggatccacggaccaaaggcttgctcaaacctgcatatgtccacaacaatgaggaggagtacttcacgtacacctcccttgatgaatcggcttctgtattcgtttccatagacatcactggtcaggttaagctgaatgtttggtcacaacccaaaatgtcttggcaaaccatatatgcagaaccatctgatccatgcagcctgcacgatgtctgtggacctttcacggtctgcaatggcaattcagtcccattctgtggatgtatggagagcttctctcccaagtcaccgcaggattgggatgccggtgatccgattggagggtgcatcagagatactcccttagattgtgcatctggtaaacaaaacaacacaagttcaacagacatgttccaccccatagctcctgttacactgcccttgtaccctcaaagcatggaagatgcttcgacccagagcgattgcgaagaagcttgtcttcatgactgcgcttgcactgcttatacctataatggtaacagatgctctatctggcatggggaattgcgaagtgtgaatcagaatgatggcattgataatcattctgaaaatgttctttaccttcgcctcgccgccagagattcacaaagtttaaggaagaacaacaaacggagaccaagagttgttgccattgtaagcattgtcgttagttttggattactaatgctcatgcttttgttaacgatttggattaacaaatccaagtggtgtggtgtgccattatatggcagtcaaggtaatgatggtggaattatagcctttagatacaccggtttagttcgtgctactaaatgtttctcagagaagctaggaggaggtggttttggttctgtattcaagggaatgttgggagaccagactgctatagcagtgaaaaggcttgatggtgctcgtcagggagagaagcaattcagggcagaagtgagctcaattggaatgacccaacatatcaacctaatcaaactgattggtttctgctgcgaaggtgataagaggctacttgtgtatgaacgcatgttaaatgggtctcttgacgcccatctatttcagagcaatgctaccgttctaaattggagcaccaggtatcaaatagctataggagttgctagaggattgtgctacctgcaccagagttgtcgcgaatgcatcatacactgtgatattaaaccagaaaacatacttctgaatgaatcatttgttcctaagattgcagattttgggatggcagcgattgtaggaagggattttagccgagttctaactacattcagaggtactgtagggtatcttgccccagagtggcttagcggagttgctattacaccaaaagttgatgtttacagctttggcatggtactattggaaatcatatcaggaaggagaaattcacctaaagtatctgctagcaacagctatcatggtgcttattttcctgtgcgagcaattaacaagcttcatgtgggagatgtgcatagtttgatggatccacgattacatgacgacttcagtttggaagaggctgaaagagtttgcaaagttgcatgttggtgcatccaagaaattgagtctgatcggccgacaatgggtgaagtggtccgggccattgagggtctacatgagcttgatatgcccccgatgccaagactacttgcagctataatagaacactctgatgtggcttcaatataatagtttataaatgcttttgtggtctacatggtaaaaaatttgttttaagcaaattttatagttttagaatggaataaataggtgcaagctgtaattgttgaattatgtatagtcagtcgggcgggctggccaaagtacacatcctgttttcaccgctagtctcaactcctcatcctcaatgacgtcatcctccgccgcagtggactgcatcttgcttccagacatgtagctcgaggtcctgctacacctccctaccaagtcgatctgccatctccacgccccggcccccgtgcgtggctattcttcaccttgtacacgctcttcatcgccgcacacgtcgcttgccaccctggatcgcttcttgcactgtcgacgtgcagacctttcctagactattgttgatgtaaaaacacaaggcctgagaaatctgcttaactctagtgcaggtccaaaagcttgcctttaggttcgtgagcatgccagttgatttgatcatgcaatcaacaagaaataaagacaaagaaaccgcggttaaatctataaacgatagccgatcggctagtggccgatgacatatcatttatttttaagccgatgtcacatatagatcgatcggcaatcataaataagtaagaaagaactaaatctactcgatcggctgtagatattaacaatatgtagcctttatgtcgatatatacttaaatcaagtgattgggatagatcggtcgccatgccgagacagtataaatcacttagatcgaaatatatattaacaataagactatatatgttcatagcatagccgatcagatagatctagcgtgtcttgggtaatactccgataccactctatattaagatatcaaagcaagtaaaatataccaaacaaaagcctaatatacttaaatgcagcaagatcttaacataaagggcagatttaacatgtcaatcaagcatatgagataaatatagttaaattaggtaagattggctgaaac

SEQ ID NO: 406 - DNA, 4232 bp, Oryza sativa
atatattggtttgaaatttgttattttcatatctcacaaatgaagacgagtttggataaaattttctacatggttgtgtaacatcttctcatctacatgtggctttttttttaatttttcacctaaattagagtatagaccaaagctctagataaaatcactggattaattgattgcgtcgtactatcattgcatgtgataagctgtacagtgcctagcagaaaaatctatgttgacctcgcaagccaaaatatccatactattcagtatatttcctaagtccactggaatcaaatgtgagtattcaatatcctacacgcgtttcttgctctggccaaaattggcacgcaagtttgacaaaaagtcaatcattagtactcccgcaaaaaaagagtatgtaattatatctgagattgatgaggtttaacataaagtatactattaaggataatatcaagtagggattgttctacccgcaaaaaaagaaaagaaaagtagactgttcaactgaacttgatcttccgggatttatcatacatcgataactgtgatttttttatggctccatgaaaccgtgatcattcctacagtacattgttcagttcatcagtgtatatttatgtaattattagttgtagatgacaggtatagtacgtcatttttggctggttcttgacaaaatggttgtaccaaaatgatgtaatgtaattaatttgagaaattttgtcatgacgcagaataccactactcaacagtacacattgagaatatagtacaatactccgaagttttatattgaagactacgcgtgttgaaataaaacagtatgtcttctatcctttttttcttttttggaaaattgcaaccaaatcatcctaatgcgtcatattttcaactaaatcgtactcgtcgatcttgacatcttcagataatactgacaacctaaaagctgtttaattcttattagaatgtagagatttaacaacagaagcaagtttggcgcaaacgccatgcggcgtcccgagctaatcatgcggtcccttcctctaattctcttcctaagccttgggagtttccacctcgccgcagccgccgttgatgaccagttcaccttcgacggcttcgccggcgtgaacctcacactcgacggcacggccgtggtcacgccgggcggcctcctcatgctgacgaacggcacgactctgctgaaaggccacgccttctacccttctcccctgcgtttctttcacgaggcgacgagcggcggcggatcctccaccgtgcggtccttctcgacggcgttcgtgttcggcatcgtcagcgagtacgccgacctgagcagccccggcctggcgttcgtcgtcgccaagagccgcgacttctcgtcggcgctgcagagccagtacatgggcctggccaacgcgcgcaacaacggcaacgccagcaaccacttcctcgccgtggagctggacaccatcgtcaacgccgagttcggcgacatgagcgacaaccacgtcgggatcgacgtggacggcctcgcgtccgccgccgccgacgacgcgggctaccacgacgaccgcaccggcgcgttcgtgaacatgagcctgctcagccgcgcggcggcgcgggtgtgggtggacttcgacgcgcgcacctcgctcgtcaacgtcaccatggctcccctcgagctgcccaagccgacgacgccgctgctctccgccgccgtgaacctctcggccgtgatcgaagacgaagcctacgtcggcttctcctcgtccaccggcgtcgtcgcgagccgccactacgtgcttgcctggagcttcaagatggacgggccagcaccatcgctaaacgtatcaaagctgccggcgttgcctgtcacgatcgccagggctccgtccaacgttctgaagatactattgcccatagcctcggccgcactggtgtcggcattggccattgctgttcttgtgattcaccggagacgacgcaggtatgcggagcttaaagaggagtgggaggttgcgtttgggccacaccggttctcatacaaggatctgttccgtgccacgaatggtttctccgatgagcgattgcttggctttggaggatttggaagggtgtacaagggagtactactggtatcccgagtggagattgcagtgaagaaggtatctcacgagtcgaggcagggaatgaaggagttcattgccgaggtggttagcattggtcaacttcgacaccggaaccttgtgcagttgcttggatattgtcggcagaagggtgagctactgttagtctatgattatatgccaaatggtagtcttgataagtatctgtatgctgagaacagcaaaatcttgagttgggctcaaaggtttagaatcatcaaaggcatcgcatcgagcatattgtatctccatgaggattgggaacaagtcgttctgcatcgagacatcaaggcaagcaacgtattgttggacgccgaaatgaactgtcggctaggtgactttggccttgcaaggttatatgatcgtggcaccgacccacacaccacacacgtggttggcacaatagggtacctagcccccgagctagggcacaccggcaggccatcgaaggcgtccgacatcttcgccttcggtgtgttcatgctagaggttacctgcggacggcggcctgtcttgcaagacacgaacggcggtcaactcttgttggtggacatggtgctggagcattggcggcaagggacggtcactgacgctgtggacccacggctgcaaggcgactttgccgtggaagaagcaagcctggtgctgaaactatgcttgctttgttcacatcctctgcccagtgctcgtccgggcatacggcaagtcgtgcagttgctagacggtgccatgccactcccagagctatcacaagctcacctaagctgtaacatgctggccttgatgcaaaatcagatgggcaactcatgctctgttgcgtcgtcggtagctggtaatatctctgacattcctcgagcgagatgaccacaaggttttagtctcttcgctataggatttgaccatagtgatagattactcggtgaaaaggaaatatcgtagattactctgatgcaatttaccatgcaaaagtttaggtaagacttgggagatgattctaatctctcgtgtggacgttcacttgtttatcacatgtcaactaaatgattgtgaattttcaaacatatatgtaggcagagtccatattagtagttatttattgtttgcttatcaaggtagtgtttatttaaaagagacttatctccagttcaaagatagtgttcgtccaactatgtactgtattattaaatgcatctctcggattcgattataaatacgattgatcattacttctgaacaccatggtgagagagttataggtacatgactttattcattaggtttttaaataatggtaccgaggatattaaagacgcggaaaatgtttctagtggggttcgctgctgcatgtgcgtgcacattttttttggaccgaatgtgcacaacatgcatgccgcacctcctgttctatttgcgcaaagctcaccaggccagccccttctgcatgcatgaaatcttcgttaacttacttattcggtctataattagtttacatcattgtattcattgtaattaaatatttaagatattatataattatatttttctagaaaaatattcaacatatatgttattgtgtttcacatatctttcaaatatttatatgactaaaattttattttaacaatgtataacttgatgttggtgagccacaacattttaaacatccaattttttgcactagattagacacccggcatctagtcacgtcctaaacatacacgtgtgttttcagtaggattttagtggggttaaaatttaccgttcgcttctatcattttgaatgaatattaataagtgggcgtacatgtaatcagaaaaatagaatgtgaatatacggtgcttcataagcagcattatcaaatagttttcttgactagttaccggtatgcagcgtgagcacgacattgtgttgaacttcttccttgcacatgcaagtatgcagcacatcacgtttgacttgtactttgtgctctattagttacggagtactatatagtaatttcttcaatgaaaactaaaggtatcttgccgaattaaaatgctgatcaattctaattttgg

SEQ ID NO: 407 - DNA, 13610 bp, Oryza sativa
tgacaaactgacaaaagtacaatacaatcgaacatcacccctctataaactggacaacttggtccattagctagttgggctacactgaacgtataataattaaggcccagtttagtctacactaaataaggtccgttagctagttgggctaaatctgtgcccaacaaagcccatatacggcccatgtttacctccatgttgcaagccggctaaatctggcctaactatcaggaaccaacaggttagaataggttcactttgatcccttaatttgaccctgagtttgaaattcgtcgaactgaaataccagtataacccatcccccactcccaataccgtatcaactttgatctcaaggcaatacgagtcctgggttttgttcgacgtggcacattgactctagtcagatgtgctaactcggacataccgctgggagatggtaaatgggcatcattctgacgaaacgaccccagacagccgggcttggtagtaggggaggtaacgatggcgaggggatttcttcgccaggagctcaagtggcctcacgatgagcggaatctcatggtgaccgtgtcgcacaagtggactcaatgcgccacgtcggatgaaattgggagttatactgccttaggaccaaagttgctacggtaccaagagttggggatgggttatacctgatattttttttcagggatgaattttagactcagcgccaaattgacggacctaaagtgaatttagcccatatacagcacatcaggtttatctccacgtggcaagtggcaacacggcccatccactgtacgatatgacgtggcgggtcaatctcactcccaaggtcccactcgagatagctgcgacggtggtgtgcgcgtagcaattaaagtgggagaggcgacctgaccaacccaccacccccctcgttccggtcgcggactcgtacgtacggccccaaaaccagatttgatagcagccgatacgtccgccgcggcggctgaataggagagagaagagaaaaaaaaaacaaaccacaacgaactaccccctcctcgtcgagccgacgcgagagaggaaagtgggttgcggcttgctgcgcgtgtggagtcgccattccccaattcgctgcgccgcccgccggatctcgtcttgccccctgcggcggcggtttgggcccccccttccgatcggtttcccccccgcacatggtcgtggcggcggcggaggtggtggtggtgcgggagtagggaggcgggcgaaccgaggcggcggcgccgatggcggacctggtttccagctgcaaggtagactcgcgttcccccgcccgccggtaaattcgaccccgatctccgccgattccgcggcgtaattcggcgccggggggggggaggggattcgttgcgtcgcgcgcgtctgttttggggcggggaaggttgcggcgtgcctggccccgcccttgctcgccgtgtttgcctgtagatgatgagatgattagttagttttgtcgatagttttagttttttttttccagtggttgctgtggagtttattagtgcctagctctctggcgtttagggttgcggattaatcggtgatttcagtatagcacctggcgaggggcttcactgggcagttcaattgcttaggctggcgctttcgcttgttggcaaatcccccacatttgcttgatccgtagtttgtcccatgctgtatggttttgtatcatacgggaagcatccagatgtttcatgtcatactaatcactaaataagttgctcagaaaattgctaattttcactttcttcagtttggtagtttgggtccttgtgttccatgacagttaatttagcatggttagttgcgtcatgcttaattccaggcaagagtatctctgctttgatttggaattgatcccagtatttagtccatggatcaaacgccagttgtaccttatgtatgtgtcatgccaaatgaattgctttggtaactttagcattgacccctttgcctttttcattgcaggataaactggcatactttagaataaaggaactcaaagatatattaaatcagctcggcttaccaaagcaaggaaagaagcaggtcagcaaattttgttcctgttaatcttttttacatcaccatctatcagacggcagtttcaactaaatgagaatatgagatgtaagcttttgaggtgaaccggtagtatagactctcataatacagcattggtgggatctttggtggtaatggtggtctgatatgaagagctcatttcaatgagctatttcttagctcgttgtcttttgttttctgatatacttctcttatattctcacaggatcttattgatagggtgttggcactcttaacagatgagcaaggtatgcatttgtctgttgtttctgcttccctggtctatgttagtaccttacatatcaagtcatgtactgacatgctaaaatttgcactgtttcattccctgtatttgtttcagtggtgtctaatccatcagcatgaacggatgatgccttttctattttctagtcttaaaaacctaaatttgtgtgttcttttcttgttgcaggtcaaaggcatcatggatggggaaggaaaaattctctcaccaaggaggcagtggcaaaaattgttgatgatacatacaggttaaatttcattgtttcataaaattgaccatgtggcataatagtgtggatatttgagatgaaatcagtggtgcttctcttttgagatctttatgccttcattagcaggaaaatgcaaatccaatgtgctcctgatctagccaccaggagccacagcggatcagatttcagtttcaggcctatagaggaagcctatgactctttccagccagaggccaaagttcgctgcatttgcagtagcacaatggttaatgacagcatgatccaggtattataacattttttatttcttacattcctttctttttgaaagatcgttacggcatgtgccatccctctttttattattattatttaaatcatgtatcatgtctttctgcagtgtgaagatcagcgatgccaagtgtggcaacatttgaattgtgtactcattccagataagcctggggagagcgctgaagttccacccgttttctactgtgaattatgccgactgagtcgggcagacccgtatgtctttctactatttgatttttctttgggtggggttaagcaggtaaatctgtggtggaaaccactgcattttttaaagaaaaatcaaaacaaaaacatatttagggaaggtgatagtacatgctcttgtaattccatgtgcaaacttgattttgcttgtgagatatgaaaatggaaaacagtgaacgaaaagacaaacatcaagaattcaagatgtgtggcttttaccttgttgtttctcaatttcatatctcattaatgaaattagttttgatcttctgatttcacacagtttaataatgtatcacctcctctgtgcatgagattacttggggattttttgaaacttgtacaaaatggtttccagtttatcaccatatattctacaaaatgggattaagttttgatttgctgcagctacatgctttgaatttgcagattttgggtcactgctggaaatccattactcccagtgaaattcgtgtcatctggtgttacaaatgatgggtgggtataaatggattcttcttactggcaacattttaactgataataatccgtggctgactatttatttattattgatgctcttctttctctatttcgtctttgcaaaaatggcagtttttccaacacctttatttacattcactggtagctcgctaggctctccctttcagtcactccttcaaatagaaaaacagttcatgacacttttttcatcatgcctcttaaatttttttcattgttgcacaatcatagaatgtttacagttacactacggctcataattacatacgtaggtaaaatccattgttgatacttgatagtcatgagtttactttgtcacatgcctctccatatattgtacaaggctcttcttagtagttacttgtcacattataataatccttgtaacatatggtaaattctccagttaacgttatctgtgactatacaacattttgtctagcacatttatggacaacagtatgcttagaaggttcaattgctattctatttactctaaattgtctcgtttaatgatcatgtgttacttgtgatgtatgacatccttattaatcctctcatatctttagaacaagtgtacctcaaagtgtggagaaaagcttccagctttctcgatcagatagagaaactgtccagagacaagaatatgacctccaggtttgttctattctacaaagctaagttaaatatgcttgagttttggagtcctcagttcaacttaatattgcgtcaatattgtaatatcataatgctcttgagtaccaagtaagaaaccatatgggtttatgccactcagttgtttaggacgttcataagtttttttgttgattttaggcttatatgaatagctcttatcaatggtgaaggcaaacctttgaccaattcattttccttttgtaacatggaattcacacaatatgagtaatgcgtctattgtgcaattgttttcattggttgtattgtgaagacaaagcactgtggataagttatgttctctatgtaacatgaaatattcttaatttgttctgttacaagccaactgtatttactttgtgttgttgcaaattttcatctgtaccatgtggatgctacttgctagcattgtacaaagaaattttctttgtgcaaaagtttgaatttatgtggaccaggctgatttcgaattcattttgtccaatgatgaaacatggtttaattcatttcgtattgtttttttccttgcataaatctaagatatgcatgcatatattgtttgtttatactatctgaagcagtgaatgtgttgacaggtttggtgcatgcttttgaatgacaaagttcagttcaggatgcagtggccccaatatgcagaattgcatgttaatggtattgttgatgattttgtagcacaatttgattcactttcatatttgaattgcatcccagcttaaatattgtcttatatgttgtgcagttatgctgttgttggttaatacttcacgttggtctttctttaaaataagttactatctgtgtaacattagtttcattttatgttcaggtatttctgtacgagtagtgactagacctggttctcaattactagggataaatggacgggatgatggtccactggtaagttcaatttccttctgtcacattggtaagatctagatactaattggcagagatttggctatcctatttgatattcctgtatgttattctattttaagttgtgccatttttgttgttctccggttgacagaacctaacgttattgagtggagttacaaccttaaaatggaaccatgttatgttacaaaacctttgggcttgttttcattgatctgtagttaaaatttgctttatcttctagtggcggcctgtaaaaatttgcttctgtatttttaatgctcctatgaaatctcctaaaatcatattcgcagtaactcttaggtggaaagtctcattgagaatcttagctggatgtgtttagtatgagaaaaatttactgcccagtttgaaacagattattgactagattattgtcatggattatttacatgatcatagatatagattaaatatttgataaataaacttaacgaatacagcatagaacaagggatctaaataatgcagtagaagaaaggttttttttttttttgagaaaaacgtagttttagaggcatggagcaaataatctgtgacagtaatccagttaagtagctgaaaagaacagggcctggttgaagatccagttaagcttgcagagtcttgcagctaggggtgatacagttgaaaaccagcattaaggtttggaagaatagtgcattctcttagtttaggaagtactgtgagaacaaccatcggttgacagtagttgttgtcttatctagtcactaggaatcatggccatgagtctgaatcatcagtcgccacaacagtatcacctatcttacccagtgggcaccagccaccatgtgaatcttgcatatggagagctggagacttggcttattgcttattctggtttctaatgattgtaaggctttctattcttattacgcatatcctgtctacgaaaaaggacaatatgccactccattcgttgggtttagacgaaatgccacccactagaatgcaaaggataaaatgccactcaataggttaccttcaggatattttgccactttggggggattttaagaccaaaatacccttggctgtggagagagagaggaagaaagggaaatggctctgctcgccggtggcagcggtgagcgtgcgggggtgagctgcgatgggggaggacagcggcgacgatggggggaggaggacggcagcgctgacgggacggcctcacgcgctcgcagcttgccacctccggcgcctcccccccccctccccccccccccccccccgcgcgtttgccactcaccgctcgctgctcacggcaccgccgtcctcctcccccatcgtcgtccgcccctgcacactcaccaccccccgtcggcaagcacggacactgcccagcttgaccttctccggcgctcccctttcccctctttcttcctctctccacagccaagggtatattggtcttaaaatccctcaaagtggcaaaatatcctgaaggtaacctattgagtggcattttatcctttgcattctagtgggtggcattttgtctgaacccaacgaatggagtggcatattgtcctccttctcctacttggcgttatgcttccattttaaatattcccaggcatagggcattatttttacatgaagcaagctttcacatgcattctttatatagtaacgcttgttgccacattgctttacttttaattatatttccaaagttttggttctgcatagcttgtactatcattctcatggttgttttccctttatttgcagataaccacatgcagtagagagggaattaataaaatttgcttatcaagggtcgatgctcggacattttgctttggtgttcgaattgctaaacggaggactgttgctcaggtatttccatttgaccttttgatttatgaaatgataattttcagattcacttctcccagatgtgtttgttgatttgattgaaatataatctccttttgaaatgtgtacaagcaaaactgaggtttctacatgagtttattgtattcttgaaccatattcctctgtatacatcattgcacttttaattatttcacaagaacgacatttatgagccacaagatcaaattaggaatttatactgtcgagatctttccaaacggttctcaaatttcactcttctctaagggtgctgtcaacactcatctgaccaggaaagaaatccagttagccgcttggtccatcaaccttcattgacattatggtcaagctctgagtactgatagggaaaactgcaaattacaccacaaaaaaaatcatatagtttgcaaagattaacattagctttatctgttggttggtggcaatgactaatagggatatttttgcaagttatgacttcaatgatctgagcattatacgcgtgtttctttttgaactgttgtttcttgtacaccaaactgcttttagtttagaactgttgaatggctttccagttcaatccattttgatggtgatgttcttaatagaaattcgttccacaaattcgctattgaagcatataaatacatatcttgcctaattgttgctgtgaagtgcttactcctctgttttcaaaagaaacaattttgctctacttttaagcagtatgtacattatggtcgtattatgttacatgttcctattgaagtagtcatgcatggtttagtttaacattttctgatgaattacaaaatttaataaagttattacctggaaatgtctgaaattttattaccctcctctttgcttaaaggaagaaacgtatattttaagcataataatgaaagggggaatgctaagcgctgtctttatttccttgagatgtttcattcctctagaaaggccaacaactctcttagctaacaccttttctgattctaattgagctattgtttaaccaggttttgaacttagttccaaaggaagctgaaggagagtcttttgagcatgctcttgctcgtgttcggcgctgtctcggaggtggagacactgcagagaatgctgatagtgacagtgatttggaagtggttgcggagtctgttacagtcaaccttcgttgccctgtgagtttttgttacgtataactgtttagttagcttaacatatgtttgttaagtgtacactacagtatgcagatatagtcattctatcaggttattgatgtccattgttcattgatctggagtagttttagcacatataggttctaatgtcatgtcaagatgtgtgtaaggctaagcctttcttgtgatgcaaaattggagactaatctaatttgttttctaacatgtcttcagaatagtggatccagaatgaggattgctgggagattcaagccttgcattcacatgggttgttttgatcttgaaactttcgtggaattgaatcaacggtcccgcaaggttagatcttgtgttccctgatgctcatccttcagatacatgtgtgttcatccaggaaagagttacttttttctggagctcacaacccaccttttgacatgttgatgctttcatattttccttttatatcctctgattgctcttttctcttgtttctatacagtggcaatgtccaatatgtttaaagaattactctcttgagagcttgatgattgatccttacttcaataggattacttctctggtaagttttcattgtacctctaaatctttttgtcagatccacagcattttgtgattatttttcttttggatgcagttgcgcaattgcaatgaggatgtcaatgaggttgatgttaagcctgacggatcttggcgtgtgaagggtgatgctgcaagtagagaattatctcagtggcatatgcctgatggtaccctttgtaatcctaaggaagatgtcaaacctgccatgcaaaatggaaatgaacaaatgatggaaggtacttctgatggacagaaatctttgaaaattggaataaagagaaatccaaatggaatctgggaagttagtagcaaagcagatgacaagaagccttctgtggttggaaatcgcatgcaaaacaatagtgggttccgagctctaaacaacattatgcatatgagcaatagcccaactagtagttatagagacggggaagacccaagtgtgaaccaagagagcaataggcatgttgacttatcattgaacaatggtaataatgagtttgacagtttctctctcaattttggccaagcatgcaatacagatgatagaccacagcaacaacataatgccacagacgtcattgttcttagtgattctgatgaagagaatgatgctatggtttgtccaccagctgtctatgacaatactaccactgcaaatggtagtggttttcctttcaccactaatggtattggatatactgaaaggtaccaggaagatgccggcgttggtacaagtggccttggtttattgagtaacaatgttgatgattttgagatgaataactggcaaatgcattcttcttatcaacaacctgaacaaggcttccagttttttgggaatgatactgatgtccataatacttttgttggttcacacaattcctttggcttagcaccaaatgactattctcttgattgtaatgttggcgtagaggaggcttcggtaactcctgctctttcagtctgccggaatagtaatgaaatgcatggaagtttggttgataacccactggctttggttggcgatgatccatccttgcaaatttttcttccaagtcaaccttcctctgttcctcttcaggaagaacttagcgagcgtgctaatgcaccaaatggggttcagtctgatgattggatatcccttacactcgcagcgggtggaggtggtaacgaagagcctgcacctgctgatgtcaattcacagccacaaattccatcaacagagacagggatcgaaccattgaccgatgctggtttgtctcccttttccgagtttagttctttattcatgtgacagttatattctaaggcaatggtttactcttgaaatatttttaccaacaacttaaaatttctatccatttgcttagtcatattttttttcagttgaattatttccttgtatgatattatatccgtgcgtgatactttgcttttccatgttttcataactagttaaattggctaacaattatcttaacataattttgttgtgaactgattactgactggaaagaaaacagtgatgaattagcacaatgtggataagactactggaaacatagttgctgctaacctttggtgatccttgagtatctcttcaactaagttaccaagcatgattattccacctttttgtttcatgagtaaagagttcattagtttttgctcttaatgcattttttaggggctgcagagacccacatcaccaattgtattgctaagcttatacttgtagcaaatgtcgattcacaccgggcctgctttctcttttctttagtaacactaccaattttgaaggaatttgcgtagtatcaagatatttattataccaaatgcttctaagcctgtcttctattatcagcccatctctagggtggtttggtagttacaatttctatggattttgctgtctgttatggtcgcctgtataacaggggttatgcttggttggaacatatgcaggaacatccaggtcttttgtctgctagtggttattgttgggtgttcccaccactatcatcatgtattatcagcaattattgttgtgattgctcagttggtccaaaatattggcataattcctttactcgttttttgcagcttctgcatttctgagcacaaacattgaaagacgtagcggagctgatttaaatccaagaaggatagaaaatatattttctcatcctcgccagcctcggtctgttaggcctcgactctgtttatcaatagatactgattctgagtagtttggacatcataacggggtaactgagtttgcattagtttggcaaagctgccatccagaaatcatgatttatactgaggtggggttatcggtcgtctggttgatgtaaagaaaaacaccagcattgatgctttgttgcctcaatggtttacaagctttcaagtgttctatttgatccaggagggatctgcatagaggacatctgatggtgagcataactgattagtccttttcccctgtgttactgttccagtttccttgtagtttgttgtttgcatgtgattaaagttgttaatttgcaagtgggcatgtcttttaccaaatgaaaagggaaagaatgacatagaagatcccttcccattcattaatgacaccatctggagttcgatcacaataggataaaaatgttgcagattataacaggataaataagagcaaattaatatgctgttagtttctaagcacatcatgaagttgaatattcattcttataaagcttgtttgtgcttcgattggctttagagcttacacatcatgttaggttctcttatttgcatttcccaaaatttagttgttgtctgacatatattcatatgtaacacaaaacatctacagtagtcgagattttcagataagatgggagtcgcagtgagtaagcatagctgtgtaggcttcttgttagaagcttgtctaaagtagttctttgccagcagtcaatgaataaaatttgcaatatatatgtctgcttctctgggtagtagaattattcgctgaagtagtccaaataagaagtaaaagatttgaacctcgtataacaagaatgttcccagtttcttgtgcagttgttaacagatgatgctataaggtttttactttaatatcacagaaattgttgaggcttgtcaacaaaaaaaggcatgatactgtagttacattccttctcattggaggtcgctaatgttttttttttttttctgttaggttggtatagaaaattttctaactgggtatcgaggcttaatgtggcgactggagcagtttgtacattttttttgttttgacttttactggatataaggaatagaggtggggtcatccctggaccctggatgcaagacaaatacatgtgaatgttttgggtgtaccatcattgtatttagggtttgggggtactaatttagttgtttattaacctggtatttgatggagaataaattattcctggaagtggcggccaataaacagagtcgttggggttttacttgggtaattgttgattaatctcagctttgctatgcaatgcacgagaatgttgggttttgtgttaactgcgccttccatgctggcacatcctactgttcggtgagtcatgaggttaatcatcccgcttcccggcacgtaccaagttatatttttctcttccacgatggtaagcacgacttcttctgttgattcagcttaatgtttttgcgattgtatcaggactaagcctatttttcccagttttcatcaaagaggaattgatatacatatcaaaaaaaggaatttatcttgcatgcgtccctgtgtatttttttttggggggcaagtgtggtcgtgtggttgtacgtgagttgacagtagtgcacagtgagtttcagtgtttgctttgacttggttcagaatcctccatctggacgatgggttctggcgttctgcacttctgcgattgggaatgacccatgaatgtctccctggttctctgcttgcacaaggagctagaggaaacatgcaatttgttccagaggcagcaccagacctacctggtgatggtattgcacaatgatacgcactctggagcgtacggccgcacgtaggtgtcagcctgctccctcctttcctgcaaatgcaatgctttagctttttcttgtttcttcccttgtccctctcactcagcattatcgctcttgggctattgacggtttgacacttgattccccttccgttggtcatgattaaaagagtactaacagatctcaggcatctcgaggtggtcactgctgctgttctctctcgtctcattagtccaaatccagattaatgcacatgtcgtcactgcacaagttgtagaagtagtagcacgatgcaggtcaataaactatgctgcttgcacgctctactctggagtactctgtaggtcaacttatgggcaaagcagcggatcacaagcttcttccacgcatgtctccacgatgccttgcattttctgccacaagtgcattagattctccggccattcacaaccaactcgtgctaggcagcctgcaggtcaaacatcctatctcgttg

SEQ ID NO: 408 - DNA, 4363 bp, Oryza sativa
cggcggccagggcggcggctactccctccccaccaaggcctccgccgctgacgtcgccgacaacctgatctggaacgcctacctaggcggccaccgcgccggcgtgcaccgccccttcggcgacgacgcggcggtggacggcatcgacttcttcattgaccagggcggcgccgaccactacgacgacctcgcccggctgctcaacggctacaacaagtattacgatgacctcgccctgcaggtttaacgtgctggtgagctccgccgtctcggcgaccacgctccacatctcctccgtgtcattgtcgtcgccggcccatcaccaattcaccatgcgagagacgatgtcgctggtgaggcccatcagcgcggcgtcggcgtcgacgtgctcgccgttggcggcactccgactgagcgagccgacgaggcgcgccacctcctcgcggccgacgtggcggagccggtctagcgttcgtccggcgaggagctcgtgcaccgccgcccagcctccgccgcccgccgcctgccgcccgcgcgcggctcctccccacgccgcctgcgcccgccggccgccgcccgtgccgctgctccccgcgcgccgcccgtggagattggaaaagagaggagagagaggaagagaggtggagaggggagggaagaagaggctgacgcgtggggcccacgtgggtcccacgctgagtcagctgccacataggacaaaaccggactcaaaaccgcctcgggacctagtttacactggttttgtaaattgagggatgcgttatatccggttttgtggttcgaggacgatattgtaactcgacgacaagttgagggaccttgggtgtactttttccccaattggaccacaaattctttctttctgttacgtgcggcccatatttgttgggccgtaacggaatttggaatttatgcggcccaagaacgggactgggatttgttgggccctcccgcaggtgcgctcagactcgccgtcgctcccccaatcggccgccgcctccgccgcgtctcgtccacttgaagagcaacatctctttcactcctcgaaccctagcacctccaaatcaatcattctcgatctccgcgcgagaatgagatcctcctccacctccagcctccaggtacgcccccgactccattgctctcatttgtgagggttgtatgacatccatctgcggcggggcggggcgggtggagacgccgcccatttcttctcaacacggctagcatgcgacagaggaagccctcaaactgatgggctaggatgcttggcttcgattcgatgttggtgctatatgattatcacaagacttcgtgttaatctttctaatcattacccatcaccaactgctacttcattttacacttgctgctttaatttatttaccttacattttgctactcacataaactttgttccagaaacattgtttgaaaatatggtgatttttttaactattgttgataaaaacttggtgctgttatggacctggcctgatctgtggtggcgaatgagtgaggggatggcatcactctatatatgcgaaaagccgaaaacagccatgtgttctgctctttgttcctttttgtttaagttttgttgctgggataacactttgtagcctgcctctcatgaatcatgatggaaatggaaggggtctccctcttctggctataatacatttgcttctcaaatattacagtacatttctaaaggaaagaaaaaaaaagatatggtaaattgaaacttccatgcctttttccatatctatttataggttttgcacgtgttgtccaaatgtgatcctttatagaggtcacacctttatccaggtttcttatccgagctaatcgaaatccaagaacaaaaatactactgtggcaaaaaagaataaggaagaacataaggaactcccacatgtccaaaaatggaagcaattagtttggtttcaatacaggccacaaaagaaatggtcagctcaactcctacggttgaggctcacacctcattcaccctgtcctgagcaatcctttttaggctccttcctgcaaggctgcaactatataggccgatgaggacagaagggggaaaaaacacaggcgcattctaccgagaggcacaggggttgcaagaagtcgcctaattctcctattgaattaggcacatcttcgcccccacattgcctctcattgtaaaatagtatcaactgataatccacaggaactaaacaacaattaaatccaattatggacggattggtaggcctcttgaaaatacgggtggtgcgtgggattaaccttgcctaccgcgacacaagaggcagtgatccatatgtcgtccttcgcctcggcaagcaagtatgattacttttttgtttttatatctctagcgatttgcctcatctccatctcttttgtttgagtatatattgttctcagtgtcttaccgagttttgtgttttgatcatattacagaaagtgaagactagtgtaaagaagaaatctgtgaatcctatttggcatgaagagctaactttgtcgatcatgaaccctattgcaccgattaagcttgtgagtggatgttgttttcttacaagcatgtgtactaactgattatgatatttcatgttcaaccctgtttttttttaatgaatgctcacattgcggattttcttcttctgttgaaataaacagggggtgtttgacaaagacactttcagtagagacgacccaatgggagatgcagaaatagacctggagcccttcatggaagttctgaacatggacccggagaacattcggaatggttccatcataaaaacaattcgaccatccaaccagaactgccttgctgatgagagtcacctattctggaggaatggtaaatttgtccaggacattattctccgacttagaaacgtcgagagtggtgagctgcaagtgcaactgcaatgggtgaaaattcctggcaggcactaagtgtctcatggccattgggagatcttggctactgagatatcattgacatttccgaatgccaaaacatatattgtgcgaaatggatcatgtcaaccattggggctgtaaatactgtgcaaaaaatgaatcatgtcaagcacgttttgatgtggaggttgtgaccagcaaagggttcatcaggttagtcaatgtctgtaggaaaggaaaatgatgttaaaatgttgttgccgaaatgtattgggagcatgatcagtaaagcttgggatgacataatcaaatagtacaaacgataggaccatgtttgcctgtgcttttgcaacaaatcaatcacaaatactgtttctcatgtggaattcttcttcagtgtcgtggcaatcactatctgaacttttgcctgaacctcaacttttatcatcttaaacagtattatatcctgttatcttgagaattgcttgctgcttaacgtggctcgatgcagtcaagtgggcgaattcatttttgcgattctgaaagtgaaccccttctctagtagcagtaacattttttttgcctgaatttctacggagatgagagtaagggacaagttcaactgaaagggagaggcaaagaagacgatgatgcctttgttcgtcgtcgtcgtcggcgatggctgtggaccgcaggcgaggtgataacccaaccagtggccattgatcctcttatcctcccgcggcgacgacgagcggatgccatctcctcctccccgcattatccgcagttgcagcgcacggggcgcaacaggacaataggataaattccacaattccagtagcctacaaattctcacctgctcccctgtttcttggttccccttcctctctcatcagcacacactgtcaccacaacagccaccaactcctctcaacttcttgatccggcggcggcggcaagatgttcggcggcggcggcggcggcgggaggaagccgctggactacgaggagctgaacgagaacgtgaagaaggtgcagtacgcggtgcggggggagctgtacctgcgcgcctccgagctccagaaggagggcaagaagatcatcttcaccaacgtcggcaacccacacgcgctcggccagaagccgctcaccttcccccgccaggtcactactcctctttctttcttcttcctctactactagtagattcgatcgattgatttctccctattctgttgtgttgtgcaggttgtggcgctgtgccaggcccccttcctgctcgatgatcccaacgtcggccttatcttccccgccgacgccatcgcgcgggccaagcactacctcgccatggcacccggtggactaggtatcacagtcacacacaactctagtg

SEQ ID NO: 409 - DNA, 3474 bp, Oryza sativa
gatgcgatcggcgatgatgagagtggtggttccaagtaacgtgggggaaatctcgtctctcggcgcaatgctataaacatgcggatgaccatcaccggagtaagtagagtaatttagtcgtacttgtacctactggaacagtgaccacccaacgagcctcacattcactgaatcatactagtcgtactactactactacaacactggaacggatagaaaacgataaatgacgccgcataatcgacaacgcatgggaccaaactcatgcttatctgctcttgtactcgtgcttatctcaaatccacctcattttacatgcccctttttgccacagcaactttcggtcccatcatggcatatttgcaaacgcaaaatagtttataaataaaattttttatatgcgtgtttttatagtgatataaaagcaacggttgaaagataaatttcgataaaaaaaccttaaaatcagctttaaatttaagattaaaaatttaaattttgactgataataagtattagcgaaaagatgatgtcctaatttccccttttcgctccaccccatgacgttgtccgacatctaaatactactcctaatcaacttgcaacctaagataatttagtatagtacacgtagtacagcctttttggagcagtaacaaaagacgcgcgggccacacgtccgtgcagttgcagccgccgctgcatccccaccgcgaaaaccacggcaaaatttagcggcggccgctgtggccgcctcacccccccgcgcctggctgtccacagcaacgcacgcacccgcacccgcaccgccgacccgaccgcggcgccgagctgtcccaattctgctgacctcggccgtgacgccatcctcgcacgggtccaatccccgacgcaggaggtggcctccttcctcgaaacccaccacctcaccaccacacgtgccccatttcatcccatctcctcttcttcccgcagccgccgactccgctttgactcatccccccgccgccgaaccttccagactacctccctctatatatccccccctccgcccgccatttctccccattcgagaaatccctcacaacccacaacattttcaaacaacgcaaagcagtagcagcagcgagaagcaagcaagaagcgatggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcagggtaagcttagctcagattcatccgaattactagcaatgatccttgcttcgatcgaagattattcggtgggagtgatgatcgataattggatcgtggtctgatctgatctggtgtgaattgtttgtgcagttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctgaggtgacggcgacgcgatcgaacaggtggtgatcgatgctgcaacgtgtgtaaatatacagcgccggctgggtcaagagatggctcgggtgacgcgcgcgcggcgtgtcctggcgttggcgccggggcattctttagtttttcatcttttcatcatctcagatggtagatacaaaacagtgtatgtatgtagctctgtttctctctatagaaccccaacaaattttgttgttgatgttgtttatcttcatatgctttgatcttgaaatcgtctaccttactactgccgatcgttgctcaaaagtgtggaagtttgaagcatcttccacgggcgttgctctactcccatctcgtttcaccacgaaatccccttcgcatagaggcatctcagccgtacatctccaaacccacgttctggattcagcaaacggacggcatatgccagcggactgactaggatttgtggttcagaataaaaatatggtttgcagtgtcaattttccaggagagtgactatgtcatactaacttcatactccaataatgaagctaagctatctccatgtacatatcaaatacgaaatcatatccaagggaactaacacagtcacaaacaacaggtacacagacaattacagcacaagcgcaggagggaaataattttaactgaactaggaagaaaggaaacacaactcattttttattgatatatgttggatgaatccaataaaaccgatacaagtcacgaaaaatcagactagatgaatccttcgagatcacatgagcaaaagctttcgacgaaagctgtcctatagtcgtggaagcaataacacttgataaagataggaattcagacacgagaggttgcagactataagatgtcatcaaatctccttgaacgccgcgaagagatcaccgttgatgtagtcgttgtccacaagactaaccaagaagtagctcttctggacctgagaagcgaagagcagcgaaatgtgtaagcttgtgaggtcaggtgatgcattcagtatacagggagtatacaatgaaatgtagcacaatgccacaaccctatcacggctgatacagtggttcaagtggcatgggataaggggaaaacatgccaaatggtattttagaatttagacgaatgccttctaaaacactctatttaacatgcaagtcttatgagaaattgggaggataggagaaaaggtggcattcagatcagtgcaacaagttctgttcaatttt

SEQ ID NO: 410 - DNA, 6577 bp, Oryza sativa
ttcaaatttttttgcaaatataaaatacgaaaagttgtgcttaaagtactgtagataataaagtaagtcacaaataaaataattaataatttcaaaaaattttaaataagacgagtggtcaaacgttgcaagcaaaaactcaaaatcccttatattatgggacggagggagtagttaactatggagtagatgcttggagggaaagattgatattgtgatatatatatacaactactctatctatcttgttagtactctctccgttctaaaatataagcattttcagcatagtaccaaatcaaccattttttaactttgactattaatagcaaaaaaaaataaaaaagatcaataatgtcaaattgatgttactagatttatcattaatcaaattattataatatgcaactctttttatttaaaacattttatttttatagatattgtttatcaaagtagtatctcgaacactgtgtcgagatttaaaaatatttatattttaggacagatgaattacatagcaagtcttatgtttgcattgtccaggggaaatatggctttgtttcaatagccacaattatactccctatattaggggttcaatcccatctcttatgaaagaatggacttcgaccttgagtatcaaactgaatttaaaaattgatagctcagtctgcttcgtcgcatattgctgactcaaagtcaaaaactctattatatctagctccttaccatttaaaaatcacataaataattcttacattctggaccgctctcatatagtacagatccatcagcacgaataaacatagactttttaactcccggccaggcggctagcccacgaggatataggaatagtagtctggaccacattccagccgtgtgcccctaccatcgcccccctccccccccccccccccccaaaaaaaaaaaaaaaaaccccaatcccccttcccccgcttgtgatttgtgaagcgaaagcgaacggagcacataaacacaattatatcctcccccgcgaatattcccatcgtctccttcctcctctcccccgcatatcctccgcctccctttcccccctctcctcctcaaccctatttcaccaccacctccaccgctgccgcggcgagaattcgatcggttcttggcagccgtagtgcagttttgtgcagttttcttctctcttgttgttgaggatgaagtttgggaagagcctgagtagccagatcgtggagacgctcccggagtggcgggacaagttcttgtcgtacaaggatctcaagaagcggctcaagctgattggtgggggtgggggtggggaggagaggcaggcgaagcgggcacgcgttgcagcggatggcggcgaggaggaggccgccgccgcggcgatgacgcccgaggaggcgggcttcatgcggctcctggaggccgagctcgacaagttcaactccttcttcgtcgagaaggaggaggaatacatcatccgccagaaggtgcggcggtgatcgatcgccatttgtgcttcggttcgaatcttcttcttcttctcgagtttcttggttctgatttgggaaatcgacgctgtgtgtgtcaggagctgcaggacagggtggcgagggcggcggggagggagtcgaaggaggagctgatgcgggtgcgcaaggagatcgtcgacttccatggcgagatggtgctgctcgagaactacagcgccctcaactacaccggtgagtgtcccagtccacgcacttccccacccgccgcatcgcaacacccgtagttttcagttttcacatgtctttcactaattatattattgcaaagggttcgttagctgttgcttatgttgtttgttaactcttcttggaatgttctgtgaattggggaggtagtaataagagaggttggaaaaactggttaacatagtagtttagtatccttattagaattttttttgattggggaggtagtaagagaggtagaaaaaaattggttaatatagtagtttattagtgttctcagaaaggtaatttagcacgcatcatagagcaggcaggagtaatggaagtttcctgaacataggtcaagaaataggcgacttattgtggttgtgggcagctatggtttcgcatgtccgctacgcagcactcgtgtcgctgtcaaggagaatggatccttgtatggcaattcagtgcgcacacgtttttgctctctattgatgaatggatacttgaggttgggctcagcagctaatgttgggggcactgtatataaacagtttgttttctcgtgcgagacaagcaatttatagtatggccacatgagtgctaacattgtttatggtggagcactctgttcctttctgctgcaatttgaaatggtaacagtgtgtcatgcatccttctatcgtgaacagattttcctttgactcgctataagaaggtactccctccatcccaagatataagtatttctagctatgaatttggacaactgtgtccagattcatagccaaaagttgctatattttgggtcggaggtagtatataacaattgtaaacaaataggtcaaaaaatttatccttttcaacaggctgtaatacagttcgtcaccaaccaaatggtgcatagaagtttctacaagaaatatttgactaataattgacttggtatcagatattatcttggcaatatttttcactaaaaatacagtctgattcagggttcacatgatgatgcagtagtgtgtagtatagtatagtgaccttgccctctactgcagtgttccatggtagtctggtagattatctgcttccttacctgtccactggcagcatatgcagtgcatatgcaaagtaatgatgtacaactgtactgctttgctatttttcggttggcctttgttatgccttaatgctgagtggttgattttcctctttatcaatgtgagattgtgagtggcttctaatatctggaaattttcattcctagcctgggggttacaggttaatcatacaactcaattaaatctaggtcggtttctgttggcagttgggacgaaaattactcacttgaatatgatgttagagcatcatttctatcataagctccatagttgttttagaaatattgatttagtaagcagggcagcgtatgcctcccctcaccaaatccaaaattaaattcactatgcatcatttcaaagattgcctgaaattccgtagatgcattaataatactatatgcacaatttgcaaaaagttgggtgtacagtcatctgcagttagataaataaattaacttgttctaaattcccaggaagcattcacgcctgaaatactgtagtagacaagtttgcaggctaatttttgcaatatgttataaactatttcaaagacatttatagtttttatttttagtacggcgcaaaatacatatttggtaaacgggggcacatgcttcattgccaaatatttttcatcagttgacgagtcttctgattaaaagtcatgcctaacgaaacaagaaagtgcaattcatgttacgtttgtgatttgcgttccagctattgaaaataaaagaaattagttttgcatatcatctaaagatatggtattgctcaacagaaatttgtgtagctaatttcatgatcttcattagttgactcttttatgcttagctgagatgtgattgatggtcctaactttgcatgctattcgtcatcctagtgcttctttagtggactactttttaaagtcagttttttgctagctgcaatgaacttgaggctaatgagtaccttggttactgtgttattatgtgcttgtggacaatggtttcggtggacgtactgtgaaccagtgacctgtgaccactctttgtatcagcatcttgcttttttctgtttttcctttgcaagatgcaagttgatggtgtcacagacctatatggctatattgggccaggttaacacacactaatttggggagtcgacttttcgaatgtgaacacattctaaagatgaggatgtcacacaaaaagtaaatttgttgttttgcatcatgcaagcttagtatgttttgctcaaccaacagaacagaatgcaagttgcatgcttcttatatgcctgaagccctgaactggaatgtgttactgttaataaccatcattggtgctttgcaactgcacaatacatttctgctgccattttgctcatatcatgctggtctatttcgtatgcttatgcgaataagaaactatattagtgttgtacaactgtctgaaagttttctggttatcatttgcaatatgaaatgttatcctatctcaaccaaattgactagcatctcctttagtggcaatgtggtaccctttacacatcactaccatgctagctttcctgatatgaaaatttactggaccatgcctcacgagaattcaggttcattagctagggatgtgacaagttacaaatggttttggtgcctcagacagacagatgccacagcctgtaagccatacaagggcgtattttctatttccatcagtttgggcagatatcacctaaactaaaatgtttagtctgattgaaccactagcaatagctcatgtcagttatccctgtttattctcttgagggaaaactctttaagaaaagttgtgatattggaagtggattggatgctatttgaaatttggaagatgtaactcttgtactttgttttagattttcaccagttgatacttacgttccatgttgctgtttacaggattagttaagattctcaagaagtatgacaagaggactggggctctgatccgtctgcctttcatccagaaagtgctacagcagcctttcttcaccactgacctcctgtacaagcttgtgaaacagtgtgaggccatgctggaccagcttctaccatcaaacgaactgtctgtatcgagtgaagatgggagaggcgatagcactaacgaggacaagccttcgaatcccagttcatccttggttaatggtggcactattccagagttagatgagatcgagtacatggaaagcatgtatatgaagggcacggtcgcggcgcttaggtctctgaaggagatccgaagcggaagctctactgttagtgcattctcattaccacctctccagggcgacagttcgccagaggagcagcaggaactgtggaataagattccggtgattgagcaggccgccaaatgacacgaccggcatttcactacatggttatgtacactgcatgaccttgatcttgacatttgctggagatagtaccggggatctcattcccctgtcatatattcagtaatttgtatgattccaggattcctaacagttgtaaaatggtggacatgttcagtatacattgtaaaatcatagaaacccatcataaccatcagacagaactgagatgttttgattcactattgtgagttaaatcctgtactttttgctgatctacatcctctttcatgaactctcggtacagaattagttaatgttgcagtataacaattctgattttgacaatctcgattcggagatgattttgttaaagttgtgcaacgtcttgttatgagttagcatcatgtgtagcacacttccactgaacttgtttgttgcctggaaattgagttgattgcgcagtttttactggaatgggaaaaaagttttactggaggggaaaataagatgtctgtaaaatttattcagagacggcaagtattgctgtttaggtgatcaaataagatatttgtatccttttgcacaatcaaattgactatcatatagtgaatctgtttgtgatcatgtttatattatctttgatgaccatgcttatttgatctcaagagccttgtagtttactataatcatgttccaggctcaacaacgtgggcctaactaggctcaactttgatttgcacttgtttaacaaaattgaggaatgttctatacctgtttttagtggttgagactgagacgtaaatgaaaacttcaaccaaagttgagaatttggagagacgcaaaatggaccttttcctaattttgtaaacttgtagggactaaaataaattaagcccacagtttagcccattttcacaattttgtgaacctgggggcccaaacgagattaagcccacatacatttcggctcactttcttgagggcccaaatgaaatttagctacactatgcagtctggcccattttctttcgccacaagtcagagcagagcagttgcggagtgggaaaccccaaaacccccacgtcctcctcctccgccgccgccgccgccaccgtcgccgtcgacgagccatgccgccgcggaagcgcccgccgccgccggccaaggcgccggaagccccaccggaaaccaagcccaagatctctccgcccgctaaacccatcgccgcggcgccgccgccgccgaaggcggtcctctcggacaccgtcctcgccgccttgtcgcagcacgagcgccccatctacaagctcgtgttcgccggcggggacaagggcatgtcgcagacggagatccggatcaagaccg

SEQ ID NO: 411 - DNA, 4531 bp, Oryza sativa
caattcttgaaagctctgagaggaagaaatgcaaaggccattgcatcttgataagttttaaaaaagtacactttcaaaagatagctccgaatttcccaagcagaagatgttgaaaaaaaagaagagttgtaaacaaaacagtgctggcatttaaggctcctcctaggcgaccaccaagaacctcaaagagagagaagttatttatttttactccaaacagatgcaacatctgaagacaacttttggactgtttggaaaaacaattgcagcttctttcagaatcacgaactcttccaaataacttacaacatcatcttttcgcttatgcttatacttattagtcaaaattaaaattttcaacattaattttaaagctgatttttggttttttcatcgaaatttatttttcagtatttgcttttagataactaagaacacgtatataaaagttttattcacaaattactttccgtttacaaatatactgttttgctactataggaccatcagattatagaaagtgtagtagtagaatttaaagatatgagttaaaagccataagctaaaaaactcttaacgtttttagattctcataaatttggttactaaacatctcaatcaggactttcctttttacagtagagaatccgtgtgtctgacaggacagtggcgacccaatccccaatctccattttcttgagatttggatcagctgcagtagtagtactgactgcaacttatgcagtcatagttgctaccgtttgatctgaatcggatggcacaggttagtcagagcactatagcaaaagtaccgtagaataaaatattagttttatgattctattttgatcactgtagcgataaatctggaccattcatcatcaaaatgaatggttgaagatacgtgcagtcctaagttacagtggaagttaccactgcagctgatctcaatccattttcttgccattctcggcagcccttccttccaagcccccaccacacacacacacactcgcgagcacagctcgcctcctcactagtataaaatagtagtcgtccccttcttggcgcgccgccgcagcaacagcggcgcgcgaggctgctcggatctcgccgcggccatcgaaccgatggagctcgacgacgcgtctcgccacggattcggcaggatgggatttgggtaaattcctctgctctgcacttctcctcctcctccttgccgctgctgttcttggacaagaaaagctttcgtgttctttcttcgttttgtttttgagctcatcgagtcgttggcgcgcgcgcagatgcaagcactacaggaggaggtgcaggatccgggcgccgtgctgcaacgacgtcttccactgccgccattgccacaacgagtccacggtttcgtctcccccgcgtgcttgcttgcattgcatcaccaatcctgaattttatttttattttttctgctcctgcctttctgatgtgccgctccctgttcttggatcagaaagacggccacgagctcgatcggcacgcggttgaatcggtgggtgctcctatatcacatcaattcgatcctgtttcttgatctgaaaaaaactgaaaaaacttatcttggggtatctgctcttcaggttatctgtctcgtctgtgacaccgaacagccggttagtgttgaatccactgggctttcctttccgtttcttggatcaatttttgtttctgaccggtgattttttttttgagcaggttgcgcaagtgtgctacaactgcggcgtttgcatgggcgagtacttctgcagcgcgtgcaaattcttcgacgacgacgtgagatgccgatgctgcttgctttgcttctgctggatctggtgattttcgatttggttgttgatgagatgcacgttcgtgttctgcaggttgacagggaacacttccactgccaagattgcggcatctgcaggtatgtttttaccacaccatctaaaaaaatcacttaaaaagtgggaatgcatttcaaattttctgagctgactgaatttgggatgcattgcaaatttgcaatagagttggagggaaggataacttcttccactgcgaaaaatgtggtgagtcagtgtgatcctacatctctcgatactcggtactgaaatcccaagctattactatttactggtgagatggttgaatctgaatctctcaattccacttttaaatatctgttgaaacacaggatcatgctactcggtcagcctgcgcgacaagcactgctgcatcgagaactccatgaagaacaactgccccatctgttacgaggtgtgtgttctaatgttcttctgccagaacagaacagtgacgctaccttctgcatactgttcatttaaaaaaaatgcagtctcttatgtacgaaactgtcgatcgtcatcacaaatgcagtatctgtttgactctctaagggagacgtccgtgctcagatgtgggcacacgatgcacctgcaatgcttccacgagatgctgaagcacgacaagtaatcgcccatgctgtgttgatctgtttccatgtggctctttctttctttgtttgtttctttactttgtgtgctagattagtcatctctttcgtgtgatcttgttcttcttggatgcctgataattgtaggttctcttgtcccatatgctcgatgcctatctttgacatggacaagttcttgagggctttggacgctgaggtatgtattaaatttcttagtgagcttgcttaacacaatagcattatacaactagacttcatctttcaatttatttaatagacctgttgtaggttcagaaatagtgaatataaaataaaccaaaatacaaatcatatgcaaaggaactaaaaaaccggaccagatattggctcatcatttcaattacattttggaaaggtttcaaacttgcagagttgcagtagtctcaccaatctaaagccttagtgataattaatttgtaggaatactgccataatatgttcattttttaacctctgcagattgaagcaaatatgctgcacatagattacatgggaaaggtaagcttgcctccatccaagaactctcaccctgtgccatttgacagtataaaatactacatacactttgacgctaatgttgctgattggtgttggtttgcagggatggatcgtgtgcaacgactgcagggacacgacgcaggtgtacgcgagggtggcagggcacaagtgctgccattgccagtctcacaacacctgcagggtggctgccccggtgctccctgcttaattaaattgagtaaatttcatataaaattcagctgcagatgctgtcagcaccgcagcatcatattattgatttatacttagtattcagtagtattggctgggttattttaagtagccaattaagtgtattttcagtccaacatgaactgcatgggtcacatcttgtatgcgaattatacacgttttatgtaacaaagcaaggtgaatttgaaaggcgaagaaacagttagggatgtgcccaatttttgttggtctgcagagtgcagatccaagctaaaaacactaaaggacacctggcatttctgttctttttctgggcctgaaaaagggtacgtattgcctttgtgcctgttcaggcctcattcggccacaggcggcctgttgaccataccatcccaccccaagaggccaaggcgatggattagagaggtgggagtgggctaagcccatggatacttattagccaattctactttaaataaatatagattaatttctatttcatagtaaattcgtaaaactacgtataaatcaaactgtcgtaaaactatagatttaaagcgggtatctcacagaactagagatttagtattgagcttatcatgaaactatgtaaagcataataccgcaatctatagatttagtgctattttagtgcaaaagtacaacgtttataattctaacataatagtagtcctaggagctaaaatctatatttagaatttcactactaaatctgtaggtttgccattatctaaaaaaatatatgtaggtttgcggtaaatttggtactaaaccgatagcttttacgatagattgtctaaattcgtagttttgcaaatttggtcaaaatgtcacaagtgagtgtgccttgcacacgtcttaaccagattagagacataacatagccataagtaacgtaaatatggaaagagattctctaacttattgccctctgactttaaggggttgacatgcgagccccatagctcaaggacccacatgctagtgacccatgtcagagaagccctcttccgataagtatatacgctttatcaaacacacccttacgagtatgtactattaatataatgttgtgcaacaagttaaaaaaaaagcatgagtagccatgctcagtttacaaccacaatttatttttagaggtaagtgggtttactgcagctaggggcggatgtacatgtgaagtttgttcactttaacaccacttttaaccatagcaaa

SEQ ID NO: 412 - DNA, 3492 bp, Oryza sativa
atacatctcaaccagggtttaaaatttcatttgagctatttctattggggctaccgaatggaccaaaaatttgtctgagataatttgaatttttgaacaaaattttccaaattctagaaaaaagaaatttgggcgaaatttcgaaaacttctgtatgaaaatttgaatcatgatctcaacccaaatcttttgccggttcgtacatacggagtatatattattaatattacttctagctccagtaatactaacttcactgttctatattaatatttgatatatttctaggtttgataagaaaccatatgtattcaagttgtatagtaagtgaaaagcttaagcctgctttggttatatgatttattttccatttttagagtctaattaagtcaaaaagaaaattttacagctactctaatttcggttgtgtttagatccaagggtgtaaagttttggtgtgtcacattggatatgcggacacacatttgaagtattaaacgtagactaatgacaaaacaaagaatccgcctgtaaaatgcgagacgaatttattaagcctaattaattcatcattagcaaatgtttacaatatcaccacattgtcagatcacggagcaattaggcttaaaagattcgtcacgcaatttacccaccatctatgtaattagttattttttcgtttatatttaatactttatacatgtgtctaaacattcgatatgacagggtaaaaaattttgtcaagcgatctaaacaggacttcatttttcacaccgggacagcaaaattgccacaagttatttcgtatcaaatcacacgacccaagtaactagtccctacatgcagctcgtcaaatcaggctagtagtggctttgattagtgcaagccttctctctgattactctttgctgcttaacgcggaaaggggaagagcgagagagagaaaaaaaaaatctttccggccgccaacggtcaccccctataagtagaggagcccatcttagctttctcctcgcagatgcaattgcgcgaacacctccaaactcccgagtcccctctcctctctcgtcttcctctccacgacgacctctccgcttcaattctgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatcccgcggcgttcttgccgcagcagccgatgacgatgacaccggctgggtacgtggacatggcgaatgatcagtatttgggtgcgcatgccgccgctggcgaggcggaggcggtctaccgggcggcggcggcggagccggtgatgatacggttcggcggcgaggtgtccccggtgtcggacccccggaggccgcccctgacgatctcgctgcctccgacgtcgcacgcgtgggcggcggcggaggcggtgcacccggccgctctgctgcaggcgcagaccgcggccgcggccgccgacccgaacgacttccggaagtaccgcggcgtgcggcagcggccgtggggcaagttcgcggcggagatccgcgaccccaagaagcggggctcgcgcgtgtggctcggcacgtacgacacggccatcgaggcggcgcgcgcgtacgaccgcgccgccttccgcatgcgcggcgccaaggccatcctcaacttccccaacgaggtcggctcccgcggcgccgacttcctggcaccgccgccgccgcccccgccgccgacgacgtcgacccacggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactatactgtacagaggagagaagatagtatattagcgcatgcatgtgacgggtactgaatgtgtgcatcgacataggtgttggagatacactctagatatcttgaaaataataagaggaaataatagtataggatgggtgataataacattgtaaattaattaattaaatgaagagtaaatgtgtactagtttgttttatgttcttttcttgggatcagatcgatcaatcggtgtctatccagttgtgtttgcctttttgcgccataaatttgattatgacttccgagtcttcaaatagccagggtaggagacatgtacaacgcacaagattttagtcatatgcatctagatgctgtaaatgccgtttgcgagaaaaagttccatatatatcttctgtgctttggatcgactagctctggccagaagtgtagtttaattagccacatcgaaatgagatattgtacatttccgtttagatgttaattcttgcagaaacggaaacaattctggttaacttcaagcaacaaccttatgccatacaggtcgatctcacactacaagtcatcatctagtacatgtgcatacgtactaatcagtaatcacatactagacgtatgcatacatcgatttcatctacagcgtgagtcatgcatgtgtgatgcacacagctaacaatcaagaggttgaactgagttagaatttcaaacgatgtccacacttgatttgattttcttggacgtgttcatatgtgcaataagtctaaactgtcaccagtaattctgaaagaaacacacgtacatactattgatctgtacgtacgtacttactataggtgttggtctgaatgtagtgtgtttcaaacagttgacactgatatacagtagcgtgtttaatttgtggattgcatgtgaatttttatgttgtcgccaaaaaatttaagttccagcctcctatcatataatgtcatattgatgtccacaatgtaaattcaagctagtcaaactatatgagtggccaaagggtaatacacctttaaaaagctaatgatatacggaatatgatatcagaaacagatgaggtttgcacataggtaaaaaagtttgcatgtgtttgctttgttgactacttgagtcttgagctagcatcaacccaaattaaaaatgggccttgaacgaagcttaaaaccctttagataagtctca

SEQ ID NO: 413 - DNA, 11549 bp, Oryza sativa
cagtctgcatggtagtaatcagtgtttctttctctttaagcagcgcttttgatgctttcccctcttctatctcggtaacgagctgctcggacaaacgtgactgagccttgtagcattgctgcagctccaattcatgcttctcagccttctctttccactccaccgcctacaaggaaacgaaataaataaataaacaagcccaccaaaaaaaaaaaatctatgcacacaataatatctaaatttttgggtttcttgatctccagatgaagcatctatggtacttagcaaaagcatcattatcgaggcacggttttttatacaaaattttccattccattatgcaaagcaagaaaaaaatatatgcaaagatgggaaaaaaaaggagacatgagattggtatttttacttgggcggcgaagggccgggcgagcgcctcgatggccgggcggtgggcgccctcctcgacgagatgcctccgccgcagagaccgcagggctcgccggatcgcctccttgccggcctcggcctccaccatcgtcctgcacccaaattcactccccacttaagcagaacaagaacagaaaagaaatccatggaacggctcctgcttccaagaaaacctcacattgccgggtgcaatccgtcggcgaggaggtccggtggcttccggcggaggaagaggaggtcgcgtgcggcgggcgtgcccggcggcgaggtcgtcggattcggttgggggagcagcggcggcgagaggatcagaggaagacgaaaccggggaggaaagcaaaagcaaagcaagcgaagacggcttccgggccgcgagttggactcggacccgaccggatatggtcccggattgggcctcaacggcatgtgatcttgtggcccattaatggctcgcgtcggcctaattttgtggcccacgtaacataggcccagtaagaatcggatggaatattccggccttggtgtccacgcgagactttgcccttttattttctttcttttttttttcctttttcaatcacctccgcttcctccgccgcctcggcgcgaaggccatcgccggattccccgcttcctccgcctggattgctccgcacgcaatcggccctggtttcttcccggcggcgtggtcgtcgctgttccccacccgccgccggcgccgccgcagccggcgtctgagttgagggaggagggaggaacggcggcgcaatggcggtggctgcggcgctgctgcgccggagggcgctctattcggccctcgcgtcgccctcttggctccatggtttgtgctcgctttctctgatgtggcatgttggagtgtttcctttttcatgtttgttggaggtgtgccttgtgcggcatgtgtatggcgaaatgccaaaatgagcgtgcctcgaggcacgctcattttcgatcatggcaatggtagtatctgcgttgctaggtttctatagatatgctatgagtggtgtagtaggtctatgttgcataattgattagaaaaagaacagtcaaggattatataggtcagatgcaactctttttgggggaaaaggaaacgttttttcccctgtatttacaatttacttgttattctgatgaacggattatatctgttgagagatacttatattttgggaaacataaccttaatatattagtactgttgaacaccgcgaggaaaagttctgctttggatggacatttcgtctttgatagcgtaactaatttcagtggcaaagtccaatgttctgtaggacacatttgctcataacttgtggtttacatggtatatgcttctcatatagataccagttcctgctacatttgctccatttctggtacacattctttggtcaaccatcccaatttgagattacagaggggctaccacaactctgggaagtttgatttgaccgacttgacgtaagaatccatctttctagccttcttttacgtatatcgaagtcgattttcctacagattcctttgagtttatgaattttgtatcgtacattcaatagactccatgttttgacttccaatctagtgtgggatgcacaatattttagtttccttaaatttaccttcacacttgccatagtgaaatataattttcacatttattttacacaccacgatctagtgtagaacagttcatattctcctaaagaatctaaatattttacacaccacgatctagtgtagaacagttcatattctcctaaagaatctaaataaatgctgtgcttcttttgaataatagccatcctcatatatggtatccgaatgcccgagaaaagaagcgcaatgtatttttacatgtcggtcctacaaatagtgggaagacacataatgctctcaagagactagaagcaagttcttcaggtactactttgttctacttagtgataataaattaatatacaattatgatgatttctcagagctattgatgaattctgtaggagtatactgtggacctcttagattgttggcacgggaggtagctcaaagactaaacaaagctaatgtcccttgtaacttaattactggacaagaaagggaggaaattgaaggtgcaaagcatagctcagtgacagttgagatggccgacatgacaactgagtatcaatgtgccgttattgatgaaattcaggtacttcaaccttctttctgtagatatgctaattaaatgtatattcataatacaaacagtaattaagagaattgtcatcccatttttttggactacatcatcaagccagtcatattttttactgtaatattcctcatcattctcatgttatcttcttctgtttagtagatggttggctgtagatcgaggggtttttcattcactcgtgcacttctggggctttgttcagatgagcttcatgtttgtggtgacccagctgtggttcctctcattcagcgaattctcgaacctactggtgatgtggttacggtaatttcgttgaaactcacatagttaaattgaagtgtattaatatgactctgccagaatgatgttagttgcaaagttagatttgttgacattggtgaagacattaggttttgtggataacttagatgatgtaattacctagtttgggatgaaacagtaatactaaatcgcatgttcttgcaagtgtaagtttttttttactgttttcaaagctccatgcttaatatgtttcaactcattccattttaacttaagatacacaatgattttatggattatcattggtggatagcatcagcaatcctgtaacctctgttactcaacttatccttagccacaccaatttgaggtcccgtccaacaatttagattgcacccctggatagtaacactacttctggacctccatctgagaaagtaatgtgcaggcatgatgtcatatatatctgtcttttgttggtgattagctgatgttttgtatttgcagataatattccaagtgaactcgagaaactgtttcttctcaatagaatttgttgagctgtctaatgtttattttggtgttagtactgatacacgcatcatgtcgtcaaatattccgatttgctggctgtatgtctctatgcaggtccaatattatgagaggctatctccattggttcctctgaagactactctcgggtctttctctaacattaaggcaggggattgcgttgtaacgttctcacgacgatctatctatatgcttaaggttggcattcttcagataactgttgcagaatatactgaaataatatctatctgacctgtgtcctgcaattaaaagagtaaccaatagatatcccctgcaaattgttgccagaaaatgtaaataataagctgagaaagtctcattatttttttttggtgaaagagaaatgatccaaatgccatgtttgttaaacctatcatcgtaacttgatctttacctgtaaattttgaaacaacaaactctcaccagcataacaacacacccctctggcctctgcataccctcacgtgtatctggtactccactaactttatcatttcacttttttattctctccttcaaaggggggggggatcactctattgacttaagaaatgggacatatttctcgctatacacttaaactctttgaattttgattcacaacactacagtactatactagtatggttggcagtgaagggtactagatagcccccattacagaaatgatgaaaagacaagggaaaactatgtacgaacctgtaaagctacttaagtaatgcaactatgtacggaagatgtaggcatgtaacagggactagggagagctgtgttgtagtagtcaatatgataattacatcatgttgtgagagcagcgatagctttgtagcatgttttgacaggttggctagtccatcgataatttactttctgttttacataaatgcaagttgaaatctattaagtcatctaatcatgtttctttttgcttttcttctcatggtatttattgaatttaacactccaatcgaaagactggatataaagattgcaaatccatgatatgaaaaatatgaatcaattaagttagcttagccaggggcagatcaaatacacaaggatcagagtgcagtgaccatcatgtctgctgcacaaacccaaaaagattatgctcactgtgacattacaaatcattgttgatttatacccatggtgggaccctgataacttgctgccctagatctgcacttgaattaagcgactgcaaactaagatacataatgtaatgtatcaaagcatcctcatgttgtgattattacgaaaattaatcatctagcatatgaagtaatatatgaaagctcaactacatttcttatatttaaaatgtccgtgcagagaagaattgaaatggggggtaagcatctttgttctgtagtctatggctcattgccaccagaaactcgaacaaaacaggtacttccctcacttggttatctgctactacaccattgtagttgatgccttgttctcacgtctctaggtccttatctaattaaaatttacagctaaagcaccaaacgtttcatttttaatatattaacatgtatatgccatgttttgcttggcttatgctcaatatatttatattttaaaattccatcttgctgattttcttccattaataaagtttatttggtctctcatatctgagtcacatgattgtctggataatgttttgtacaatgattaaagtcagtaaaattagcggtgcagaaggattagaattttctgtttaatgtttgtgagatgaactttcagctagcaatttgttgattaataccccgtaacagtaaagcacaaccaaccacaaattttagcttgaatttcaagaaatcggtagttatggttgtaggaggcaaaacttctcttggcatgttgtgctttattcttgatgatgctgtgatgatttgaaaaagttgataaatctattccctgagcttgcaggcgacaatgttcaatgatcaagatagtaaccttaatgtgttagtggctagtgatgctattggaatgggtcttaatctgaacatttctagaatcattttctctacactggagaagtttgatggcatctgcaacagggaactaactgtggccgaaatcaaacagattgctggtattggatttgtttcttaatagttttgcctctggcagattaagttttccctccccccttgttgcacaggtacttgagcagtgaatttgagatattcttcatattgcaatactttgtcttcattttataggaagggctgggagatatggatctaaattcccagttggtgaagtgacctgtctaaattctgatcatcttccattactacactctgctctgaaatcaccttctcccattatagaggtgctcaccctgtccgatgtctatctctaataggatgagagctgcacgaatcttggtatagataacatgctaatactgcactgtactctctgcagcgcgctggacttttccccacattcgatgtattatctctgtactcacgattgcatggaactgatttttttcaacctatattggtaagctagctaaagcccatccttcttagtactgtatatggcaaattcctaacacaacagagaataacattatatatttatgatttagtgaattgccattgtactacataaacaatacaagggtgttgctcttttggcttttctaatttggatgatacagcaagctattcatgcttttataacactttaactgcaaagtattacttagttcttcaggtggttgatgaagtcatttataacttggcaactttttcagtggcatggattggattgcttctaaaataaaatttagtcatagtattaagatatcctatttgtatttgtttggacttcagcttgactttgcttctcaatagttataaagtggaatttgctcttttttctacttttctctgcctacctctttctcaattacttgtaaatgctgttttcaaccattaaatgtatgccaatgcttcctctggtcaggacatgcatcttacttatcttttcactcttatcacaggagcgtttcttggacaaggctaaactatctccagactatttcattgctgattgtgaagatatgctggtaagattctttccctcaatgagcaccaatttctatatttggtcaaattatctagaagtaagtcagttttccatctctcaactctgtccagagttcaaatttcacgctcaactccaaaaccatctgctttgcactgtcctatcaaaactgatgcaagtcatacttaatgcaagcccctcatccctccctccttccccctatttctcagtgctgtggccaggccaagcttggtagcaccttggtacagcctagatccaatgctgaactagttcaagaggaagctatgaggaataaaaaacctagccagttagcctgcatgcaatacaggaataaggttaatgagtctcatggcaatatagcaactgaaatcgagagatgaaaccaacattttaaacaaaaaacaaaagcaatgatgttatcagattgatttggacatcagtaaaggaggatatttgcttaagattaatttccggttgagctttgactgttgtaactgttggaatctctgattttcctcctacatactccctctatcccataatataaggcgtgcacatatttcaagattcaactttataaacatttgaccaacaattattataatataaattaaatttttatttgctaaaattaatatcattagattgacatttaaatgtactttaagatggttataattttgttgcaataaaccttataatatatgagatattataagttaaagattagttttgaagactatgccaagtttgaccatgccttatattatgggatggagggagtagtatagtaggaagaggcaagaaaaactttctggccatgctgtttcgatgagcttatcaggctaatgtgaagcacacaaccatggatgcatcagccgttgtgatctctttgacatgttcatctttcctcatctcaaatggtatgggaaacagatctggtggtgttttccaatggtgtgtttggtggcttcagcccagcttgatgagaggatctttttgccatgtcatgaaacagttgtgttgtttgccctgcactgttagtgcatgtccaaatagttgccacaccatgatacttttgtagcccagcagtattattctgctaactgactcatgttggtgttgctaaaaggttcaaattaggaaataagatacatacagtttcatatcaaaattatttataaggttaaagaaatcctttgacctagaggagctatggagaaaggaacgagggagtgagaataagagagaggaggagaaagacaagtcttgtcctgcttggcactgctttttctaaaaagccaaaattatgaaatgtgatttttgagaataatttaggtaggtttttttcagttgtcttcttagctatcatgaaaataaggctgggcaatggaagtggtgaagaaaaatcccctaacaataattctaaaatcaaatcctaaacttacaatgagacagctttgctaagaggaataagttggcagcggcagcatgcctcttcatgactcagcattcacatcggcatagtacacatgaatataccacttgagcagttcacccgtttaaggcatgggcattgtttctatgcatagttttttagctagaggtataatttactcagtattaggtttgttttaatgctctataaggacttctatggaatgtcaaaatctgatctcctgggtagaacagcattgacagcctactatcaaaacacaacattttagcaaaatgttaaatttataatgatagtgaactttatcaagcatattttttcctattgagttggaggttcaaacattttgcttaaagtaacctttattcctcatatttttaacagaaagttgctgctattgttgatgagctaccacttggactatatgataaatacctcttctgtctcaggtgatctgtactactatgaacctataatcctatatcgatccatcaatctgtcctttttgaatgctatgctttttggatatctttctccacaactgttgtccaaaatataagctcagttatacacatttgacactttataatttgtatcgcagtcctgtggacattcgtgatgatatatctactaaaggattaattcaggcaaacatttttgtactactatcattcagttatgtgttttgtggaatcaggaaacaatttcactgattttttttgagatgcagtttgcagaaaattatgcaaagaaaggtattgttcgactcaaagagatatttacacctgggacactccaagtgcctaaatcgcacaatcaactgaaggagcttgaatcgattcacaaggttatttacattttctctctccagtataaagcagtactagtacattatcttgtgaaggatttctgctatgcatattatttcattctgtaaaggttgctatccatctgtcccacagtcactttctatttctgtgtaccattgtccccaaacatttgtacaacagcattgatcatgccagtcttccatttgttacaccactgtccctaaacagtctgtagatttatctctgcaaacagtttgtacggttagatcgatcactatgtcaaacggttataaatgcaggtgctagagttgtatgtgtggttgagcttcagattggaggattcctatccagaccgtgaattggcagcttcccaaaagtcaatctgtagcatgtgagttgcatgcagggcttacttttttttttttaatttgttttactgataaattctttggaggtcttattgctggcaatatcaggttgattgaagaatatctggaaaggtccggctggcagcaaaatggacgaaaggactttttgcagaagccaaaaagactacaccaagaatatgatgcatcacaattgtatgaactttttcttttattccaaaatgcacggtattattttcatttaataaagggaatgactatgctagaaacatttaaacttaagtctcaatctaactccactcatgatatatacctgatgtgtctgaactgaatatgcatgtactatagttgctctgctaatttttttccctgcacttttagcattttgcatcagaaaatatacctatgcctatgcaattgattctctattaaatggttatgatgacttgcgttgaatggtactcccacacttgtgggagggcagagaaataagctagattccttataaacttttaaagaagttacaggttgtatatagcattgcaaaggaacatatgaagttctaattatcgaattgcaatatattttcatgccaacctgctggcagagatcattttgctaatttcgtttttcttctcttcatttctttttgatgaaaaattgctagtgggattgctacatttagttttcagtgcctttgtttacttaactctcttaatgaacaggcgcaaatattttcaagaaattgatgtgagatcaaaataagatgcttatgctagaaagtcgcctcacaatatctgcttccggacaacggatttgctcctgtttgcatacgttatggtcgaggagaggcgacaagccgacaatacattttatggatgacaggagtcaaaagaatatcctttgccgacaatacattttatggatgacaggagtcaaaagaatcatcctttgccaaaaccatttaattggcctaagcagtaaatgtggcagcacctgtcctccatccaaacaattttgtagctattctttcattacactttattttaattatttctaacacagatggagctgtacatcacgatgaaacgtctaaatgttcgttaaagttattaacatagacaggacgaagccacctgtaaactttgcggttgtaactctttgtgttatgaaaggtgtaaatatgtcaaaatgacagttgtcaagtgatgtttcttgggcagctaaacacctgatttgtgcatgccaaatcgctttcctgtgatgtgccagcaacatgcctatatgtgccagagcgcaagcaaaacttcatcatgaatcaaccagttgccttctatctcattgtatcagacgtaaaagatgatatcagttgttggtgatgaatgcccttaatgcttcattgaaactgctattatcaatgtactcagtagtttctactcccttataagttgctttgactttttttggtagtcaaacttttaagtttgatcaagtttatgaaaaatttagcaacatttaaaacactaaattagtttcattgaatctaacattgagtatattttggtaatatgtttgttttgtgttgaaaatactactatatttgtaaaaatttagtcaagtttaaagaagtttgactagaaaaaaaaagtcaaaacgttttataatatgatacggagggagtatgcaacatagcagtaactgtaacaattgaaaagtaggatagttactgaatcacagtcgcatttgcataaacattccaatgagcagtacatattaagtttgcataaacattccaatgagcagtatattaagattcatgaccacaggtgttgtacaacacagcacaatgttgtccaccatcagtgacctctcattgaaaggactccatatgcttcagatttgttacctgcgtcctgagaacttgaatctttttgtacactgactgcagattcctcttctcaagcttctccatcacaagatcaaatgtctcctgctttggagcaaaaccctttgacaccatttcctccaagaacaggcaagactgggcaaccttcccatttctgcacagccagcttaccaacaaggtgtaagtgctgaaatcagggctaatgtcctttctaaacatatggcacactaggaacagaagtatctttacccactgtcttttacagcacagcttcagcaatggcgtgtatgtctttatgtctggattgcatgactgctcctcc

SEQ ID NO: 414 - DNA, 2981 bp, Oryza sativa
ctggtatcgattaataggttaatttggagcgtcacgggctagttccggtcggtactagttctgggcgtgacaacattccataatagatgacacgagttcatcttttaccatctatctttttcagtgttctccttttccggtatttatctaaacgtgcatcataactttttcatagaggaagcacacacaactcaacaaaagctataaattgctcctaagcataatttaacacacgatcaattcatccaaaaatagatctcacactggattgagaacatcgttcaaaaaaaaaactcaaccaagacacaccaatcatattttacagggttgtaccgtttgatacgatcgtcgttccataataaacggcatcagtttctctcttaccacacctcgtttgagtttatctcttaccaccccctcgttttttttcactgttctcctctccaacaatggaataacggtgaaacaaaaccgctctctgcatttctgcaaacagtacaattgcttaacccgtggtaccagccgttttttagtcttgttacaaaaattcaaaagaagccgtaacgttttacatgaggcgcgaattgaaagaggcgcaaaccaggggccgtgctgccgtgcgtgcgtgcgtgccctgccccccaacttgacaagtggatggagggaagggggacaaccccggtcgacatgcgagcggatggggaaagcgggccgcaccaccccccaccacccgatccatgggcagacgcagcaaaaaaaacatcacgaattcacgcacgcacacgcatccacagctcgaccgttctcccagtcccctcccccacccccaccccgtcgctgtcgtctctcgccaccgcataccgcccacccaacccaacctcaaaaatcacgtgttcttcgtgcccaaccgcaccgcacgtcgtccgtccccaccccaacctgcccccctccctctccgctgaaaaaataagtcgcgaaaaccccaagactctgctgcttcctcctccttccccaacttgcctccaattccaagttccaaccctccacctccctatataacacagctcttcccaccccgtcaaatcccacgactcaaaaccaccaaaactcaccaagcaaagcaccagcgaggaagaacaagaaggaaggtgaagagaagccgcgttttgtttctcgcgaaagtgtttgttgatatggcgatggaggggaagagcaggaggttcgcggtggcgtgcggggtgctcagccagtacgtgagggcggagcagaagatggcggcggcggcgggggcggcaccggcgagggcggtgacgacgctgagcctgatgcctggggcggaggtggtcgtcgaggaggaggagcggagggaggttggggaggaggaggcggggccagcgacggcgccggccgcgccgctgaccatcttctacggtgggaggatggtcgtcttcgaggacttccccgcggacaaggcggcggaggtgatgcgcatggcctcctccgggatggcggcggcgccggctcagcgggagggcgccgcgctcgcggacatgcccatcatgaggaaggcgtcgctgcagcggttcttcgccaagcgcaaggaccgcctcgcggcgaccaccccctacgcccgcccgtcgccggcggagaccaaggcctccgagccggaggagaagaagacgcccacctcatggctggacctcgccgcctccgcctccgccgccgcgcgccgtgacagcctcaccatcgcgctgtgatctgcgcggctttgaccaaaaacgacttaagacgcgcgcgcgctctcagcgcgcaagaggattgattcactttgctcatacccatggcgacgtagagtttttaccgcttttgctatacttctttgtaaaattcgatagggagattgaattgatgggaaaccccttgtgcctgttcttttttgtcccactgtatcaaatattctttcctgtgcaaattaagccaactttttagttgttacctcaacaaaaaaaattatctctctcccggttaatttttcaactagcaaaataattccaaaagaattaccactgaattactccagatcaagcaacacacaccaaaaaaattaattaggcttggtatgaaagtaaagaagccacacgtgatgaaacggggcacagcatgtggcgggaggattgcgtacgcgtcaatacacgcgacactgtgtggattggaatcgggagcaagctaatcgcttcttctcctcgtccacatttaggcgtatggcccgcccaatcgcgcgtgctgaaaattcacgtggccagatagcgagtcgtctcgacgacctgctgcgcggggtcggttccgaccacgtttctttcgcctcgagatcgacggatcatctaaccgatttgaacgcaaattttttataattttggccttcttagagcaggtacaataacatactataagccagctgcaaatatattttaataagataaatgaggagagagaaaaacagcggactacagatttatagccagctgtagcacagactccaaaacacactatgtgcatgatatgtgggaccagatattaataatgtaatatgtaactagttagctatatatactattaaacttgctcttatacatacgaattgcttttactttcttgatgtgctttgccgacacgagttacgtgccatcatgtttgggattttttttatagtggggaaagatgattacatgccgaacttaatttagtactagtacagtagtacatcattgaacgttatttggatgtgaacatttttatgtttcgtttcacatgtaggagtaggttagtttgaacgttctggcaggggctaattgatgttggatgggtcatgtttggtttttttagataaggaaagtattccttgaactttataccattgaactctacttggacgtataaatatttttatggattgtttgattcgactccaaaacttgccctac

SEQ ID NO: 415 - DNA, 5967 bp, Oryza sativa
aataggccttccatattatctcaacataaacatagcataaacataaaatgcaatatcgtaacatctgagtaatgactatataaccaattcaatgatgcaacccttacaactatttaagataacggataacccggccgacaacccttaaaactgtgagtaaaaggagattgattagatgatgcgaagctttagattgttcgacgagcttgctggggcacaaccccacttaacagaagcgtaatctaacatctgcccaacggttggctccatgcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaatcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtatttgtcacgttgatgtctggagagctagtgagcgagctactaggtgttagtgtaatttaaccggcaaatgtatgaacgaattatgaataaaatcttcacttgtgttgtcatgaataaaatcttcacttgtgctgtcattatttccgaaattattcatcaaattcgaaaaaaaaagaagtgaactatttatatattttatcggacaaatacacaaaaatcttagaattatatcgagttgtgtgtgaattagattgcgaataggcccttggtaaaaatgaaaaaaaatatgggggttttcagtttttacaagcccatttggtcaatactgggctagccgttgttggcccgaccgccggaggctcactcgcagcggtcgatcatggcggggagggagaagaggcggcgggtggcggcgctcgacggcgaagagcggcggcggcggcaggaggaagcggcgaccctcctccacaggatcagaggtgcactccccctccctctcgtgatcaatcgcttaaaaaacttctgaatccttcatcaaccgaagtaaacacgcgtccctcgttttttgcgcagggttggtgcgctgggtcgtcgccgaggtcgccgccggccgctccccgaccgtcgcgctccaccgctaccagaactactgctcctccgcctccgccgccgccgcgtccccatggtcggtttccgcgtctcgccctaccctaccatctcatcggccgtttcaaattctcaccccgctgtatgcgcttgcagcgcctgcagctacgacgtccccgtgggcacagatgtactctcgctcctccaccggggctcccacgcctcccggctcagtacgcgtcgttgatttttgtctcaacctgcgtatctacgatcatgttaatgttaatcagtttgggatgttttaatcgatgtgcagatgtgctcctcagggttcttctcgtcgtgcagcaactcctgcagcagaacaagcactgctccaagagggacatctactacatgtacccctccatattccaaggtctgcataggttccatgcctccgcttctgcttttgtttcctgctgtgtgtgacaattggaattctgacacctgtttttgtctaaatactgcagaacaagcggttgttgaccgtgcaatcaatgatatatgcgtactcttcaagtgcagccggcacaatctcaatgtggtatgtaccgcgtaatctgtgttattttccttcagaatcttcagttttgcttctagaagttgcgtgtgcatcacataataagattccactttccagctgctacatcctttgtgcccacatttctgtcattaatcacctggagccttttttttctcaatgctgttttacatcttgaattcatgtgtatgtactgtcataactgactggaatgtgtgctaccttggctgcttgcaggttcctgtggcaaaagggtaggaactctgtcaactatcatagagttggagtgtctgaagatatgtttaactcattctactgtcctattgattgtccatgccaatacttaataagataacttctaaccccttatcttccaagcacttggtctgcttaaaacaaaatctggatgtaaatagtgagatgcttctcttttagcaagggcttatagagcactgtgaagctaccattacagtgctatgctcatatattcttcacctattcatttcccctgttaaaaactcatcaatgtctttattattccagcttggtgatgggctggattagatttttagagggagaaaaggaagtctattgtgtaacgaatgtcaatgctgtaagttctatgagtttcctttaatcactgtaatatgtttctttctttttattgatatggtttgatttttgccttcttcaaatgcaggccttctctatcccagttagcatcgaagcaataaaaggttgttcagaaatttaaagatctaaaattcagtatttatgttactgttaatctgcactgaaaataattcctttacaatttgctgacatggattgcgtgaggggttggaccataatctcaattattcagaattagccaccatcctttgttttgagagaatccactttgatatattctgaatcgaatagctaggattgatctcttagcaaggtgctgttcattagactaaagaataaagtcagtgcttagtatctttacccgtcttgatttaagatatgccagaaaaagactggacaacaagtgaacccacagtttattcttcattttccttacaaatatgcggttgattatacttatatcttttactcactttatgttacagatttcctctcttgttatctgtgaacttcagtgttatccctgatgcctgaattatatctcaaggaaattaagctatcttaggttttctcttgtagatgttgttagtgttgcggactacatacttattgtcgagaaggagacaggtatgaggcttaaagattcctcatgtgcatgtgatacttgtactcttccagttccagccttcctacagttcgcttctgtactctccttgcagtgtttcaacgtttggctaatgacaagttctgtgaaaggaatcgctgcattgtgattacagtacttactaactgctgaatctggtgttatacacaaaatatcttcttgcatttattcttatctagtttgatgttgttctgtctgctcagggaagaggctacccagatattccaacaagaaggcatatactctttgttatacttttctcttttatttttctgaattgatatttcaaatgtaaatactttatttttccagattcttgcgctaccttgttgaacagctgcatttgccagtttactgtttggtggatgcagacccttatggtttcgacattctggctacctacaaatttggttcactggtgggtcatgatttatctaattagctgtttgctttgtatttgctattatgcactatctgagcatacctgttaattaaaaatcacatataaccactttatgcaaatgactactacactttccttatcagtagctcccaatagctggattgacctttatgcattacatttttgtccagtatcaaggcacatttgaatcaaacagtatgccttcagtttgtttggcagctctaagcccttttagcatgtcttgttttcacgatattctgtcccattttgctggtagatttggaccttgcaagtttatttaattttccttgaaagcttggtgtatttatttgtgttaactaactaccttctgcaatgcgcttgtgtaattctcattctatttaagcaattggcatacgatgcaaatttcctgcgtgtgcctgatattcggtggcttggggtcttcacatctgattttgaggattatcgccttccagactgctgcctacttcacttgtcgtctgaaggtgactaaactgagggatataaatgactgacatttctacaactttttcttggaacttataagtaccttgtttgttcttattcaattgtcaacctcatgcttcatgtattctgttgcagacagaaggaaagctgaaggaattctctcaaggtgttacttgcacagggaagccccacaatggaggtaaggttgtacttttcgtacccgtattacaagcaattcatgattatgatgggagtttacaagttagagctcggacttagctagtggaacatttctttgcttttgttttaacagtagttaaagtcatttttttgaagactttcttatgaaaaacaggccagcttactaataaaagctgtactcctaacttagtgccttcccttcagtctcatttccttagtttgaaaaactccactacgcccagtaggtgcaagttttggggatgaattttagtgtaccacttgcctaggaagacttggcccattttatttccagtaactttagccctgaattttttacactgatatactttatttggcaggttggagttagaagccatgttgcaaaagggtgtcaaatttgagattgaggcgttatctgcatgttccatttcctttttatcagaagagtacattcccaagaagatcaaacaaggaagacatatataagattggttgtacctgtatctatccagaaattttcatgtggcaaaagtcttattttgtttttgtcatgctaactgtagtcacatgtatggcactctggtagtttaacccccagcaagtattttgtagcaattgtttatatatgacggtgatttggtgctgtctcaagaactgaaaaccacaaatttacagcaactgaaattttactattactatctctgctactaagagcatctccaaggtatgtctaaaattaggctcctaaaaacctgtattgggagtatcacaaaagatattgggctcaaaaatcacccacatctccaacagtatcccaatacctgattccaaaagaactttaaaatctgccatatcatcactggtgggttctcttaaactgatttttctccaattgggagtgcgtggaggtgcccaaaattagctcctattgggttggattttggatgtgcctaaatattgggacctcctttgggaacctgttggagggttggttttacccttaattcccaaaatttaacttttaggaacaagattaggcctctcttggagatgctctaacaataccacctaaagagttgtgcagctttatttggggtttattgcatttctaacagaaaccttttataagtgaatacctctatagtctgcaattatgcatgtcttttctcattttctgccagatcgtcatcctgtggaagctgagattaactatcccgatcttacctgagacttagtctccagccatcatcagccttttttccttgcagagttgcagttatggagttaagaagaacgggcaacaaaacaaaggaaaggttgcttaaattccaggtgaaatctacacccacacaagttatatcatttgcacataacaagccgaaagcattgcattgactgaaaagtagcttatcgagtttcatatatagtctccagccatcatcagccttttttccttgcagagttgcagttatggagttaagaagaacgggcaacaaaactaaggaaaggttgcttaaattccaggtgaaatctacacccacacaacctatcatttgcacataacaagccgaaaacattgcaatgactgaaaagtagcttatcgaatttcatatatgcaggtgtgtgagctcggtgttacttcacaaatacttgtctcttacacatgttcaggagctgatccactatgttagatgtagg

SEQ ID NO: 416 - DNA, 6063 bp, Oryza sativa
tttatttgcctacatatcttttctcggtagggattgctacagatgactggttaaataattggggtacaaatacatatgtgcttgttggctatctgcatattttttatgagcaaatttagtaaacctatgttttatggtcaaagttgtataaaattggtggcacagaaccccatctattgtggtttttaagttttacaaaacaccacccctaaataacatatttggcaaatatttaccaaaaaaatttaaaacacacaatgtatatgaaacttttagttgttgatttcttgattaaatttgttagtttaactcttcaccacttaaaaaaaaatattatttcagatatgctggaatcaattgaaatttgaattaagacggggttttatgaaatatttagatcataaaatatgtggttatgtgccacaaatcatatatgcaattttgactataagacgtaaggttttataaaatttactctatttttaacttattgacattctacgatggttaaaaatatgactaactatgacaggtatgaacggtgagctgcacacaaaagacgtgggcatacacctgtttgcagtttgattcacattaacatgaaaataatgtgacaaattttgaagagaacaaaagcgtgactcgtagattgacgctattacagtttaagtattattaagaaggtacaccaacaaatcatgaatcacttacccgataaaataaagaaaataaaatagtgcatgtgcaagttttttcttaatataatttattttgtatatctctcttactaagtactaaccaatatgattataaacagatggagatataattattcatgccgctaatttgttctctaaaggagttcagctgcgtgaaaagggttcggcatcaaccctgtgcaaaatcgtgtggactacaacgagggtacctaacaaatatccccgtaacaacacaagtaggcgccattgaattctccaagatttctttcaacccttttcctcctcccgtctctatatatagccttggcatcaaagccattctcctcctcctctcctcagcactccatcttcctccatctgcgtattttccaacacatctctcttgcagttcgtttcaagtctttcattaaggtgtgcgtcttcttctctttgtcattcttctagatcacctgcttatacttctgcatttctgcatgcaatgctcagttggtccaacatttgttctttgaacttactgcatgctcttttgatgtctttgtttctgcaaaaatataggcaccgaagtgccaaaactgaacttcggtgcctttctcactgagaaaacggatacttttctgttgtaaaggatgctgtgattgttggagttcatgtaggtcctcgaaaagtgtgaaaacagccaaaaaatgcactcgttctgagaattgcttgagaactgtaaacatggccacaatttgctagagctagctaaaactgctatcggatccacttatttccttacctttttcttgattttttcttgtttcatctccctagggttgttaatgttcagcatatccattgacattttcttttagacacccagttttcttattttctgaccgggtcaatttccactcaaagttcgtatttgaaaacatgttcgatgaccaaaacaattttttcaagtctattcttcttcaagtcaattctcctaaagatttccaacttgatttttttttcacaataaaaatctctaaccttacgttatatgcttccatcacacagtttagtagaatatataagctgacgttattgtgcttccatcatggctaatagcgatgtactagtggttgctcttttaaggttggtgcccatggttaattgcgttctgaactttgacgcgttaggtttacctaccatttctttgagttcagaaacactcattaagacattaacccatgggcccaagcacacatggcctcagtgattagtccagcatatcgttgtagtagatatcaagacattgagcctaactgtgttaatgatcatccttttcctccggcagatattttattcttttttattcgactcagagtgacattgtactgctaaaccacagttgatgccacacttaatcctgggcccattttttttctttccttggcatcttgtagtattttcccttttgttgatgttgatttgttcctttgctcatgaatgacaaggacacacatttattacggcctgacacttgaggaggacatggctgtcgttttacttctgtgtaaatgaaaagatttttccttcttgatttatgcagtaaaactttctgaacatttgaagtgcaacggagctggcgttttatggcttttcctatgaagcaatccacatctctgatatagatgtgtactcgttctgaacatgacaaggtacggcacatcctaaaactgttactactattttcatctcatggaaaacaagagcagtttctctaatactttgtcttacattgtctgatcagttctcaggtatttctctgttgatgaactgcctccacacctgcagtgacaagaagacactgaagaagtggtttttcatcgacaagacagttggctaaattcagcagtgcactcgtccttaaagcgatcgatcatacttctttcttgatctcatcatcctaaattttcccaaatggatttgagcaatagctcacctgtcatcaccgatccggtggcgatcagccagcagttgttgggcggcctgccttcaaatctgatgcagttttcagtcatgcccggtggctactccagctctggcatgaacgttggtgtcagtaggctcaaaatcgaggaagtccttgtcaatggactgcttgatgccatgaaatcctcgtcacctcgcaggaggctgaatgtagcatttggcgaggacaattcatctgaagaagaagaccctgcttacagcgcttggatggtaagctacaatggttacattggttgtgtttctgttggcctaataagttgtactagtaactcgcaatccttttcttttcgtggacagtactgacatatgtgatgacttgtgttgcaggcaaaatgtccttctgctttggcttccttcaagcaaattgtagccagtgcacaagggaagaagattgctgtgtttctagactatgacggcacactgtcgcctattgtggatgatcctgacaaagcagtgatgtctcccgtggtaagtctgaatataaactctgaccaataactagcatttcttggttaatgaagagctgctttgaattaaattaaaaacttttcctcagatgagagctgctgtgagaaatgttgcgaagtacttccccactgcaattgtcagcggaaggtcccgcaataaggtaccgaaaatatggttgcatgcattttagtgtactagtattagaagccaagtgattgcatatgcaagtgtatgtcttatcttacatatggcttacttatctctatgcaggtgtttgaatttgtaaaactgaaggagctttattatgctggaagccatggtatggacataatggcaccttcagcaaatcatgagcacagtgctgaaaaggtgaggatttcttgcctatgtttctacaaatagagtgaaaaagtctaccttttttgggggcattctaacaaatatgttctagtgtaaaatactgactatggcttaattccaactacagagcaaacaggccaatctcttccaacctgcacacgactttctgccaatgatcgatgaggtgcatttctctttcaactttgaagtaaaaaagttgtattgctctatccagtttaacgcaaatataaaacgattccatcatctcattattattcatataaattactgtgattagtcctgatgggtgtgcaaaagttttgtgctatttgttaacaaactttttatttcaacaggttaccaagtccctcttgcaagttgtcagtggaattgaaggtgcaactgttgagaacaacaaattctgcgtttctgtacattatcgcaacgttgcagagaaggtaaaaactgtttttttttccgtcatacttttttctctgctcccaagcgcttggaaaatgaaaattcatctgacaatattgcttcttgtttgcaggattggaaactggtcgcacggctcgtaaacgaagtgctggaggcttttcctcgtctcaaagtaaccaatggacgaatggtaagaacgctatgccaagtctatttagctgtacactgaaacttacccatttcctggtaatttgcacatctatcaaaccctgtgctgaatattctggaaatatatcttcaggttttagaggttcgtccggtgatcgactgggacaagggaaaggctgtggagtttctgctccagtcactcgggctaaatgactctgaaaatgtgatccccatctacattggagacgacagaactgacgaagacgctttcaaggttcatatattttctggagaacacgtagtgctgtatatcctagtcgcatctttgattcagtgtaaactgatatagcggtcatttggtttaaccaggtacttcgacagcgaaattgcggttatggaatactagtttcacaggttcccaaggaaactgaagccttctactcgctgagagatccatctgaagtaagctcaaaagaatatctttcttcttccttgggtgattttcattcgacgtgttcatcattaactgtttgcttatcgtacaggtgatggagttcctcaatttcttggtgagatggaagaagcactcagtgtgaaaaaaagaagacagtctgagcaggttttactaatactactccggcagaaataactgtagtttccgaggcgacaattttgaagcattggacgctgtagatagatgtaataactctctagatatgtggttccaattcattcttattgatcgatgttattgtattgttcatgttctccaccgctgagaaaaattaatcagtgatggttgatccggtctcttgccattgtaagttgtaagcaagaaggccctcttcttagtatccatgctgatgaacgaaattaaaaccttcatttttcgtgtaatattctccctactgtgaaccttttacatagtatatatcactcgtctattcaatatatattcttccttcatccgaaaataacgtaacctaaaaatgagatgtgactcatcctaaatttaatacaattacggtctagtaagttaaaaggttaattcgtgaacgtacgtactaagtttattcgcgaatgttcgacgaactcgcacgaacacctcactccttatttgaaaagtttgtatgctgaaagtttacgtgccccatctcgatttggatcaaattccgattcagattcaaaagttcctacacagaaacttcatatgtgtaataagagatttgttgacagccttgtgctacttgtttgttggatggtttggaaggaaagaaatgcgcgtgtgtttcagaaccagcggcgctcagccagttttctgtttggttcaatcaaaaaggaagtggcgatttggaaggaagctggggttttcaggaatataggagagtaggagtagtccttagtgtaatcaagcttttgggaggttgctccggtgacaacttccattacttcgacagcttcttgttgaagttataactttgtatatttgtatatattcttcaatcataagtaaatttggttggcctatcttggctggcccggcaaaaaaataataataagacatttgctccggtctaacaaaaaatatctcgaggtactggtacttcacggtaccaaatcgtttccgatgttattgaaacaatgctcatcctacctagttagatctaacgattggaaaatttcgagatattttttattggatcggagcaaatctcgtataataaactatttgggacaacgtctttcctctctacacttagagacctgccacagtagagttccttatggttgctaacatgagggaaaaaactcaaaactacgtctacgaaacaaactttagagagtggatcgaactaatataacgatcggttttgcccttggcaaa

SEQ ID NO: 417 - DNA, 10355 bp, Oryza sativa
tttcgaattatagtagcaacgggtgtttaatgtcacacgcacattgtattagagaagttaatacactccatattcccgagacaactttagctacatgcctccgctatcatactaaatgcgcagcttggctttggcgtgctcttgcactggcattagacaaggtccaaatgttaaagtaatttaaagccatattattttgggacactattttgggagccacctgggccgatttgttttgatcgacttcttattttgaactatggggactattttgtaacgaagacgagaacgagataacacgaagaaactaataactacaccacactaccttgttaaagtgggttggacctaaacacgaacaaacataaaaagatcaagcccagagcccacaaagccctacatttattcaaaggataattttatcatctttgagaaagtatcggaaggtaacatattttatagtgtaaattttggtaccttgaggtattaagtatctcaaggtactaaaagttttaatgtaaaatttacgtacctcaagttactttataaaggatcgtaaaatctctcttatttaaatcagtgtctattccaaacttccagggctcaagccttaacctacccaaagaggattgggccgggccgggccgggctgggccagggcagccccatgaactacctcgaactcgaactcgaactgggtcagggcaagccataacatgcaaaaaaaaaaaaaatgtagtaactcgaactcgaagatcattcgtaggagaaggcggatttgggctcactgggtggcgatcgaacattggaagtggtggattccagctgggagcgagctagcagccctctcccatggcgccctctcgccttttccaacgctcagagtgcctataaattaaagggagagtacatgtgatttttcatgataatattgtgagatcgttccgcctctcgcccgccgtgacgacgagaagctagagagagagctctctcccatctctctctctcctccccctcctcctccgcgggcggcgcgagcgagcgcgcgcgcgggcgccatgccgacccccgcgccgtcggcatcgtcctcctcctcctcctgcggcggcggtggcggtggcgccggggccgcgtcgtcctactcctcctccccggacgaccgcatgctccgcggggagtgcggccgccgccaccccttcgcgtcgtcggcggcggtgggggccggttccccggacgccatggacacggactccgcggagccttcctccgcggcgacctccgtcgcggacttcggggcccggtcgccgttctcgccgggggccgcctcgcccgccaacatggacgacgcgggcggcgcgtcggcggcggggcacgcggcgcggccgccgctcgccgggccgcgcagcgggttccgccgcctcggcctccgcgggatgaagcagcgcctcctcgtcgtcgccaaccgcctccccgtctccgccaatcgccgcggcgaggaccagtggtccctggagatcagcgccggcggcctcgtcagcgccctcctcggtgagtgcgatcccgaaatctcgcccttatcccaaatgtgatgtgctggagcgatgcatgcatcggctatcctgcactgcatcttcatctcgaaaattttcaccgacgctgcaggcgtcaaggacgtggacgcgaagtggatcggatgggcgggcgtcaacgtccccgacgaggtcggccagcgagctctcacccgagcgctcgccgagaaggttcgtcgctgcaactcgggacaaatttccctttctgtctcaactctgaagtctgaaccaatagaacagtgactgttttgttatcactctagtactagttggaatcatatgtgtctatggagtatattttttcttttctgattgattgaacggaacagagatgtataccagtgttcctggatgaggaaatcgtgcaccaatactacaacggatactgcaacaacatactctggcctctgtttcactacctgggattgccacaggaggacaggttggcgacgacgaggaatttcgagtcacagttcaacgcgtacaagcgagcaaaccagatgttcgctgatgttgtgtaccagcactacaaggaaggggatgtgatctggtgccatgattaccacctcatgttcctgcccaagtgcctcaaggatcatgacatcaacatgaaggtcgggtggttcctgcacacgccattcccttcttcggagatttaccggacgctgccctcccggtcggagctgcttcgctccgtgctctgtgctgatttagtcgggtgagcatgccctttgtgcttatgcctccgttctgccttctgacgaatttggtactggaagcagatgagttttggttcactatcattctgaatttacacctgcgcttgctgtcagactaggcaaccaagtgacttttgtgactttgatcatgttcagtgtgtttccaagtcctaatcaatcaaaaagaaaaacagtttgttaacgattgtttgccatgtctatataataaagttgcttttatagtagcttagaattcaatcggccaactttatctcgtacgctgacagtaaaggtacatttaaaaggtgacaatggatagtctaatacttgaactgacaatagagacacattacatgtcagttgattaagtttgtaacagaaaaataaacaatactacataattgcaaagtttctttgatgtctttctttcaagaaacacaaatatatcaatgctacagtattgctgatgaatttatccatgttgagatgtttttctggtttctgatctgatcagtctcaattggtgtgctgtttcattttcatttgctgatgatcgtccgagtagttaattcttactaatatttagataatttggcatacaagcgaatcacgtagaacatgatacttttgaatgaatttatcaaagttttatcacttggtgagttgtttcatggttttcctactgatgtctcttcttcagatttcatacatatgattatgcaagacattttgtgagcgcatgtacaagaatacttggactggagggcactcctgagggtgtggaagaccaaggaaggctaaccagagttgctgcggtacatatcaacctttgtttatttatttatttaactattttacctgaactgtttgatattcctgacgattctgttagcttcatccactaattattttacttgctactttaaaaaacatggctcatcttttttaaattattttgattatttataatctgttcaaaagatgtttgcagaatgagtgattcttttgactcacttggctgaaatcttcagtttcctattgggatagactctgaacgtttcaagcgagcattggagcttccagcagtaaaaagacacatcactgaattaacacaacgttttgatggtcgaaaggtgagaaagcacttgctcttcacttcttgatctggggtagattacgaattttccacttctttttgctgattataagcattagatatggacaagaaatctgaaacattactcatgtatcattctcatagtattagaagtttcgtatgtgttgtattaagtcatcctacctatttcttacattgtggatcttgtaaagtgggcaacagtttcaaagaaagctcatagatgatcttaagacctttacatgtggagttcatactgtaaacatctaaccaagcttgtcttcgtaacaatttataatactgctgtccatggcgtcccctgttttgtagtcagtgatctgtttctttctttcagtcgtatcactctctttgtatggtgtcaaaaattatttctttaataagatttaattatgctgagcttgtccccttcattactgataagatgcagccattatattttccaactcgctctagttccattagtcacttgttactgctgctaacttagaaataccctgttgcatgtcactttctctgctgttaaaggtctttaaataataatttccaattgatatgctttacaagcttgttttgtcagcattaaatgatttacaaatgcctagtatggtcttcccactataacttttccttgttgatgtgataggtaatgcttggtgttgaccgacttgacatgatcaaaggaattccgcaaaagattttggcctttgaaaagtttctcgaagaaaaccatgaatggaatgataaagtggttctacttcaaattgctgtgccgacaagaactgatgtccctgagtgtatgagcccttcctgtgttttatctcctatttatactttgtgcgactctacaagcatgtctgctggagtacctcagatgcatgaagtatgacttctccatgtaaatgaattatcaatatttatcagcttgcagtcttctttcttaaaaaaaaaacattcttcttaaaatctgaacgaagttgcagttcaataactttgttattgattatggattcaataagtcttacttgtgagatcatattaggtgagagtggctcatattatctacctatccatttgaaaatggggctgaagtcctataagaacctagttagaaagattgtttctcaaccttatttcctaagtttggtgttatgtgattgaactggaaatctaacctgattatttgtggtcattttaactaaccttagaacatgtcatgagcagatcaaaagcttacaagtcaggtgcatgaaattgttgggcgcataaatggccgatttggaacactgactgctgttcctattcatcatctggttagttttgtttcttgtccttgttaacttcatttttgcgctatcacaaaaacatacatccttcagtcatatttgcctcttctctagtaggtaaaatggcacttgtgatacccatattttctatgatgactatacctaacctatcactatttaaataataaaacaagtcagattttagttccttgtttcactctaccttgagcatatttcatgcttattttttatgagaagttattgtatcatctaaaaacattgcactccttgcaggaccgatctcttgatttccatgccttgtgtgccctttatgcagtcactggtaattataggctcctcttttgatattaaaattttactcatgacaataactcctgctttgtaatgatcacatttgagtgtgttgataggaatgttccttcagtattttagtgactcttgccaagcttgatctgtgcatttcctctgttttcttcagatgtggcccttgtaacatcgctgagagatggaatgaatcttgtaagctatgaatatgttgcatgccaaggatcaaaaaaaggagttttgatattgagtgaggtgagctgtcagttgtgatgatcaataacctttgatcactcctgaatttccatgctattcatatccattctgctggttcatacttttctattactgtaatttcagtttgctggggcagcacagtctcttggagccggtgctattttagtaaacccctggaatattactgaagtcgcagactcaatcaagcatgctttgacaatgtcatctgatgagagagaaaagcgacataggcataactatgctcatgtgacaactcacactgcacaagattgggccgaaacttttgtatggtgagtagttcattccaattgcctgatctgtagagcttgtttccaatggtctgattcgtagtctgctagattggaccttattcgttgatttgatgcttgctattcgactgtacattttgttttcccttgtttgactgtctaaatattgtgctgcgtcttttcatgtagtgagttaaatgagacagttgctgaagctcagctgagaacaagacaagttccacctgatctccctagtcaagcagcaattcaacaatatctgcattccaaaaatcggttgctcatattggtattaccatatttcttctttgctaccttctgttggctgggctgttctgatgcaaaaattgcttgtttattcttatctttttttgacgtaaatatttattcttgtctgatagcaatttctttacatagttgctttgatttgtgctcttatgcacatattgccttcactctgaaatgattggccttaatcttgctgaaatagttgctatgacttatgcaccttttcttgttcaagtaattaaatttaaaatctataaaattgaactatttaatttaaatattactgattgtccgatgatttttttgggaagtccagtgaaagcattttttttttaaaaaaaaactcagctttagtttatttgtttggttgcactttcaagtttcaaccactttaagtcgcatacaagtgatctgttcagctttctcttaaaaaaataataaacttaattgcactttgacagtagcatttgtatttacccttttttttttacaatgtaggggttcaattcaacattgactgagccagttgaatcctctgggagaaggggtggtgaccaaatcaaggaaatggagctcaagttgcatcctgagttgaagggccctttgagagccctctgtgaggatgagcatactacagttattgttcttagtggaagtgacaggagcgtccttgatgaagtaattatcagatttttcctgtcttttttcgtacaatagattgagtacgctactatatttccatcaaaactaacatatatcttcccatgcagaatttcggagaattcaatatgtggttagcagcagagcatggcatgtttttacgtccaactaatggagagtggatgacaacaatgcctgagcatctgaacatggattgggtagacagtgtaaaggtgtgtatttgataaataatgtctgctgcaaccacttgatgaatgccttctgacattgtgtattgctttccagaatgtttttgaatactttacagaaagaaccccaaggtctcattttgaacaccgtgagacatcatttgtatggaattacaagtatgctggtacgtgtttatgcttgattgctcctttagttttaattagagaaggcctgcaatataaaagcttaatgctattttcgttttcccattgcaaagatgttgagtttggacggctccaagcaagagatatgctgcagcacttgtggacaggtccaatctcaaatgcagcagtcgatgttgttcaaggaagccgatcagttgaagttcggtctgtcggagttacaaaggtcagtggttcagtgtgatgcctcatgataattgaaagtttacactttgttgttagcggatgtttgaaaaattatgttctttccacagggtgctgcaattgatcgtattctaggagagatagttcatagcaaaagcatgattactccaattgattatgttctatgcattgggcacttcctaggaaaggtaattatgcaattaatttatatgtgcatatccgtttctttcagtgcaaggtgctttttttgtctttgatgtttcaattatctcgtgtggcgtgatgcgtgcaaatctataaagtttggattggtcttatatagatgttgtgacactatttcattggttgtttagaacaaaatccaaagtggggaggacacgtccccaaataacctcattagccccttgcaaatttatatgtggaagaagtgggatttgtgggaatgggtataaaagtttctttggtatctttctttcttacacacgaaaagaagggaaaaattacctcctagcaaagcacaaaccgttcttttggtttacttacgaaaataatgttttaactcaacaaaatttaagcaatgttcatatcgtcaatgctgttgtactgatgcacaaataaaagtttttttgagaatgtgcaaaagaattgcacatcttttgtattaagaatgaaggagagtggcaacaactttacatcctctttagaaaacgaaaagaaaaggagaaaacacacaaagcacattagagagatatcttgcatcatccattttgcgaccgaagagcacgaatcctcctactccggcaacaggccggccttcctccaaagggtggctttttcagccaccgctcttgctacctcgtgccacgacctttgctgttgattgaacaccctatggatatacaacagtttgaaatgtttcggagttaccgaattgaaactgcacaagctatttactctaacattggaacatgtaataatttttgccatatagcatgcacgtttcctactattcaatacgaagtttggagcctttcgtgcttttaaaactgaaggaattgtcttctttcttgtgcattcttgtactcttcctgcacttgttcgattaatcattggctttctttggtaacattgtctctttttcaggatgaggacatctatgtctttttcgatcccgagtacccttctgaatcaaaagtaaaaccagatagcagcggctcggtatctcttgacaggaggccaaatggacgaccatcaaacggcaggagcaattccagaaactcgcagtcaaggacacccaaggcacaggctgctccggagaggtcatcgtcatcatcttcatcaagccagggcaccccaaacagccaccatgactggcgcgaagggtcctcggtccttgacctcaagggcgagaattatttctcctgcgctgttggaaggaagcggtccaacgcccgctacctgcttaactcgtcagaggaggtcgtctccttcctcaaggagatggcagatgcaacggcggctcacaatgggttccagtccacaactgcggattacatgttcttggataggcagtagatgttctaatccccggtcttcccccagagaagaagtttaaccctgaaagtattcattccttacatggccctgcatgatgtacaattgtgtacaaaatttaagctcgtgataaaactgcgagagggcagcaaatgagaaagcgttaaaatcgtttagagaattctgtacaaaattaaatgcgctctctgctcccatagtgctgaaatgagcccaccgctcttctacattttttttttggtctcggatcccgctattagcagtttagtgatagataataaatctgtaaacttttgttttcctgaatgttttcggccataggttctggagcgcgtcatgtttatttttcaaattctagttcagggtctagttctgagtttgtttttttttccttgttcgtctttagagctagatggtgaagatggtggtcacgatggagaaaattacatatctactatcgcataagataggattcgctcaaataccattattaaaatgggcttcgctataataccattctcaaccaagatgttttttctactatctactttcagttctaatagacctacagattgtctgaatacttctcctttaagcacgatgtaatctgcacactaatcatatcaagaaaccttaaccactttcagtttgcatatggttcagtgaaatttaatttgtggtcactggaattagagggattttagatagcaatgtgttgttttttattgttgtaatctgcagttaattatgacatccttcaaacaactctgtgaaatcaacctttgaaccatgacttttatatttacctttaaaagaaggttgttctttcgctgctactgaagatagatcactgaacatactggcatattttcttgtcaatttctcttgatagccttccatatttagagaatgagttgaactgttagtttgttatatctaatgatgtgctaatttgcatagtttacctccttcaaactgaattagatcatgtgttgagagaggatgtgtgtcctcgctggtcctgagctggatgcatattcccctatcgttcatgcttgaatctgcaactatttttttttacttgttatgttccataagcaaaatgagatcaattggatgtcaactccatgtcctcagggtgtgtttggataattgaaaatagggagtgggattggcgttaggaaatgaatgaaggcttaggattaaatgaaatagggagaatagatggttaggatttaaagatgttttttggtgggtggaaaattatttccctatcccattagccaaacactgcctcattgtcttgccaggtggagggaggcaacaatccaatccaggagtgatgggatgggatcccagctcaagggagccccagtggcaactacggttgggaggacctaagccctacagccaagctctatattcaaccccttttgcttaccggcaatgagtcaaccaacttccagtgatatgaaggtactgatcccctcctccatccctttccctccctctttattacgacatcagctgattgatcaccagcttttgattccgattgctccaatgaactttgtgcacaaa

SEQ ID NO: 418 - DNA, 4095 bp, Oryza sativa
ttagcttattttacccctaaactattaaaaattatgccagttgtattgtacagtaaacttttttaagccatagatgacgacgttattaaagttcaaaaatattttaaaatttttcatggtgtttgcttgaattaaaaaatgcaatcgtaagttctaaatgcatccatgttctaccaaattctcagtgcaacctatgattttatagaaataaaaaaagaaaaatagtgtttggaaagtgaactgaactgttttcaataatttgggacgtaaaatgagaaaaaaatagtgtaaggttaagtgatgcgatcaaatagttgggggagtactatttttctactccatctattccaaaatataaaagaatttagagaaaacagaacgaatctggacgaatctggacagaacgaatatgccatatccgttcaaaatatgttataaggagtagcaacgaagggaaaaaacaaattttaggcgtccggattcatcctcattctatttttacggagcgtgcaggcaacaatcaaacaaaaaccggataagatctattcctccgctaaattaggcaacacaacaaagcattcccctaaaatcaaacaaagaaggtaaaaacaggaatagattaacgcaatctacgtggtgcgcgtagcaattttcgccttgggctgtacgcctcccccccatctcccactcccacgacgtgtccgcacccgcggtccacctcccgatgcgcatgtcctacgccgccctctcccctccctccacgtgtcccccatccccgatgccccccacgtgggactgacctgtgggcccccaccctccgattgcccccacgtgtcagcctcccccctccccaccccgcgcgagacggcgtccgtttgccaccccgcggctaacccaaccatggttcggaagcgtcgcgacaccgcgagggttaacccaaccgcggttagcggagggggcctctctggtttatatagccgcgcctcctcttcccctcctcttcaccacagcggatcacggcggcgacttcggacgaacaccttgcctcgccggagttggagaagaggagaggagttagagagcaagatgatgatgatgggtgagggcgcgcacgcgccgccgtggcagcagcacgtggcgtcgccggtgagcggcgtggagggaggaggtgggagggagagcgaggtggtggccgcgccgtaccacctgctcgacacgctgcggcattacctgccgtcgaacgaggcggcggcggcggaggatgaggaggaggccgcggcggtggcggcggcggtggacgcgtacgcgtgcgatgagttcaggatgtacgagttcaaggtgcggcggtgcgcgcgcgggcggagccatgactggacggagtgccccttcgcgcacccgggggagaaggcgcggcggagggaccccaggcggtactgctactccggcacggcgtgcccggacttccgcaagggcgggtgcaagcgcggcgacgcctgcgagttcgcgcacggggtgttcgagtgctggctccacccggcgcgctaccggacgcagccctgcaaggacggcaccgcctgccgccgccgcgtctgcttcttcgcccacacccccgaccagctccgcgtcctcccgccctcgcagcagcagggctcgaacagcccgaggggttgcggcggcggcggcgcgggcgccgcggcgtccccgctcgccgagtcctacgacggctcgccgctccggcgccaggcgttcgagagctacctcaccaagagcatcatgtcgtcgtcgcccaccagcacgctcgtctccccgccgaggtcgccgccgtccgagtccccgccattgtcgcccgacgccgccggcgcgctccgtcgcggcgcgtgggcaggagtcggctccccggtcaacgacgtgcacgtctcgctccgccagctccgcctcggctccccgaggtcggcgccgtcgtgcgcctccttcctccccgccggctaccagtacggctcccccaaatcccccgccgccgccgccgccgcggcgctctacagcctcccgtccaccccgacaaggctatcgccggtgacggtcaccaccgcctccggcgccaccgtcaccgtcgagccgctcgacctcgggctcatcgaggaggagcaacccatggagagggtggagtccgggagagctctccgggagaaggtgttcgagcgtctcagcaaagaagccaccgtgtccaccgacgccgccgccgccgccgccggcgtcgcgcccgacgtcggctgggtatccgacctcatcaactgagcaaacccaacaaggcggcagccatggctgagtaagaattttcctcatgcctccatagtggaagcagaaggtagcaggaagagaaggaaaaaaaaagaaaatggaaaagtttttccaaccaaaaaaattctattatttttttattttagtttcttgcttgttagattctcctaatccttgtacatatgttcatcatcatcatctaccatcctatgtgaatattcttggatggatgttgggggggccagggaggcaggcaaaggcaaaggcaggatttgttttggggtttttctcagttcagttcagttcagtccagatggtggtggccatggctgcagctgcagtacaagaagaagaagatcagaaatggatcaagatatgtggttaaatcttgttttgtacatagtgtgtgtgtcaagtgtgtatttttacttgagatcttgtggagagatgaagcatgcatagagcatgatctgatgatctgatcacaacaacggcgatgatgaagatgaagaacaagaaggtggtggtttggccggattctgcgccagtttctgcgattccagaacgtcgtcatgatgattattattgttattgctgttaattaagtctgaagaatttaagctcgttttcgtcggatggtatagccagccgatggttcagctagcacctccattattattatcactattgttcctcttttttttttgttcattttgtttctcatcaagatgggatcgatccggcgacatattattgctctgtattttgatcatcaatgttattgttgtttacctactgatctagtagctcacaaattagtaccattattatattgtggtactttttactaagcttcggctgtgtttagatccaaagtttggatccaaactttagtccttttccatcacatcaacctgtcatacacacacaactttttagtcacatcatctccaattttaaccaaaatccaaactttgcgttgaactaaacacaaccttcatgggaggttcaaatgttttgtcatgtgaggatgaaatgggtatggtttagtgaaagttaatgcttatatttgaatagctcacaaattagtatcggtttagttgtctatgaaaaacttgacagacgggtttaaaatgatccgcagcttctactagtgtctgtcgagggagaaattttctttttcaaaacctgagttcggcctatcctataccagaggctctatcaccatgtcaatattgaagtcctttgaacaagaccacatcacgaagtttattgaatagtagttactttttttagaaaaatagctctattaattaataaactagttgtttcccataaaaaatggtactatacacacatacacacacagactatgttataaaggtttttttccgattctttttctcagctataaaccccataataagttcttatttaggtaccgtgcaaggactatatggtatgtgaagtttgcgtcataaaagaacttctacgaacacggcaatttttttaaacaaccctcgtaaaatagtgcagagttttatattgagaacacgccaacgaacacgataaattgagctgactacatatggatacatggttattagctagggcaagcatgcatgcatctcacaaaaaaaaatcttgcaaatacggatgggatgaagttgcagtcgagtactcctacaaaacttatcttaagcatcgtacaagtagatgcactgtggcaatccagtacaagtacatgtacatacagcactatggattgacaaagttaattaaagacaaagggatcca

SEQ ID NO: 419 - DNA, 6796 bp, Oryza sativa
cggcgacgagctgggctgcgacgattcagaggcctctggtctctggatcttgatgttaagcatgaggccgagcacctgcatcatccggggatcggagaggtacatgttgaggctgctggggttcctctgcacatcccgcagcatctgcatgaagtcgggctgctcgaggtatgcgcgcgtggtcgggtcggaggcgatcttggtccagagctcgggcccctggaacatctggcctatgccgtcaacgccgctgggcggcgggcggcgcggcggggcggcggccgccttcttggcatcggcgaggccggccttaaggccctcgttggtggggtcgagggcgaggcccttctcgtaggcggcgacggcgctcgcggcgtcgccgaggccgaggtgggcggctccgaggcgggagtaccccttagcccagtcgggcttcagctcgacggtcttctcggcgtcggcgagcgcctcggagtagcggtggaccgaggcgagcgcggcggagcggttggagtagaggacgtggttccccggggcgagcgcgatggcgtcagtgaagtgccgcgccgcctcctcgtagcggccggccgagaaggccgcattacccttcgccttcgcctcgtcggccatggcacgcggcggcgatcagatcggcggcgcgggctccggaagcttctggaagggctctggcggcggggccggaggagagggaggaggggaggaaaagtctggggttagatgggggattaaggtctcggagaagatgaagttttataaaatcggcgaccactatgattgttgcggcgtggcgtgggccgtcggatctctctcaagggttctcgaagcttccgcttagtactattaacgcttattacgctttctcctcatggaagcgaactctttagcgtgatgtaactctccgctttgtccgccgtacagtctccaatgtgggctgggctggtttctcatcagttggtccggcccgtgttaacttcgcggcttgacttgttttagttgggctgggccacgcacgccgaggcggcgggcggcggttgccgtggctgcagaagacgacgaagcggcggcggcgccacctgtccacctcacgccccacgcgtccgcgccgcaggctaccctccttgcatggcggcatggcgcggcgcctacttcggtgcttcccttcaaccacctcggtgtcccgtagagtcgtaggcgtggtattgtcgcgcgcggagaagaggggagggatatggcggcgcggtggtgcttcgcgttgctcttggcgctgtcggcggccgcggcgggggccggagccaagcggacgtgggagccggtgattcggatgccgggggaggtggtggaggaggaggtggccaccgtgccgcgcggcagcgagggcaccgaggaggaggagaaggacggcgtcgggacgaggtgggcggtgctcgtcgcgggctcctccggctacggtaactacaggcaccaggtaagcgcacgggtccagtactccagtgtcgtcggcttcgccgtcgcttagttcgtgcgcgtctggagctcgatttggggggcttggatgatgatgcagcgtggaactgctgtgaggctgtgtagctatgggcagccgtttctgaaagtcgttcagatcattcgtaacgagatctttagtattcatgaatttaaagatttatatgttcaatttgtcgtgccatgagtacttcaatgctccaaaattttcggtttttagcttttgaaaacgaaaaggtttgccttcagtactgaaattaaccgagcaattttccgtcaaaaaaaaagaaattaactgagcaataagttaacgatttgggcttgatgagaagtgaactactgaaagcagccccaggatcttttttttgggaatgcgcaaggagcacatcattgtattaagaagaaataaagtttatgtataaggcgggaacaaaagcaaaacaagatggggatgggatacaggagaggatcaagagtactaaagcctaatctccaaaatcatttggcgacccctccctatccgcatggattactacgctaggaatggctgccctagccagccttcaaagatcagcttcgcctgtcatggcccgagcgatgtccacccaagatctgctggtttgattgaaaactctattgtttctctccttccaaattgtccatgctaccaaggttgcgatggtgtcaaacccctgacgatgcgccttgatctatgtacgtttgatcatgtgagtgtgtgcggactgcagagtgctagtagttcaatctcagcatgatttgcacacatcgctatccaagttgtacttagtctttttgtcaggaagttcaacagactgatgcctagactcatttcaaggaagaaaatggcgtgagcagcaatataattctggataagcaaacgaatttgaagttttcaattttttctgggttctaagttctagtaatatccatgtttaagacagattgagaaaaaaaatggcacaacatatgatgagtttaaaatggagggatcaatttaatacgaaagaaatatcagctgaaatatttagtggctaatacttcagtgattaatttttactgaaatatatgtagcagaaagagacaggctcatagcaagtttgtatttatattgtttcgtttcaaatttagaaggaattgagaccaacaaatggtttatttctccaaggactgtttgcttgaggtttgatgtttttttttttttgggtgtgtttgcactttgcaggctgatgtatgccatgcataccagatattacggaagggagggctaaaggaggagaacattgtcgtgtttatgtatgacgacattgccaataatatacttaacccgagaccaggggttattgtcaatcatccacagggtgaagatgtttatgcaggagttccgaaggtattacacgatgccgtactgcctcactgttattcgttcctcgggctggagagaggactgttagggtcttatgtccaattatttacccttttgcacttctttattagcttcaggtggcttcagatttgcgtgtacatggcacaagtgcataacatatatattgacctttttctctaagtttgatgaagataacacactctataattccaggattacactggagacgaagtcactgcaaaaaacttttacgcggttctcttgggcaataaaactgcagttactgggggtagtaggaaggtcatagatagcaaaccaaatgaccacatatttatcttctactctgatcatgggggtcctggagttcttggtatgtgatagttgcatatgctgctttgctctttgagttaaattttgtccatcatgcatgttgacatgtccaattctcaggtatgcccaatctgccatatctttatgctgctgacttcatgaaggtgttacaagaaaaacatgcctccaatacttacgctaaaatggtaagatttttcttggttacttatttgtggaagagcctccttggatggaataagcaatatatttgtgcaggttatatatgtagaagcgtgtgaaagtggcagtattttcgaaggtttgatgccagaggaccttaatatttatgtcacaacagcgtctaatgcagaagagagtagttgggggacgtactgcccaggaatggaaccatcgcctccttccgagtacatcacctgcttaggtgacctatacagcgtttcttggatggaagacaggtagcttcacatatctttagaaatgtaaagaattacatattgcacacaatgccgtttgtggttttttcgtacattcttgtagaactttcggtggcaaatgttttaataatcaaatctgaagataatactataaatggtaaaaactatttaatttattgcatcatgcagatgttatgtggtcatctatagaaggattatttttttttcttttatgttgagagactgacctgtacgcactccttcctcgtgcacgggacacaaggtccaaattcttttccaaagcatgttcatcattgtacatcatttttaaatgataattggagtattaagtgtgtatttatatgcatgggaccagcttaaatgtatgggacaggatattaagtgtgtatttctatgcattgaacatgtgcatatcttgtgttaagtgtgtatttatgtgcattggaaatttccatacatatcagctttaatgttccttatttctatgcagtttgcaaagtatttactctataatatgtaaaatttatctcgatgttaattggcagtgagactcacaatctgaaggaggaatcaattaagaagcagtacgaagtggtaagtcttgatttgctctgtacctttccaattttcattgttaaactcccaggtagtcacagcattgttgacaggttaagaagcgtacctctgacatgaacagctacggtgctggctctcatgttatggagtacggggacaggacattcaaggatgacaagctttacctataccaaggtttcgaccctgcaaatgccgaagttaagaacaagctatcatgggaaggcccaaaggctgcagtcaaccaaagagatgcagatcttcttttcctctggagaagggtatttcctagtctattcttttgcagacttttagtttgttgtttgttatgttccttccaaaaatacttaccagtactagctattatctaatcccctttctatacaaccatatggttggagtgcacttgcatttgttttgatgtcacaaattattccagcctacagagatttttctaaactgaagttcattatgacgtgttgaaattacttggtagtgtacatcagctaaatatctttgtttctagtaaactgtgctgctgtctgctgctcgcaagtttcttttcattggagtattatcttagagagatttttttttataaaagtatctcctgttgccatttggagaacaattgcactagactattagcgaaccaaacttaaatgcagaatctgtgaatgggcaagcatttgtttcagtcatgtgcttccatcctatggttgctaattttatttctttgtttggtttcagtatgagctgttacatgacaagtccgaagagaagctgaaagctctgagggagatcagtgacactgttatgcataggaagcttcttgacagcagtgttgatcttgtcggaaaacttctctttggatttggaaatgggccttctgtgcttcaagctgttagaccttctggtcagccactcgttgatgattgggattgtttgaagagaatggtaaagttggaaacttctttatactcggcttactgagaactgacatctgctattactccactgcgctccaatagttccatattgtcctgaaatctcctagtttccattgtttctgtttgtctgactttaatatgagtttcttcaggtacggatctttgagtcgcattgcggaccgctcactcagtacggtatgaagcacatgagggcgtttgctaatatttgcaacaacggtatctctggcgcttcaatgaaggaagcaagcatcgctacttgcagcagtcacaactcgggtagatggagctcgctggtgcaggggtacagtgcttgatctgccgcaacacgtgatatagcctcaaaacttatgccttgtactcgtacttcctcaaaacaataccttcaggactgcaaataaccgtccaaggatgtaccgctgtatgctactgtacctctatgtgtgcaatatagatgccctgtatatacgagtatatgaatgaatcgtgtgcttttacatgcccgggaattgatcgtgtatttgatagctgagaatgctgagatcgagatagcaaggtagaacttgtgtttcgaactgaatgaagttcgcctgagcacaactttgctgcggcgtcgcaactcgttaatatcaaatgaatagaagaggggtgaggttttaaacctaagttatctaacacatcaccttgtgaaggtagcaagaagacctctgagcgtttttatataggcctgctaatggactaggttagaatgggttaaatggactggtttctagttccggttttcatataggcctgctaatggactgggttagaatgggttaaatagactggtttctagttccgattgcctttggttggatgaaaatagattgctgcctcaaatggattggatatttggattggcgtgggttggatttggtttggtgtttttgggttgaaaatggatttaacccatgtagggcaaatggattcttttaagggttaattaaatccagaccattataaatttacaagtttgaaaaaatatcattattatttaagaaattggaagtatgccattacaacttaacatgccttcgagatgtatcgttatttaccctttcgctgaaatttctagattttttttatcaaattactctcgtcttcttcctctatcctcttcttccttcccctttctctctccctatcacctcatcacctcgtcgttgggcgcaagcacgagaaacatgtaccactcgaagacaagctgaaccatttcagggtggtgagagagtgagtttgaggaggatgatggcgatgaagtccttcacctggctatgggcgtcgaaatggtgctttccgaagcccaatctaagggctggcagcggcacaatggctggattggggccatggcgtcccagatcgggagcactagaggcacacaagggacagagggggtgctaacttcttcagacagtgcgtctttaggtcaacctcgggcgcacttgtgggcagcaagg

SEQ ID NO: 420 - DNA, 4617 bp, Oryza sativa; identical to SEQ ID NO: 355

SEQ ID NO: 421 - DNA, 10644 bp, Oryza sativa
gtgacgtaggcatcctcggtgtcttaacctccctggagacattgtttggatacccattttcttctaagctattttctagacaatttgtctcttgcggtgacacctagttagtataagttggccatgctagatggggtggtgagggggagaagattccatcttttctctcactgttttccccttcaacacaaaggcgtggatggttatgggattgtgggggggggggtgtcgtggcctgctcctcaacagtgatgacttgttgtagacgcgtgacgtggcttggcttatttttttcccttacgtagtctctcgggagtatgatcttgtaattttttttgttatatcaatacaaagttttgcactgttttatgtggattgttttaaataaattgttaatatctctaaagaatgttgctaagtacgataagatttgacttatctttaaacaatgaatatactacctccgtcccataatataacaactttgtatgggatgagataatgtccagatacattgtcctagaatgggactcatcgtatcttaaattgctatattctaagacagagggagtacataacggagggtctagatttgtcgtacattttgggacggattggaggtagtagcaaaatcagccttgggtcctgtttagattccaacttttttcttcaaattttcaacttttccatcacatcgaactttactacacacaaacttcgaacttttccgttacattgttctaattttttcaaacttctaattttaacgtgaaactaaacacagccttatctgccgtttgtagctcggtgacacgtgacgacgtgagatccagccaacagggcggcgggccggaggcaaacattagagacgtggagccctcaacccccaagtcccatcccaatcacatggaccacggcccgccacgtaagcagcacaactgccctgattggtgggcccccactacctctacctccacagcccacaccgatcgatcgaggtcccctgcccgcacacttcgcgtcagctgctgcccgcccgcagcatcagcatggacctcgccgccgccgccgtggccgtctccttcccacgccctgctcccccgccgcgccgctgcgccccacgccgccaccgccgcgccctcgctccgcgcgcggcctcctcctccccctccccctccacggcggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggcaatccttttaacatcatgcatgtttgagattcagtatgcctaattgaaatgatgtgatgggatgatgctgtcaggtatcactatgacggcacggcgaggcccttctttgagggatggtacttcaaggtgtccattcccgagtgcaggcagagcttctgcttcatgtactctgtcgagaacccgttgttccgagatgggatgagtgatctggatcgggtcatacatggttcgcgcttcactggcgtcggggcgcagattcttggcgccgatgataagtacatatgccagttcaccgagaaatccaataacttttggggaagtaagctactttttctagatccagtctttttcacattcaccctcaaagacatttcatctaggatatttttatttccattcaatggtgaaaggaatacatattcgcgctaacaatcagctctctgttctgcgcaaaatcctaacgagctgactgtaagatatttaataaagcaagaatagaagaaggttattaacaactagtacaaaacaataccaaccaaacgcctgaaatcatagccgctctttcatggttaactgaactcaacgaacttgttgcatttcccttccatccttcttgtctggtgcagattgatgaaaagaagcttgtcacagagctttattctgaaccatcacctgaatttgcaacggaagaggttgcttagtacgatgcaagtatgcaacatgtcctctttcacgcacctttagaatttctaatcagcctttttgagatgagacctaatcaactattttgtaaaagcaagctttcttcatattagagattgatttgaggaaataaatttgtgaaaaaaatatgtttataacaacagggaattatattgtgaaaaatatgttgataacaacaggggcttatattagaaagaccttgtggtctagttctcgaaaaagatatagatgtgtacctgtgtagctcatcacaaacctgttctgaccaataagttggttccagtcttgataatagtgttgtgctgccgaatctagttaatgtgcttaacaagtggttattagttagggatacctaacaattactactttacagccttctgtcattatcaaagttaactaagatgtcaatttgacaacaattcctattggtttatattcgcaaaacctaataagatcagaactaatttgaaatcatgttgttcttttgacggacatacttgtactttcatactcatcctacatcttcccaaacagttcaagtgcatatattcttaggagtcttatttgttttggatgtagtgtgcattccatgcatctataaaggtaaaaagtagtaaacaaaactgcagatcaaaagtcagaacaatgcaaactaagatgcagtgcagatattgattacttcatgcttctgttatttgtagttggtattgtttttcctgttcatatggaactttagtagtgcatcacagtatgttgatttccaaattaataagctgcatttcgataggtaggcatgaactaatgctcggaaacactttcattcccaataatggttcaacacccccagaaggggaggttccccctcaggtagattctttatggattcttatgaattgcaaaaactcatataatgatctgcaactattctcgacttaacattttttcctattaacatattttaaatgccattccctgagctactccacatctatttgatatccagtgaattcattaaaaaatcttagttttcttgtttaatttgtggttataactgactacctttcatatctagcatggttggttctttatgcattagaattatatatgattatttcaccaactacctaatgtgcatgatttttcttttcaataacaagattaaatttcacctagcaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattaggaattttctagtcgagttttggaaggcttccaagtgacaccgatttggcatcaaggctttatacgtgatgatggaaggcatgtgcatcttgatgtttatctaagatctattcttgtaactattattatgtttctatgttttattgaaaagtcattacagtttacttactgagcttttttttttgccaatttagtgcgaaatgcttctttccatagctgaactataaagaatagttggatctgcatgttgagaatttatttatttttagctcatcaacacaatgctaaatgaaataacctgagaattgtattctggtcaatcaaaatataatattgtagaatcatgtacaaaatttgaaatatctgcttagtacgaaactatttggagaggaaggtttgcttgtttgtacaaaaggataatagatattagtatccttcgaataccatgatggcaggattttctgccaatctgaattttgaaatcaggcagatggatttcctaatctgtaaaatggaattatgcatttatgcaattgaaaatatgacaagacaaaatgatgagtaaattttagaaaactaaaactatttgtcaaaactattaatttgctacaactttagctaggcatttcagagaactgcaactacattttatgattttatcatagaactacaactttatttgcttgacaagtttggaccaacatgctatacacatataccatactcatgctcctgcaagttgggcccacatgtcataaacacatagggggataaagttgtagctttctgataaaatcgtttgctattgttgcaattttgtgaaatatgttgctaaagttgcagcaaagtgatagttttaaccatataattgctgttttgtgaaatttaccgtaaaatgataaaatgaacatagctctttcgctgtcacttttgaagttcatgaaagacaacacacttgatacgcttattgccttgtcagagagggatatagaagtttctatcctttaggtgctccaaatttcttgaactatatattgtgcccaaacacatttctaatagcaaattcaactgtagagaggaaaggtgatgcgacaccatctttgctcatacattgcacttaacttaatataaattttttttaggaaaaaacagtagttcgtgtgtaaccacgattgcaggtaattaagaaaattgctctggatggtttgattgtatcgaatgttacatattataagaaaaaaaaagaccttgacaatgcttttagatttatttagtaatgttatgcaatgtgtttattactactatgatgatgcttatattacatgcaaatcctagagaacaactcctagcagtttatgtcaggactggatacaataccgtaattaatgtttcccttcaaaatgtaaatggggattgagtagaaaagagagtttacactttattgctattaaatgaacaattaaaatttaaattacctgttgctcccctgtcaggtcaaagtatgtgccaaatgtccaaacagctaggtgggagtacagcactcgaccagtatatggctggggtgatgtcacgtcaaagcagaaatcaactgctggttggcttgctgcttttcctttctttgaacctcattggcaaatatgcatggctggtggcttatccacaggtttgtatttctttgtatttgataaactgaacagagagatatttaatttttctttttacctactggttttcattctaggtagatggcacatgtgccactgagtaatttactgaatgatacattcatctctcatgtgtaaaactatcatgtacgatggagttgtatttcttagcctaaaatgtgaaaattggttttccattgatgaagctttatttcaaattttttctttaatatttctgtaggaatccaaattgcactaaaaaataccaggaaatgtggctagtcctatctatatgtccaatccttttattccattcagtatgatttctccagttcagtcctgtagtagcgcacgattgattgaggtgatatgatatagtgttaggaaggttataataatattaagttaatagttcaatactaacttctgcaacttaactactcaggatggattgaatgggacggagagcggtttgaatttgaaaatgctccttcttattcagaaaagaactggggtgcaggttttccgaggaagtggtattgggtgcgtttttctatcttctttctgaccattaatcctgatgtaatggatacactggaatactgaataagttttgcttcatttacagatagaaaatatgctgtttcttgctgtaattctgtgttttgtgttgccagtaatgttcacccgtagtagcttttgggctgtttagatcccttgcctcacctggatttaagagtttaggcctccagtaacaacaaaaatgcttgctttgcctggcaatctcacctcattgagcaaggatattgttagttccttgctcacagggcaatgtttggcttgcatctcatcctgcatctctttatcaaaggaagctgggtgaaggttctgaacaaacccaatatgcatgaaggtttcaagaatggcatgcaatatgatggttgtagtggtcatgataaaaaataccttctttaaacatagtgtggtcggttgaaagtagtcaattttactggtacatttagtcatagttatagaggttatgcacttttaaatattcatgatatagctagtttacaaatacttgtcgcttcacgtttcgtaatgcacattttccaattttatccatattaattatctagttagttgtggagggtaatatggtcatttaacatgaaaacaaatgattacacaaatttatgtgccatggttaaaagtgacaagtaaacgtgaatggagagagtatgttttagtttgactcaaaacttcacatgaatgaccaaactaactgattgaacacctttgctcatacaggtccagtgcaatgtcttctcaggcgcatctggtgaagttgcattaacggctgctggcggattaaggaaaattggattgggcgaaacctatgaaagtccttcactggtagagtcctgatactttcagcttttaatctgatgcatacttctaatttgttctgcaacttagctcatcatgcaagcttgattgctggatgtctgccagactgccagtaaggcaaaagggaatattattgatcaaccagttggcctaaaaattttgactgacaaaatcttatccatttccgaagtatgggtttattttcatttcaggactggtcattgatacaacattttatggatttagtggataaatgtattgctggtgatggttatgccacaaattagaatcccctttaccgcagtggttttaagtttagatcttttttgtgtatgtatcatgaaagttacactaattgtatgtatctaggcgacttttcatcccacagaacatttacatctagacctctgacagtcgaaacaaccaacgtacagaaaagccaccagggtgagtaaaaagcattggcagcataagcttgtgtgcagcctgagacagggttggaataatctcttgttccaaaaagaagtgcagcatgctttgtttcctttaaatgtcctgtggtgtttctgtgatgttattatggattcttcctcttttatagaaggtccaacgtcattcttatccactttcttgctttgcttttgtactcacatccacatcaacaaaaccatgtatttattgagaccaggtaatagatatattttctttagccagtaatttcaatacgatgcttgtttgctttgtgccctgcatattaactttcataagaggaagcatacaatgatcagacagaagatttacgaatttaactatgcacatacataacagttctgtttgttccctgcagattggaattcattatgagggaaaattctatgaatttgtgccttggaccgggacagtgagctgggacattgccccttggggtcactggaagttgtccggcgagaacaaaaatcatctggtaattatcatccagcgtgctgaaaatgtaatgcagtgcctgtgctagttggctactgttcacattcgagcaagattcccacttagctttcttacttgtattatagattctcttaggttgtaaggttacttatgtggttctatgttccttgattagcattcaatgttctaaaagcagattatctaggtgctaggcagcctgctggcctagtatccaattaagtgccaggagctgatctatcaccggactagtgcctagcacctggtgaatgcgacccttaacatgcattgctacttttctacaggttgaaatagaagcaaccacaaaagaaccaggcactgctttgcgagctccaaccatggaggctggactagtgccagcatgcaaagacacctgctatggtgatctgaggctgcaaatgtgggaaaagagaaatgatggtggcaagggaaaggtatgcatgcatgataataaggccatcagaatttttcagatagctgatgtattattgcactattactcttgttgcaaaatctaaggtgccagttgggttagctgcctcgaaaattgaactttattatgcaattcacaaggagggccagatgtagcatataatatgcaaatcagtatgcggcccaaaagtccactactaccttcgttccaaaaagagtttatacatgaatttggacaagcacttgtctagataggtgtagagaaaacgaactcttttgggacggaagtagtaatactatttttttctagattagcttggggctgtttggatgggactaaaatttttagtctctgtcatatcggatgtttggacactaattagaagtattaaacgtagactaatgacaaaacccatttcataaccctggactaattcgtgagacgaatctattagccctaattaatccatgattagcctatgtgatgctacagtaaacatgtgctaattatggattaattaggcttaaaaaaattgtctcacgaattagctctcatttatgtaattagttttgtaagtagtctatgtttaatactctaaattagtgtccaaacatccgatgtgacagggactcaagtttagtccctggatccaaacaacctaatgccactattttgccttaggaaatattgaaagttaaggacacaatgaactctgatggattgatggcctctatagttatctgcccccggagcaactgaaaatttattaattcatatatgataatatatgcatgatactatctgtcctgtcaggctctccatattcaaatactagaaaatattttaataacactctttagcctttacctaagcacattgtgggatcaatttctgattctgcacatacatggtcactgttcagtatagacacttttattgaacagaatatagtgaccgacttcattgatagtcatcaaggcatgtaaccatgatccaaatcaagaaaactcttcttatttactctaaaaaactgtaacaagattatatggtgcattaccaacaaggctacaatgtataaaaattcctagttgttttcagatgatactcgacgcaacaagcaacatggcggcactagaagttggtggaggcccttggttcaatggttggaaaggcacgactgtttcaaacgagattgtgaacaacgttgttggtacccaggtcgatgtggagagcctcttccctatcccatttctcaagccccctggtctgtagcattgttcaggtcgagccatcgataggtagagatgaataggccctccaatcttgtcacaccttgagtcttgatctgttcctcacttagcatcatgttttcagccagagaactacagaaacagtaaaccaatcagcatggagtttattctcgttgggttagagaaaggcgcctttcgggtgaaatcatgttgcacaaatttttacagatcaggaatggatgctgtaattcaagaaaataagtataattcatcttaggcagttccatccttttgtgctcatctgaacttctgaagtatcataaagaagtgatagctggatgcccgggcctgcatctgcaattgtggaggtctttctggtcagaattggctggaaacaattgttgttagcacacttcatatggtaaatctttcagaggtactgacagacaaagacgtgtgttttcaattatcattgtactaacaaggataccagtgggcctaacagcacatgacggaagttctagcctgttggcataacattggattatagtattacaaagctgattttaaattttaaaatttgtatctagtatttatttaggggtttcttcgtcacttttttgtaaaattattcttcaaaaaacaaatttagctttgaaatataatccaaagttgtcaaagcggctgcacacatatacaaaaaagctcaatacaaagacaataagcaataacttggcacattaatggacaaacaaatctgatgaccgaattttggtaacatgtaaattctttaaagaaaatttgttatcaccaaccaaaaacaactcatacattccaaacaaatctcaaaccataatacaccaaattccaaaagaatatccttttttcactacaaacgtcaaaaccttactcctcaagtcgtcaaggtccaacctccaaggactaccactcaccaactcctcccaaccaaaccaccacaatcctctgaatctcactcacttcaaacccatccagaatcccagattcacaattctgcaggagccaccacagcattccgaaaatccatttttttgacaaattcgttccttttctttttcaaacagtgagctttgggatgaaaacaaagtcatattatctgcagcatcgcatcggcatcatatttttctttttctttttttgttgttgggattgatttatgacatcacatctggcgttgatgtcgtgcctgctggtgctgctcctctccctcgacaagttcctcctccactacctcaagaagcgctggctctccccgaggatc

SEQ ID NO: 422 - DNA, 4178 bp, Oryza sativa
cggattctgtaattagtttttttattagtgcccgaacacccatgtgacaccttatataatatctgatgtgacacgccaaaactttacagcaccccctgaatctaaacacccccttacattattactagtacatgatcatatttctgactctgtacttttgctttaagtggtttgcaggaggaaaagtactacagagtgtcagaagaagatatgagacagaagcttcttatccagtaagaactctggcacagatgtctgtggagccaaaacagtaaaaccaatgctgcactgtacatacctgttcctctcattaattaatcagtcgacaggggcaacgaacttccatcaatctgaatcacttttacagaacacatctgtagcagcaaaggacagttgattagtgaaatatgacgagccgccaattattgcaggcagactgttcagatacttcaatgttgatacggtgtacgaagtactcttgccatgaaatgggactgcaagcctgtaaatagatcaaaggtcatagtcaggaacacctcatatccgtagaaatacagaatccaggctggatcatgtccattacaaattacatactagaattttcggacttacataaaggagtgacatgcatacagagagcataattcctcaaatgtgcgaagagagcaaaaaaagaaacagaccacacctcaaacttattacagtttatacgttacacaaatacttcaatggcaaacaagatgcgtgaaacaacatgtagctgccaaacagaaaaggtaacaaatatgttgggatagccacaaaaaggtgaacttgcagactatacgaagcacaagaattcagttatttgatcaatgaaagattataggcacaaagagtagagtgttactctttgctcctacttcatcttcctgatgtctgctacttctgaataaaatatattatcatgttctgcacccagtaaggagttacttctaactgtatcatgaagaaatataaacgtgtcagaaaatattaaaaaatataaatgattcaccagctaagagcgtcgagcaacactcagcagtgagcacacaccatcatcataaccaggctgtgtacatggagctaccttagacaagcttaaatgccaaccaactccaagcagtcccagatcaaaaagctcatgacaacggaaaacttgaaaaagaaaaaaaaaactttacaagtcttaaccaaaaaaactctaaatttacacacacacacacacacacactaaaggcaacacattcttacacatttcaaactccagttctatagcgcaaaacaagacttgagtgttgaaatatgaagaaagtttcccaataagacgagagaaaactgaacacgtcatcacaaataaagcacgagatattcccaaacgcagtttgcagcataagtcttgccatatgagacgcctagttaagaacaacgtccatgcatccactggcactcaaagctcatgactggaccatatccacaccccaccatagctgtggaagaattatggccatggagttgatctgacacaaatgcacaattgctttgcagaacaactagcctagcttatactaatgctctaggagctaatgtgctaatgtgaatcaacccggggttgccccacaattaatgtggctaccatgggcgtaggtgagagtgttaattaccaatgtcctagcagagaaggtggttatgctaatacccgcacagttcaccgacagcccccactgcgggccttgtggactggaccaccttcaccttcagttgcccctcccctgaattctctcttcacctctactacctctgtcccgaaataactttatttttcacctatcccgtacataccaatacaaagacaaaaataccataatgtcctctattttaacaaatcacaatgcaattttaccccactttaacaaactccaatgcatttgtctcccacttccatagattcaatataatgatttacttaaaagataaaagttattttgagacaaataagatggtaaaaaatgaagttattttgggatagagggaagtatctccagtcctgccttacttttatcccttggcacacacctgctagttgctactgcttgtgaacccagcccttggtgatgttcagtgaaaactaggccaaacacaatctctttgattctctctttctatctctgtatctctgatacgtactatttgaccacctatacgtctcaccacatttaacgcggcactgtagacgcaagtacaggccgcagcagtttatattcactcaaacaagtgctttcctcctcccccacacctcctccgttcagttcagaggcgcctagcaatagcagctcattgcctcatctctgcctcccctgtccttctgggggcagagaatctctccactgctggaaaaatggtacagccaaagaagaagtttcgtggagtcaggcagcggcactggggctcctgggtctctgagatcagacaccccctcctgtaagctcttctatcaacatccctctaattttctgctaataatgttatgttttgatgtgtctaatactctaatctaataagtaataagtctcaatgcatatggtgtttgcaactaatgcagtaaaaggagggtgtggctgggcacctttgagacggccgaggaggctgcgcgagcctacgatgaggctgctgtgctgatgagtggccgcaacgccaagaccaacttccccgtgcagaggaactccaccggtgatctcgccacggccgcagaccaggacgcccgtagcaatggcggtagcaggaactcctccgcgggcaacctgtcacagattctcagtgctaagctccgcaagtgctgcaaggcgccatctccgtccttaacctgcctccgcctcgaccccgagaagtcccacattggcgtgtggcaaaagcgcgcaggggcccgtgctgactccaactgggtgatgacggtggagctcaacaaagaggtagaaccaactgaacctgcagctcagcccacatcaacagcaacagcttcgcaagtgacaatggatgatgaggaaaagattgcgctgcaaatgatcgaggagttgctgagcaggagcagtccagcttcaccctcacatggagagggagagggtagctttgtcatctgaaaggcttggatgaaacgacggcataacgaagtcaccactctagaccatggttccagaatttcctgctggtacacaggcagttcagattacttcagtacaatagaaaatatctattacttcagacaagtaacaagacatataagtttgcaactatgtgtagctatatgtgtttatgaaaagctatatatacgcagtctccatcaacatactttgttacacatcaatgtcagttatatagtttctcataaaggaaataaatagattgttattctgtgttagtgtccatcttttgttcagatgccaatgttggactctgtcaacaaatctcaagaatatgatgaaggtgatatttgtgaaaaagacccgctttaaacgacataatgattcaaaaggaccatggacttttttatataacaaaatatatatgagaagaaaacaccaattgcttttgtgtatttatgccagctatatatgcatttattgtgagaaaatacaattataaagcaaataagacaaaataaaagcagctaaagtgatataaatgaacacacagtccttccattgtctcaactagcatgtcactttttatcaaccagtaaatgagtaattctagcctttctaggctctatgaacttagataaatgaatgaaattcagtgaggacaattagatgcaaattagtttgctaaaagtaagtcatctatattcgatgcttgggtctctggtgataccattccatatgcatatcaagggcaacacattctgaatgacaatgtaccattctgcattaccataacagaaatgaggaaagatttcttttccgatacttctttatgccaatcttgtgtccatgtgttgatatataataacatgaccaacatcatgtaaccatcaaatgctaaactaagggtgtgaactatggactaaatgcatggaccatcaacagattatttgagtacaggtgtacagcaaacacctcaaaggcctttaagttgtatttcccctcattcaataaggaaat

SEQ ID NO: 423 - DNA, 4875 bp, Oryza sativa
aagcaagacaaaaaatatcagtgatgagttaagtcaaccctccacgaaatcaacagaaattaaaaacttgtagacgtacatgttcgatgtagacacatctcacagatacacacgcatatactactatattttttgccatgttattcaattggaccatgaggtcaatgctagattgtgtagatcagaaggcaattgcaatgaacattcttctcgattttttttagacgtacgtctttcttctcgaatttttttttgacgtctttcttctctaatttttaaccgaatgaaatatttgtccttaataagatgagagtagtttggtagctgtgcactgtgcaagggtactgtgacagccgtacgtccaatatccaactataaatatgtacagctgtatatacgtatggatacatgtcatccttcaaaacggtacttgtgtggcacgtgtatgtcaagaaagagctgtagtgtactgtgcaaatcatttaaaatcttgaagcatgcctgatcatgcataaacatttgaatcgaaattcacatgcacagtttcgaactcttggctggatccccgtagatgtccgttaaaacgcggtggatgtaagtgagttacattgctcaaattaatggacacaaaacatgtacatagtatatgcatgctatgcccaatatataccaactccaaccgggaaatagtatcttaattcagcatacagtaagctgaactgtatggattcaactattcatagtacggcaggccctacacaatttaattacgttgacactggccggtcttatacctaatacctccctgaccaacagatgcgaaaagaatctaaattaagcacgctgatttcattaataaaacgtctctaccattaagaattgacgactagctagctagtatatatgtgtgtatatatattaatagtactgctggaattatggagtattatatatatataaacgaagatcactagacgccgcaccgagacagatttacatattccatcacaaaaagtcgtatcttgcgcctatccttttccagcgaaggaaaagaaagaaaaaacaaatcaaaagggaggtgagaccggttgaaagctgaaaccctcctcacttccacgcctctctttcctttccacacataagctagctccccatactctcacaccccatgtcttctggaggaggaggaggaggaggaggagatcgccatggcccctaccaccagcacgggcacctcggccgcggcgaaggcgctgattacgtgtacagcagcagcgacatggagagcttcttcttcagccaacccgggggcgtcggcatcggcgggggtggtggtggcgtcgtcggcgccggcggtgccgacgagatcatgccgtactccagcatcacggactacctgcaggggttattggacccctccgggctagctcggcacctcgacgtggcgtgcccgtcgtctcaggacacggtggtcaagcaggagctgtcggtggatgtgacgagccacgacagccagggcaccggcggcgtcgccggagaaggcgtcgcgcaggccacgccgaactcgtcggcgtccttctcgtccagcgacggagaggcggagggcggcaaatcgtcacgccggtgcaagaagggtcaggcgaaggcggaggaggaggacgacaaggatgaggaggatggagagaactccaagaaaccgtatgttaaatttccattgattctactctatactttgtctgattcttgtcttgatttcttgcttgattaattcttttttgatgcgtgtcttgagatggggatactttcttggggctagatctggttggtcatactgttgcggagttgcaaaatttgacctgaaattttctttcgtttatgctttctctctactgcatgcatggtgtgaacattagggtttgctagaattttggttccttagggttctttttagtagatccgtctatcctcttgttccccttttcttctgattccgttttgacccaatttccaatatgatctttcagacgatggggctactactattcgatttaatttaatagacaaccaacctatgctccataatagatcttgcgtagaatgaatcaattttacgagttatagcttcaatttttgacttgctaggtctttgaagattatattatgatttccccttttagaaatgattcaaattaagatatattttcgtatcaccaccaaccacctaaatctacaatagttcctcagtacttttgcaaaattaacgctgatcttgccccataacatgcaatccaacagatatctagctagctagctaacttattagaccctaattaatactatatatcaaaataacaactatttctagcaaaacctggtgctaatctaacatgaaatagctagctattcccatagtccaccatgatcctacctatctagcaagctagttagctagtttgattgttggtgctctgaaaaagcccaaactaattaataattaggcctgattgagcttgtcaccgcagaaatatcaactgatcttctgaatccatatcatctctctgtttctagctaatccacctgaccttatttttgatattttgtaccatgcatctacacaggaacaagcccaagaagaaagctgagaagaggcagcggcagcctcgcgtggcgttcctcaccaagagcgaggttgatcacctcgaggacggctaccggtggcgcaagtacggccagaaggcagtcaagaacagcccatacccgaggtacacatctatatacatgtacaaaccttaatttcacccagttgttgtagcacatacatatatcgtagtataccatgttactgtgccatacaattgcatggcacgatggtgttcaagtactccaatttcaaaatgcaattcaattcgaattcgaatattgcaggagctactaccggtgcacgacgcccaagtgcggtgtgaagaagcgggtggagcggtcgtaccaggacccctccacggtgatcaccacgtacgaagggcagcacacgcaccacagcccggcgagcctccgcggcggcggcggcggcgtcggcatcgtcggagggcaccaccaccaccacctcttcatgcccggcgtgcatggcctgccgccgtcgcacctcatgccggcggggttccaccctgagctgatgggcctcatgcaccaccacccggccatggccgccgccgccgcaaaccctagcatgtacttcccgggcgtagctgcttctgctccgccgcctcctgctgtggctggcggcggtgcaatgccgcccaacgatcatcctcctcttcagcagcatcacttcactgactacgccctgctgcaagaccttttcccttccacaatgcccagcagcaacccatgatgatgactgatctaactgattctgcacaaatatatactactcaatatttaactagcacccggaatttatcaagatgcttttcaaacattggagtcgttgcgccaaaaatgtgatggctagggagtgcttgatgatcagcttggtcttggtgagaatatataattgttattaattaattgattttctgcaagcttttcatcttgaacgtaacttgtgtgtgttgtgcacttcatgcttttttctctcttccatttgtcaacatttccctggttgcaaattgaacggatcagtagagatggaagctacaactttataactagaacggctgcattccacttgattcttcagcatagccctttactgttctgcacctctagacttattgtacatgcatgtactagtgtatatcatgtgtacctcattgactcattttcggagagagcaaattaattaatatttcgtctcacattttcgcttttgacaatcaaagaagatgccaacttattatacatgatcgacccgcttttggttgttagattgtacaaattaatgacgggtgtgtagtttcttttgtgcctacatatatgtataaatctggaattaatacacaatgacggtgcaaaagagagagttctgattgctttggacattgatacactgaactggccggtttcttgtggtagtgtccataagatagccttatcatgatgcatggtttgcttgttttgtttggtagcagatggccgtaatattgggattttgacacaagaataagtaaatgataattaatactgttgttctcatattcgattagctagctagtacctgcagcaggccggttttgcgttagatctatgtctatcgctagctatttgttattcagttcaacataacacatttattatttcttcttttttcacattcttgtatggtatctaatcaaaacatgtgttgaatctgatgttttatctggccttatatgttctatgaatgatcatgatcgatatattaattccccaagatgtacccccttcgtttttctaagatatggtgccgttgaatttttttaacgtatgcttgatcatttatcttattaaaaaatatataactattatttattttactttgacttgatttatcgttaaaaattctttacgtatgtatgacttaatttttttatatttacacaaaaattttgattaaaacgattaatgattaaatgttagttaaaaaaatgaacgacatcatatattataaaactgagataatatatgtgtacgtacggtggtctgatggatatggttgtgaccgcaagtttttagatgtacacgataaatccgcatatatactagtattaattaatattgcaagtgccggagtaccagtaagttttcagttacaggacggagggcaagcataaatacttcttcaagattagtctttactagcgtgcatacgttttctctttatgagtgaatccactt

SEQ ID NO: 424 - DNA, 6035 bp, Oryza sativa
gcccatacttttacaaaccccttcatgattagcgattttaatccacaagtctgaataaattccagcatgtctgatgtagctcatagaagcatttcagcttgtcttaatttttttctgtcctcatttttttaatcaaatgactatttcattgtacagtcgtaaagccatttcaaccacagtaatctgctggtaatttttttaatgtcatataaatttcataggtagtgatattactgctgatttcccaccattcaactttcttaaattaatgcctaatatatcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaatactcggatgttatatatcttagcaatgtaaatcttgacatgagacatatatccataataagtagcagtacatattgtgggatagggcgagtagtttttttaaaaaaaaaaacgaaacggtttaaaaactaatccatagttagcaagtggttaagtgagcaaccgtttccatcaaagacggggcaaaagtgagcggggaagacgacacctccgcagctcggcgcacaaagcctgcaggaaacccatcacctgtaaccaatccttccatcttctctgccttctccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctggtcagtttcagaacagattctttgttcggtctctatccattgcaagaacaggttttgttttttcttttccctttttttgggatcagagtctctccatttctgatgctgctgctgctgctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattcttcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgttgttctattccctatttactgcaaatctgtaatcactgctcgcctgctcggcgcagtttgttttactgttccagcaaatctgacgagcaaaatcaaattatcagtgttttttatgcattggtctgatgatatttatacttttcagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcctttttcattagcatgtttactggattgctaaactatatattttctgtaaaaaagattatatagtatttttaaaatttataatacatactttaattatgcgctaatgatcccccttgttttccaaggcgtctacagctacagccgaactcagcctcagccttaataagatcagaacttctgcgttgacatcttaggctgactggttttacaatcaacaaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagta

SEQ ID NO: 425 - DNA, 5626 bp, Oryza sativa
aagacaaaagcacgtttatccaccgttttattgtaagcaccaaatcctgagctacttcatctcatttaaaccatccatggagaaattcctaaagcattatattgtttttaggtgaagaatactattgaagagagcatctacaaattaaacaggggcagagctgtttgctccacgatacaccgtaaatcaaaaaatttcaaagatgagcttgttttgacactgaaggatattgagtctttatttcctgtggcaacacttgatcagccttcagaacaggagaataagaattacggtggggccggtgggcatatgagaagtttacctccatctgttgcagctggcttagctgctgaaaggaggttattggagcaacatgacaaccagcattaagttatcagctgacttattctttcaactggaactcggagaggcaatgaaagaggttgaaataattgatgctgtagatattttagttaattggatttatcgattgccttcttagttctaaattatgttaaaattacagaaggtagggatatactatggtctggagcttctcggatcattatattagaatctggcatcagtgatagaatgtttaggacacccccgagcatcgggtatgtacttaaggagatgttgtgaaatttagttagttagcctgacagaagcatgtgtatcattgtataaaacccgccgtcttattttccttttgatttttgataggtaataaatatccttaacatgtgtacatgtttatgaacattgctttagtaaatgaaagatcagttcagatcatttttggtcaagctattgttcttactggaagacagttgtcacatactcacatgccgagaagtgccatttcttttgtcatttgtggtccactatatgtttgtcttcatacatagatttatggacacatatactgtttctgttaccgatggggggtatttactttcattatttaggaagtggttggggtcctaattattcttctatgcctgtggtaagcctgtgtttcccatgtcggcttgcgtcgagtgctattcggctatgcaagttgacaggcagctgggcaatattttctcttctcctgcttcattgtttcccccgtttttttttaagttcagagcttctccttgaatatgtacttacagtagtcttacaagcatctaaaaaccgattctttttggaacgaaaaagtacgtgggagaaagtgtttcccacacatataataagaaatgaaactacaggcaggggcttttgccctagaataaactaatgtgggggtggtctccatgggtgtttccgttatccttgtttccagtcatcctacctagatggaaatgttttcgtaagaaaattgctttgagcagttgttgttttggcagatagcagatgctctccacttggacaatttgctgctgtgtgcacgtacagtgcacaaaatggatggagaaacattattttcagggagcaggggagagagtttatagttgctatgatcgatatattgcttatccctcaacgtcctgtaccggatgtgtgatgacttgtatgcatgaccagtgaaggagcaaaggtaacacgtgtatatcttctacttgtccttcagttagcttgcactgcatgctaagtgaaaacttctaatattcaagtgccaacatgccacttagaaaatgtatgagtgacaactatacatcaactaataacagctgtagtgctagcatcatcactaggcaagtagtagtgaaaaattgtctgccatcagatctacaagaagataggcatctaacgcatgcaatggcttgaaattaaacaactgctgcacttgcaatataactatgcattccatataccatatataaatgaaaagaaccaagcatgaatttctccaccacagttgggagctagctaggaccattccacattttcccagtgattaaacaatcatcttaattatatacgatttccagtactgccattttttttctcaggggttcactagcaccagccgggccgtgcatggagcatgaaccgaccgtccatgagctcacggcctcgtcacggcgatgacgtacaggcgacacacatccagctgggcccctccttccatgttccaagccatttcctttggtgagttgttcttcctcttccccccctcccgatcgccctcgtcgtctacttttcctctcaacttcccaccgagcacaccaataaaaactgcagctgctgcccaataacctatctactctagcagtctagctacggctgatgagcaggtgtcaatacaagagtagcaaagctgagaatatctagttcctactttgctagctttcctagtaatactagactgctagcagcagcaattagctatagtagcggctcctcccatggcgtctcctgatggtggcgttggagacggcggcgcggagccacatgaagttatggacgacctgctcgagatgcgcgagcaagcggcgatgctccacagcatgctacatgggacatcgccgtcgagctgtgcggcggcggcgagcaccaggcagctgaatcagctgatagacggggtgatgagcaggctgcagtccagctcgctgtcggtgatgtcgcctggaggaggaggaggaagaagaggatcgggcgggaggaagaagaaaggcgccaaggccgtggccgggccgcacaggcggagcagctccggtagaagaaggtgaagaaagttaaaacccttttttctcaataatcatctgcaactggatgcgcaactagctagctatgcttaccacatgcggtagtaatactattacccatatatatgatagcgattcacacatcatgctagctacctcctttatgcaacttggagagtacgttgggagtatattgccttgtctagcagtggggtttaatcttaactttacgtgccaatgatcaggggggaatttttactaccagtagctttcttctctcacaaaagatcatttcctgtttcttatattgaaaagaccaaaagctatgagcaactagctatatatatgacactcttgtatacgtacataccgtggtctgccgagcatgctagtggagatttgggtgtgtgtctctggatatgatagttgctcctatctgctgtaacatgtggcagatcgaaaagtccttttgtcaggatggtcacgaccaaggagctggaggacggcaggcaatggcgaaagtacgggcagaaacatatacaggactccccaaataatccaaggtatgtacgtatagattattcaactaattctgcagtaacatgaccagattcttcgcccttgtgcatggtagttagctagtacgtaatgatgattaacccagcaagaaattaaaggcccttgtaccggccgatcgaacacttgccaatgcaactggacaactcgcttagctactccagttaattggagaatagtgttccgatcttccggttccggccggatcatggttagcttcacatagttagatatatactactccaatacacatgtgcttaattcaattgaactgtattagttagttgttgcaattactaaaaagagtaggaaaatactgctcaacttgaactgtgtatttattattagatagcaacatagcatagttagcaccaaatcgttgctgtaacatgttatctattcaggagcatcatacgatgcaattttgcagcttgcattccttaattaaagatctagttgttgatctctctgcaggagctactacaggtgcacgcataggccagaccaaggttgtatggccacaaagcaagtacagacctccgagtctaactcgtcggagttcgtcatcagctactacggtgagcacacctgcagcgacccttccaccatcccgttcgtcgtcgaggccgaagctcccgctgcagactacgcgaacctcatcagcttcggatccagcggcggcgcgagcacaagcagagtcgaccctcttcgtcagagccgccatcgtttgatggcagaagccgttgatccgacgccgtcctgcagcttcgccaactgccactctccggtactgtcctcggagtgcgccagcgaggcggcggcgctcagcagcagcctgccgctctccgccgtggtgggatcggcggtgacaacgccgtcgacgtcgatcgtgggttcagcgcctgcggattacgactggccgtcagggctcgccggaggtgacatggccggcagcttcccgtcctctcccagcagcctcgggttcatgactggctcctttgggaatcttcctggggatgacgacgacatgtttggcttcgatccttaacaagggctgtgcatgcatacattcttgccatgctaattattgctactactaatattcaagaaaaacaagtccgctatttgcatgcagaagtgtatgcatgcatgcataatactattgctgtgaggctatagcaaattagcaatacttgtagtacatgtgtgtactgctattggaggaaatccaatatatatacggtacgtagtaaatatgtgtattagttgatcgctgtactagtgagttgtgtgtatgtgattttgtaagtattgaaacataatttgaaattaatatatagtagtgaaagtaatatatactccgtgttaccttttgcgctacctatatataggtcatttaatgctccaaaaataactagatgaaagatctaatctaatttaatttagtttgtccaattggatttggaacataacaatcaatatataaaatgcaagaaagaatctagctagctagcggggaaattttacgcataaaccaactttaaattgaagtgtgtgtgctcaacgtacgctccctctgtacttataaaagaagtcgtttagaacaatgtttaagtcaaaccttgggaatataaatcataaataactctcaatttgttgagtttgaaaatgtaaaaattatatgaatagatttgtcttgaaaaatactttcataaaagtatacgtatatcaccttttcaataaatacttttatagaaacaagaagtcaaagttatgttttagagaccatatcgctgtccaaaacgactttctttacaagtatggagggagtatttgacaacaaatttatgtctagataaaaactccaataaactcatgctgttactttttttttgttcagagtggtcattttatagggagcaagatgtcccttgcatgcatatgttcctcaccccccaaaatataatgttattcaaacagattataaaagttgtggaaaagaatttacagctaaatttatcttttttttatttcgtgggtttgaattttcttagtgataaattaatgtgcatatgtgacaccatagatgtatggtgaaaagtttcatggtatatatatgtgtgtgagtaaattgcgtttagggccaccttttattaccaaagtttcactttggaccaccctttaacacattttttcactttgggctaggttactttacctttctttcactttggaccaccccataaactttttaggaatacataaatgaattttccaactttaaacacatcagcaacctgtaaaccggtaatctttttcaacttacacgggcaattctttacaatattatagag

SEQ ID NO: 426 - DNA, 4291 bp, Oryza sativa
actttagtcctcctccacacttaatttacattatcgagttgattgtggtatctatgcagcatatatcaaattttcacctgaaaaatatataaaacaataatttaggctcctatcgaatagcctattcagccaaagaaaaagccaaaatttgaattttcaaacttaattttgatatttattttgaggtattttcaacgtagtttctttttcagcattggcttttaagtcaccgagaatatatatataaaagttttacctacaaatttatttttattctctaataagccgttttggcttattaaaagaaaagccaaacgatggggccattacattatcgagttgattgtggtatctatgcagcatatatcaaatttttacctgaaaaatatataaaacaatgacaaataatttacggacaaccaatgtcattttgtgcataggttcaagctcacaaacatatgtgctaatacaaaactatcttccacataatttaatccatggttactttgtagctgacattttaattacaaaccatctccgaaacatccagaaataaagtagaacagacaaaagtatttccaccaacatatatatatatatatacacatttgatttgcacttgatagtgcagttgcaagaggtgtgtggttttaacatcgagatcgcatgttcaatccccaatacacttacattttctttttaaaacatatttagaggtacaaatctcccttcaaatctagttttttttttatttgatgttgttccaaaccaaagtgtccaagctgacgcttttgggtacaaccctccactaatctaaaatttgtttaatggatcattgcatcaccccaacactgtccactagctaagctaatgtagcttagcccgatcgatccgacatggcgttggccaatcaaatccaaagaaccccctctcgccgtcgccatctagttctctcaccggtcaaaatcctcttctcccccactcaccaccaacgcgcttcttcttcacctctccaatccccttcttcttcttcttcttcttcttcttcttcttctacctctcgatcccctcctcccctcctctttataagctcgagctcccctcgcagctgcgcctcactccacatgcactctcgccatctcgatctttttacccaattcttgatcactcttcttggtcgttcttgccattcttgtaccgcgaagcgagcttagctgcaacctgcaagatcgagctagctagctagcaatttatctaggttggtgagagcaggaagagatcgatcaagggttgaggggtgatggagagcatggagggcaatggaggagggcggctggtggtgacggagctgagccacatcaaggagctcgtgaggcagctggagggacacctgggtggctccggctcccccgacctctgcaagcacctggcctcgcagatcttctccgtcaccgagcgctccatcggcatgatcaggtccggccacttcgacggccaccgcaagcgctccgccgccgctgtcgccgccggtgacctcgactcggcgactcccagccccctcagcgacgtctccgacttgcctttcaaggccaccaagaagaggtgaatatatacaaagattaattgttcatgttcatttttagctgaatttttgggggaatgattgattgagtttaattttttgtttgtttcgaatttttttgattgatttttgcaggaagacgtcgacggagaagaagaggcatcagattagggtgagctcgacgggaggggtggagaatccaccggtagatgatggccatagctggagaaagtatgggcagaaagagattcttggagccaagcacccaaggttggtatttttctgatttccctctactttttccccccaatatttcagtacaaaaaaggtgtttgtttccacctttttcatagcctaatctgcacatgcgtttttcataagctttgtgctgtggcatcatcaaagatatatctgctttgctttcctgcttggtttggttgtttgtggctgtcttttctttatcatggtgaaagcagctgcagcctttcctctgttctcaaatgcttggactccacctgtcagaaattcagataggatcataggaccacctgtttgtttgcatgcatctaattggatgtgttgtcaaataatcctgccaattagtttgattgttttcgaaatcacacaaacttttctgaagaattttaagaatctttgatcgattgcaaggtttctaaaaacattttttttcaggggttactaccgttgcacccaccgccactcgcagggatgcatggcgacgaagcaggtgcagcgcaccgacgaggacgcgacggtgttcgacgtgatctaccacggcgagcacacgtgcgtccacaaggcggtggccgccggcgccggcaagccggagacggagacggacacgaacgccgccgccgagagccgcctccacgacctgagctccggcctgacggtgaagatcgaggggctgacggcgccgccgcagcaacagcagggcggcggcggctggaacgccatgccgccgttctgcctgtcgtcgccggtgagcggcctggcgccgccggatcagcacaacccgttctccgcgccgtcgacgccggagaaccgcctcgccgccgccgcgtcgtcggcggcctcgccggcgacctccgactcgatggccgccgcgccgttccaccaggcggcggccggcggcggcgatgaggcgtggcgggacgccgagctccaggaggtggtgtccgcgctcgtcgccgcgacgacgacgacggcgaccgcgcagccggcgcccgccaccgccatggtcgacgccgacctctccgccctcgacgccttcgagttcgaccccggattcaccattgatatcaccagcttcttcgcatgagattatgaacagaaccagatcaatggtgaccaaactcaacccaatccaatccaatccaatccaacccgatccgatcctcacatagctgatgaacactagagaagcagttcatggtgaccaccctctgttctttagctgttgccatgaaagaacagaggagggaagaagagcagaagctttcttcctaggtcaatagagatgagaaatagtagtactagtacttaatttttctctcttttttttccccaaatgagagtgtttctttgtattattattagtattattattattgatttgtgtcaaggaaaataagatcttgatcatgttctgagcatccaaagaatataattttgtcagcagttttatactcttgaagtacaatatcatgattctcatcaggacaaatgaaccaaaatagttgtacaaactcttgattttctcatcaggaaaaatggactagatcttgaaaaaaaatattcttattgtagccacccagattacttcaccaacacaagcatgagcacatgaaaattccaaacgtgtttcctgaaacccaatagccgtgtaatcctcagacacgaccagggggagaattggaccaagtaaaaaatgcatatcattgtcattgtagtagaaacaataaatacaaaagttggcacatttcgttgtcttatctgagaaagttccataaatctaaggaaacatatcttttcaaagagataaatcgacgaaaacattgagattgaactcacataaatatagtccatatggtccaaacactgctactagtaagagtgccaggtcaaagatgaaatgagaaccacagagcttggggccagtcctcatcacaggcaggagacagtttcattccttcaaggaacatccgtggaacgcaagggttcacatttgggagattcctgagcctctcatctctatcatcatcagtccttcagtttgccgatgcagaaatcttcgatgatctcgaagactctaaagccatgttgcggtctgaaaagcgcgtaagagttattttatttacctgagtcataaaaaaatgacgcgtacaacacttgtgaaagtgaaaaggggaatcagtaaaagcaaaaatcagaatttgcggtcttgagaatgatatgagaagaaagatccccttcagtgtcgcagttgagaaagtaacactaccctttggagcatccatcatctagattttctttttggttcttgaaatggtcaatgttaaatgtattaaaatcagtaacatccacatgtccctaaaatcacggatatggatttatgggtgtatgtcgctgagcataaatagtttcaatgatgacaaaaatacatgaccagtactcaaacacaggaaa

SEQ ID NO: 427 - DNA, 4074 bp, Oryza sativa
cgcctgttggcaattgagctctgtagacagatccgtttcctcccataccaatgcaatgagttccattgaaattctctgtggcttcaaaactctgcttgcacacatctcctccatcaaagttccagactgaaaacacttttgtgtttccagctccattttcactttgctccacagatttcatctttctgcgttgccatgtcacaagtgctgtgatgaacagaacagatatgccagcagcagcagcaacaccaagtaaaatgggtctgaatttctttcctttgccacctttctgaataaggttgcaaggtggtaaagctttgactgtaccacacaagtgtttattatgcacgaaccactcaactggagcttcttccaagaacttaatgtgtggcactggcccttccaaattattgtaagacacatccatggatgagaggctgatcatacccttaaatgatggtggtatgctgccatttaatgtgttgtgtgaaagattgagggcttcaagcatgttcaaaccactcagctgacttggtatgatcccggcaaatgaattgtcacttaaatccaacaattcttgaaggtatgtcagcatccctagtttaataggtatgcttcctccgaggtgattatgtcccagccttagtgattgaagtttcaaacagttctcaattgatccctgtattggtccgcttaggttgttcaatgataaatccaaatactcgagattctgtagagaacctagttcctctggtatgtttccatggagcaagttgttcgcgaggctcaaattgaatagagacaccatactaccaatttctggtggaatgtgcccttcaattttatttgatgaaatatcaaaactccctaaccaagacaatttccccaagcttgacggtaggactccggttatgcgattgtttgatacatgtagatgttaaagggtatatgtgtcttttcatctcttgtatacattatatgtggtccttgaccctaagtcaatagtacatagtaaattccccaaatttatctatcactgtaagatggtatcagagctcatgggctgaaccctagccctcgatccccgttgtccgccggcgctccggcttgccggcggcggctccctatcgggcaaatcttcttcacgtcctcctcgtccggatcagcagcgggattcacagcaagtcagtgtgattcgtccgtcaagcgtgagtgcatcgctcattgcagccgctcgtcacgcggttgctccgctcagccgttgttgctgctcttccactactgctgccgctgtgtgctgctggtgctaattcaggagacaatacatcaagtcctgtaagcaagtctctgtccagtcaatttgtcaaattttcttctgctggtcttgatggcaacatccgacccctttcttggaggtggagctctgctctccacggacattaagctaaatggtcaaaattatcaagaatgagaactttcagctcgtatgcttttgaggtcgattggtcaagcatctcacctcacagatgatcctcctgatgagaaaacggatgcaactaaaattaaggcgtggaaaacagcagatgatcgtgttatgggattcatattcatgagtgtagaggtgcctattcggatgagtttcagggatcacactaccgctaaagagatgtgggactacctcaaacagaggtacactcaagaaagcggagctttgcgtttttccttgctgcagaatttgcacaacttacaacaacaagatcagtccattgaagaattttataatgcctttactcggttgtctggacagcttgaggcacagactccaaaaggtgcttcaggttgtgcacaatgcaaggcgagagagaagcatgatcaagaaaatctagtgtatcaatttgtcatgagactttcctctcaatttgagtccattcgagttcagttgcttggacgtcctacacgtcctactatggcggaggctcttgcagatctaatcgctgaggagacacgtctttgttccttggacactactcctactcctgtggttactcacaatgtcatggcagcacctcagcgtgttggagctcctatgggcgggatccctgaattcagttccatcgccaaaagtgatcgtatttgctctcattgcaagaaggttggacatatttccgatgattgcttctatcttcatccagagaagttggctgattatcaagctaggcgtgcagcggtcccccgtcctcgtgcgacggctagtgctcctgttttcttggatatcactgctgctggtccttctagtactagtgctggtggcagtgcctctagcgccgtctcatgtgctcctcagtcattggttgcaagaccgtcttatcaagccagtgattggtcatggccatcaccatagttggtccccaaggcctctaagtgtgaggtcatcttcgcctaccacttttgttgccatctcctacttgttgcttttgcttgctgtttggagaaaaaggttgttgctgctatagtatatatctgtccttcagttcagttcaagtcttctgttatccattaaatctatctaagtcaatttcatatcttcaattcgtctaagtgtatgagtcttttatatcatcaccaacaacaacaacagctcccaccggagctggattgtctcaacctactccaaatctttgaagagccgaagaacaatttgtgaaggcttcatggtaccaagggctgaagaacaatttgtgaaagcctcgaggtccacttcattgaggaggggatgcatctttcctacttaatcatcaagacttacatgcttcgacaatatctttaagcttatattttggttttagtttagttgtaccttccaaatgcattgttgtatacacattgcatttgagtgggggtgttaaagggtatatgtgtcttttcatctctacaggagctggttcttatttgctttgacatactcccatcaagcttgccctctctgtcatccttgaagaggttcactctgatgtttagcaacaatattgactcgatatgttaaagggtatatgtgtcttttcatctcttgtatacattatatgtggtccttgaccctaagtcaatagtacatagtaaattccccaaatttatctatcactgtaagagtagataggtaagtttggtgcactcaccccaccgaggagataattgtccaaacagtttatttgagctcatgtcaatatagacaaggtttggatgaaggcccaactcggagatatctccttcaagttgatttcgctcaagacgaactctaactagggttttgcagtttagtaagcttgttggcaatggtccaacaaggctgttgtgatcagcagtgaaattttgtagccgacttgctgcgcatagtcctgatggtaactcaccagagagattattaagactgatttccaaaaactctagattcactaagttgccaagttcttgaggaataaatccaaaaagttggttagatacaagatttatggaatagagtttattcaaattccctaagctgttcgggatggaacctgtgagattgttatcagcaagtgataagttatttaggttcaccaggttacctagttctttaggaatgtgtctagaaagtttattgctccaaagcaacaagttggagagtttagtcaaattccctaagctgtttggaatggaaccaatgagcatgtttttggaaagatttaaattctctaaattcacaagcttacctagttcttgagaaatatgcccagaaagttgattgtgccaaagaaacaagtgggagagtttagacagattccctaagctactcgggatcaaacctatgaggttgtttaaataaagcgataagttctttaagttcaccaggtaacctagttcttgaggaatgtgtccagaaagttggttttcaaaaaagtgacaactcaatgagtttagtcaaattccctaagctggttggaatggaacctgtgagcatgtttttggaaagttctaaattctctaaattcacaagcttacctagttcttgagaaatatgcctagaaaattggttttcaa

SEQ ID NO: 428 - DNA, 7471 bp, Oryza sativa
agagaaaaaaaatagggagaaatctccgggaaagaaggaagagctttgccggtgtgtttatccattatccacttccttatcctaaaacacggtaaaaaaaaacagtattcctacacgctaatacacgtcagattaggtgagacgtagtacaaggtttgtttgaacggcaggagttcaaaccaaccaactcaattgatattgaaaagttaaagaagttgagaaacaaagtaattctgatgcaatacgattaattaaattatttacgagagaccagtgatcttattacgcgtttatgccaaaataaggtcatacaaatgttcattgctgatacgataaacccacaaacctatcgtacgtgcttcaactcaaaacaacactacgtatcactacgataaaaccatactcacttagtactagtactgtttataaaaagtactactggtactactagggcccctttgaatcacatgaataaaaaaacagagaaataggaaaaacataagattctgatagaatgtaagtggaaaacagaggattgtaaaacacaggaaaaacaggaaaaataccggaatttgagaagagataaagactcaaatgatttttttcatgaggttctacctcttgttaaaattcctccaaaacttatattgaaagagtcatttcatagaaatttcataggattccatagggttcattcctttgattcaaagagttttatagaaaaaattcctatagaaataaaatcgtctaaaatttatatgaatttccgttgaatcaaatagcttaaattataacccccgaattgctccgtttcatccggataaacacgagaaatcacccactaaaaaatacagtcaaattagtcaagaatccgaacgactgaaaaattacgaaaataccctccaccttccccaccgtaggagtagtactactacagtacacttcttctcccccttcctctccttataaaaccccgcctcctcccacctcctctcctctcctctcctcctcctcttcgcgtcgaatcctcctccgagaagaggagagtacatgaatcctagcgcgaggatctcgcaggtagcaatggcggcgatactgccggacctggcgacgcaggtgctggtcccggcggcggccgtggtcggcatcgcgttcgcggtggtgcagtgggtgctggtgtccaaggtgaagatgaccgcggagcggcgcggcggggaggggtcccccggcgcggccgccgggaaggacggcggcgccgccagcgagtacctcatcgaggaggaggaggggctcaacgagcacaacgtcgtcgagaagtgctccgagatccagcacgccatctccgaaggtgagggagggggactgactcacccccgtgtgctgttcgtgtttttttttttggccttttttgggtggatctgagcacgcgcgtagttgtgtagatctcgtgccgtcgcagcggttactggcgctaatttttgctaatttagttgtttttttttggttgcttgtggcgtgaacatgttcaaaagtagcttatccgagcatcaattatggggaatttgcagcacaagattgatataattgtggggaatttgcagcacaggatttatatttttatattgctgtgaagagattataaagctcaggttaagatggcgctgcttttaatcaagcggagttgcgtgtctagcagtagtgcttgtgagcttgtgttactttatttattgtgtgaaatcatgagattcctctgagttctatcgaatttactgtggctaaagtagtattctattgtgtggaatcatgagattcctctctgagtttgattgaatttactgtgtgcctaaactataacgagagctgctacacatacgatttttcacgtacgatacttgtacgactaacgatttccagcgaaagcccgtaacgtttgtctcctgttttctagtgatgcacgcacggcgttcaccatcagttagaaatcatactagaatcgtacgcagaaatcgtatgcatagtattttcgaaactacaactatgctagtatgctagatgtgaactgttacattgttagttggatctacagaaacattaaacaatcatgttcccactttacacagcacatgttataataattcttagtcagtgcgtgctaatcgcgggtcaattaagttcgtttgttgcgtctgctgagatattttattggggagatatttttagtggggtagatcagaacttgaattgctcagttcttagaggccctcacgtaaagccctgcggtggccatgctgtggggataggagaatttactgatggaggaggacaagttattggaccagtggtcctacttattgctcttaggaggataagaagataacgatttttctgcgcacctgcattattgaagcagggagaaaatagtttcattttgactgtatccacctagcttggaaggaatcctagatgcggcgcacatggacgggacgatcttgtggtccattcattaatcataaaccttacatgtaaggttataattcaaggacagttgcaggctgagaggtggtgatttatgtagtttgtcctatgttaggcgcctgctttcttggcaggtttcatctctagcgatgcttgggtgagttttaatattgtgaaagtgttaggttctgtccttttctagtaaagttcaaacgtatttttggaaatatttgtttggtcaacatttctttcttagaagactatagggcttgcagttagtgtgccttacttgtggagtcctgctatgcatatgatctgtttcacaggaaatgctagatatgctaatagtttgcatggtttgtaatttgtgaatctggttttgtggaaactttctaggattggaactttgtttaatcaaatacatttttgttggtttcaattggttggatatttgagatattgggttactgaccagtgaccaaagtcccatctatttcactatttaatttagcctttgttaccatattttggtgctcatgtttatggagtccagtcaaacactacaattagaaaaacaggttcagttctaattataaacatatttatgcgttgctagctttggtgttttatgtttcagctattattattgttatcgctaaccttttcttgtcattgactaattgttgtatatttgtatgcgtctatgatctaaatactgttttttttaaactgtaaacaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtaagaattctttcctgacgctttaaaaacttgtttcttaatattacttgaaataatttgttttgttcttttcataatgatttgtgttattgagcaaagcattaaaacatcgataggaatttatgtgcatgcaagaatgatcatttcttcctccttttgcaggtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggtatgcccatatttaaattggaattccatcttttacttagaacttcattgttaaaatcattgacctcatttccctgattttgataggcaacttttcttgtgtgtggcggttggtctttgggctggactaatcatcggatttgtgacagagtattacacaagcaacgcctacaggtgcttataagtctgatcatattcaatgttgtctgtaatcttatatatttgcttctagtccctcatgtccctcacaccttgaatttcccttgtccagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaaggtaaaactgcttatcttgtcgaaagtgtttttatgttgtttttatgcttcatttccactctgaagtcaattaaaaatttaaaattgtgtttgcacttgtaaatatttttccttttgttacaaatgtcacaattttaaagttaattcccatctccatgattgtacttgtagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcaggttcgcacattctttttcacagccacactctcatcacttactcttgccatattgcattcataaccatgttgcttcctttcagattgccatctctgcatcaaacactggtggtgcctgggacaacgcaaagaagtacattgaggtaagaacttatcagccatcttccatcacagcaacacttgacgtcaagcagtttttttcccctcccatattcgccaaacattataactctcgttctccctggttttaggctggtgcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagctaaaatgacgtagtagtgcgtgtgcttgcttttgttttaagatagagaattatagtattattttgtatactatattttcctcctttcttgcttcgttcgtttcatattataagactttctagcagactcacattcatatatatggtaatgaatctaaatatatatgtgtgcctagatccattaataactatatgaatgtgggcaatgctagaaagttttataatatgaaacggaggtaataatatgaaatggaggcagtatcttatattttctttatcctaaataaataaatctaaatttctggatatgatagatagtgtcacattttttttgataggtttgttagaaatttattttgaaacgaggaattacatctacactctatcattcatattgccaacagggtttacgattccgatagaccctttcgttttggccactggcggaatttgaaatttcgcgaaattcggtgaaaaaccaataaattccgaacaaatttcataaaccaaaatttgaatacaaattctctaaatttgccgacaaattctcaaaaactggtcggttttggcgaaattccgatcgaaatcatcgaaatttcggatggagttcttgtcaaatactgctgcttttcggtttaattttttattcttttctttcctgatgtaagtttcagtaaatacacataatacattatttttttcgaaaatttatatcccaataggttctatgaatatcataatatttataagattttatttgatttattctttttttatcaattcaaatttgaatttaaatgaaacttctcaaaatctcatacggtttttactttcgagcctcgtcaaaacatcaaaatttcgcgaaatcttaccggatttcgtcggaatcgaagaccctggttgccaatcatcagcactaccatcaataaaaataagaataaatagtagtactccatagtccatactggagtagtgattttctgccggcgactcggatattaatcgcagcaact

SEQ ID NO: 429 - DNA, 3113 bp, Oryza sativa
ggggcagcgcaacacaaaaaggggggaggatgccggcgaccacgctagtgaccatgaagcaagatgatgtgaaagggaggaccggacgagggttggacctctgctgccgacatgaagagcgtgatgtgtagaaggagatgttagaccagatgccgacgcaactagccctggcaaggtcacccgactgatatcgctgcttgcccttgtcctcatgtacacaatcagcttgcttatctctcccatactggtcgtttgtttcccgtggccgaaatagaagaagacagaggtaggttttgttagagaattttagtggtattgtagcctatttgtaattttgttgtactttattgtattaatcaataaaggtgtttcattctattttgactcaatgttgaatccattgatctcttggtgttgcactcagtatgttagaatattacattccgttgaaacaatcttggttaagggttggaacatttttatctgttcgtgaaacatccgtaatattttcgttgaaacaatttttatcgacagcaccgtccaacaatttacaccaatttggacgtgtgatacatagcagtccccaagtgaaactgaccaccagttgaaaggtatacaaagtgaacttattcatctaaaagaccgcagagatgggccgtgggccgtggcctgcgaaacgcagcgttcaggcccatgagcatttattttttaaaaaaatatttcacaacaaaaaagagaacggataaaatccatcgaaaaaaaaaactttcctacgcatcctctcctatctccatccacggcgagcactcatccaaaccgtccatccacgcgcacagtacacacacatagttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctccgagagttttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcggtacaaacattttgcccccaattctttacccccccagtaaaaccttgcgtacaaattcgttgaaaaattttaatgtctttgtgacagtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaaagtacgctgtgtatgtacgtcgtatgtgtacaattccgctttgttgaaatacgtataaatatatactgtgtgtacattatacggtgtatatctcatcgtgcatatgtacacaacgttttggtgatcgttataatgttcatttttttccttattctgatcaatctggatcataggctcgagaaattgctatagatcaacggccggaaattgcagaacaagaaagtgatcctattgagtattagaaatgattgatcgttactaccttataagaagggccccggacttttgttctcgaataagtaaaaaaaaaacgaaatgattgcgcgtcatcccgatagaagggcaaatactccgtaattgtcctcgccgtaaccttaaaaaaaggcactcactgtggaatgaatgtacaaaattagtttattatagcatccaaagtttcgagtcttccccggtcggctatctttcctaaaaaatcataacttgcatatgcatttaaaacaaaatcaatctgttcaaattgaagacatgaattcaggtaagcatgtttaaccataaaaggatattgcatcgcgcgttgagcacaggtacgatcggtctatccctttctatatttgatgagtaattttacccttttctaaggaggtaccactttttcctttttttatacctctcgatatatatttaataaggaggtaccattttttctattataaatttgatatctcttaatatattaatatatatttgatgttctattataaatttgatatctctcgatatatatttaataaggaggtaccattttttctattataaatttgatacctcttaatatattaatatatatttgatgagtaattttaccgttacgaggaggtaccaaattttttattactagaaaaaatatccattgtaacgggtgaagcctattttatcttattattgttatttggtttagaaaaaaatatccattgtaactggtgaagtatattttatcttattattgttatatggtttattattattatatggtttagttaagatgcgatttactgtagcagttcgcttgggatatatttttagaaaatcatgagctacagttaagagtccgatcatctcaaattagcatacga

SEQ ID NO: 430 - DNA, 6373 bp, Oryza sativa
catcaatcttgtaaaagtcattttaaggagcatttgtgacatataaatagccacattcagaggcttaaatctcccctaaatcctaggagaatcctaggcatcatgtatacatacactgtaaaagaggacatattgagatcaataaaattgatcggattcattgttcacctattgttatctaataaaaacatcatatatccgatacgacaggagtacctggtagaaaatttgcttgatgtcatgatcgttatgctcgtggattatgactttgatgaaatgttgccgcatctagctcttgatcaaagcagtggatcgatggactcatggactggctcatgagtcatgacacccatggcgaagttaaaaaaacatatacatgagataaatgtattttgtttacgtcagcaaaaaaaataatataaaacatgtatttacggaagagccaaacgagtaaaagaaaagaaaaacgaacgcaaacgaagatcaacagtcccatcgtttcacacatacttaggtttatccatacaaattattagcaacttaaaaatgtaaattcctaagtaaggtttttatatacgtgtctttagtgactcagaagcaaatattatgaaacaaactacgattaaaaaacataaattaaatataaactacttgtttgcaaaatcaatgtcctactactcccttcgtcaaaaaaaaatcagtactagatgtgacatattcatatttgttgtactaggatgtgtcacatccggtactaggttggttattcgtaggacagagggagtatatcttactggattttgtcactctaaaattaagttataaaaattaaaatttgattttacaaacataaaaataaccgaaatgacggggccaaagaaagagacaatgggaaaagtataagacacatgcagcgtctcgctcgactgaacctgaacctgaaactgaaactgaaaacctgtactcccaagtctgaaagttgcaggcagaagatccgtcccgtactcccgtcgtccatcattcagaaaccacagcgagagagacagagacagagccaaaagaaaaaaaaaccaaccttttccgtcgccaccccgccctccgtccgtgacaactccacctccacttctctcctctctcgtcttttgctgctctgcccaacccacccgcaccaccgcacccgcaccggatcgaacggcggtgatgcaggccggaggaggaggggacgccggggacacgcgggggcggcaccggatccaggcggagctcaagaagctcgagcaagaggcgcgctttctcgaggtccgtctccctctctctctcctcttcctcccttgtttcttggtcgactagcattaccggtcttcttcccaaatttggttccagaattcttgcagtattaaaggttagatttcatctaggagtatatagcaaaaaagggggaaaaaggaaagaaaaatagtttctttaggactttctgttatggggattatttggtgtgaaattaatggaggagagcatttcaattctcctctgcaaaggtgccgcatattccgcctcgaaattaacgaaaatgcatgctatgcttttttgcctaacatttcgctcggctcgatcatgttcaatgattccaatcccatgttcccatatgaccgagcacgaagcgctcgccatgtttgtccaaggtttctttttgttgccttctgtccgaacttgcttgatccccatggcggcccatatgggtgaggaaatgtggggggagaggagcagagaagtcaagcgcatgtgcatggtcgccgtgcagagcctgcttgtcctaaacaaaaaaatatttatttccgtacctttttgtgggccttttcttttctagtatttcctgcctgactatttgtagtttgtagagttctttttttttttaaggatctataccagagcccagagaaacaaaagtgctcttctgtgtcatctaatgattggggactgacagtgtactcaagagtgaagactgcttcagggatactactgaatactgatgccccttcctggggacctgtttagaatgggtagccatgtgttctggtttgttttgtgagatccaatctagttttttgttggatcaaaaggcttgctgaataaatggttctcctaaactctaaaataacactaggatttatgaaatggtaaatgaaattgattgctgcgaaaccttagcatgactcgctagccaatttgttcactgctggtacaggaaagtaccgctatgaattcactaatttttgttgacatagttattttctgttacttgatagttctatctgtttttgtgttattttacagtacttatgatgtgtaaggggcattctgacatgattgcccctttgcaaaaatgacatctgcaatatatccttgctctatcaacaaataaaaaggaacttgtctgtatgttctttgagtaatcagctaaccattttagttatgtgcatcactcaaaatgcttaatttgtaagttcttagaattagacgccaaatgaatactatcatatgctctgtactcactattgaggaatcaagattgtgaagagaaaggagaacaatcattctagaagaatgtttatctgtttgttctataaaactgttttagtattttgtgttaaatctcttcattatgcacatgggtaccagtttcagaggatacaagtaagtcgtaatgcaaatgtagttcttcttttgtggtaaatgctgttgtcaacatcgtactgtagtctgtcttgaaataacaacagtgaacaaatagaatcaatttaatgaaccacacaatagaacttcattttagagtttttttttgggtggtaaatgatgttgtcaacatcgtactgtagtctgtcttgaaataacaacagtgaacaaatagaatcaatttaatgaaccacacaatagaatttcattttcgtttttgtagtaaatcctgttgcaattggtacagtatcacactgtagttctcattccttctcattggaggaagttttcttctttcttctgtcaacatcggatctgtcacatactcagatgggaaagtgacctttgaagtcatgtactgtgagtttaccatactcaactgagtaaataaagtaactagaaaataaaactaccaaggactaatgggtgtttatcacctttctttagataatggaagaatctcactcggtctctatatcaggggtatacatagccacacttattgcaaacttgtgatatacaatcacattgataaaaagaagtggtaacaagcataagaaaaagaaaattcccaatgatcataaaacctgttgtccatgtgtatcgagatccatggaccatggccatgcgctccaaagtatggctggggcacgtaatttagtgggtcttagcctactaacccacttcatagaattgatggttcactggcctcctaatttatcgtcaaatttatgcatttatatttgaagaaaatgaactaaagtgcgttcactggttaactcaactgccaatctttttatcagtaagtatggctcacactaacagacacacctgaggctcctcgcactgaaagtaaaaccaaaatcatagacatttggatcacatgaagatgacatgctgtcatgggcaggcatgtttatgggagggatttgatgaagtgcataatcatgtgaagtaattggatgtggccctggatctcgatggtgtggctgcgctgctgtggtcgggtggagtgccaaggaggctggaatggaagaaagagaatagtggaattagattattttattacttgcctttagggctggcgtgactcctcagaacaatgtgaactaacacaagtacacaacttatctataataagttgaatgcaactcaagttatccctaactaactatctaaacaattccaaatttaaaggactcctaatcagatacaacttattcttagtagagtttgctgcctccttgtgcctagcagactggaggtcccacatgatacctgcattggactacaagctttcttcacataaccaagtagaaacctttggttttcatcacctaagaactatggctaataatactattactaaaagttcacttgttaggaatccttgttgttaatcattttcattttgattgttaaatctcgatattttgtcatttatgttaaacctatatacagtttgctgttttaggctgctctgattgcattttggaatagattggattgcagtgcaaaggtggagtgtgtggccaatctatttcatctgtgtagaattctgacaaatttatttcgaacagccccaacttgtgtattagctgcacattatatgaatgcaacgcgaaagctacttgcatagcagaataaggcacacatttccaaattaaatcattttaaatttctcaatggtgctgatatggactagatttgttccttctccattcttacacaattatctgtagagctggcagggattcctttttcttcttcagatatagaattctgtacagcatgaaagaatgatccttttttcctttaaaatgtttctggtttccctttccctaatccctaccaaacctgaaatgttctcagtgtgacttcattgtatgcaggaggaacttgaagagcttgataaaacggataaggtgtcagcagcattgcaagagtacgtgctagaagaaaacttcaccaattctaatattactttcagacattttatgctctcgtcttcctgcttaaaaagcatcttttgtggtggttttactgttagttactgattgcactgttaacatttaccaggcttatggtaacagcggagagcaaagcggatcctctacttccagtgtaacgacataaacatcctatttctaaatttatccaaatatctctgcctcagaactcttatgccgcttctttctgttaccgcaggactactgggcctgcttgccagtcttgggacagatggtttgaaggtccgcaagatctgcgcagatgcaaatgctggtttttgtgattcttggcaagcaacaccgagggcagacaatgattgctgcaaactgtaaattgtttttggtcttcccagcatgaatgtcattagtcattaaaggtgaggggggaaattcttttactgtactgagtatgggcatcagaaagtggagtagaatgagaagagaactgtggaatacataagtggcagcaatgagttagcttaatctttgttcgacaagtttcttcgtattgaaattttctgtgcatttagtttgattggctgcatttctgctgttgttaaagtatgggatctctcaactgcaacatttgactaaaaaaaatattccctgtgaggctgtgaggttagttctatctgacatttctttagatgtttctacccttgttcagttagttaccatgctgaatcttgtgaacaccatttctgaagaatgatggctgattctatcttgacaagaattctgaatcctgcattgatgtgaaagaaactggctctttcatggatcgcattaactttccactagctcttctggcccattcaagagaagcccagctcacagaggcccagcccaataagcagctggttctctctcttcaactctcataggccacaagtgaagggaccttatccaaaactacacagcaatggcgcgcgcttgctcgtctccctcctcgccgtcgccgtcgccggcgagcagccgtcctctcctcccctcgtcggcctccatctccgccttcctcgcatcccacccggccctcaccctcctgcacacgcaatgcgcctccatggcgcacctccgccagctccacgccgcgctcgtcaagtccggcctcgccagggaccccatcgccgccagccgcgccgtcgccttctgtgccggcgacggacgcgacgccgcctacgccgcccgcctcgtcaggcaccacccgaggcccaacgcgttcatgtggaacaccgccatacgcgcgctggccgacggcccggggcccggcgcggccgtggcgctgttcgtcgacatgctcgggtcgccgacgccgcccgagcggcgcacgttcccgtcgctgttcgcggcgtacgcgcgcctcggccgcgccggcgacggggccgggctccacggcatggtggtcaaactcggcctcggcggggacgcgtacgtgcgcaactccgtgatcgccatgtacgcgtcgcgcggcgccgcggacgaggcgatagcgctgctcgcgcggtgcgaggcgttcgacgccgtggcgtgcaacagcgcgatcgtggcgctggcgagggccgggcgcgtcgacgaggcgcgggcggtgttcgacggcatgccggcccggaccgtcgcgacgtggagcgcca

SEQ ID NO: 431 - DNA, 7990 bp, Oryza sativa
gattaaaatacttcctatgcattcataatgctatgaggtgattacttttattattattttagttaattccataatttgtgctggttaatttaatttctagatatagtcatgattttatctctacaacggatttactttaaatgacatgctaaagttaccttcgttttgttctaagttacttctataatatatgtaacttacttttaggttttattgaatttacttttatgtatctaggaagtaacttagtgaaatctaaaagtaatttagacatatcataaaagtaatttgtgatttttcatcaaaatataattatgtgagatattgttgtaaagatttaattgttacgaacacaacggtgtaatcggatcgtagatcggatgagtagtttaaaagaaaattgtatttgaagtataggtggatgatgcctcttatagatgaagtggtagacaaaccagttaccattagctgtgtagttacgtcttttgattgctgtgcagaactgcagatgcatagtacacttcactgtccatttagtcctgagtttcgaagcttgtgaggcccaacaatgtgaaaagcccagcgagaaaatagcgtccaaagcacggcctgaccagtcataggtcaacagccgttgactgacaggtggggcccggacccgcacgttatactttctggccccaccttgagctaattacttcatccactaagcacgcccgcaccgaactttctagcacatccagagcctcatcgacgtcgatgtcccggccacgcaccaatcatatcccgccacgtgtccggcccttcaggcacgcacgggatcccagccctccgaaccccaggttccccgcatcggacggcagagaccaccccctcgctctcgctccacgtcaagctcgccgcgccgcccagtaaaatactgccacgtggaggacgcgccacccgagccgtccgatcttccacgtggcgcgatcgcccccgcgtggaccgggcgcacggggtctccgggtgtgagcgatttaaagaagagggcattcgcctccttcttcctcctcgagtcgagccgcggcgaggcgacgaactcatcacctccactctctgctgcaacacgagtgaatcggaggcggcacgatgcgcaagtgggcgctctcctccgcgctcctcctcctcctcctcctcctcaccacactccccgatccaggcatgtctctgtctgcccccgccgccggaggcgttgtctgatttttcgcgattttttgggtgtttttctgtgggagtatagtgaattttaggttggaactctgtgatccgttagctccggaggcgaccagtacagattcgatctcacttggtcaccctttgattgactctgctgtgattatttggtgccactacttcgagtaagggagtgagatgtgatgactgatgaattggtagttttttttttttttgaaatagtgctcatagttgtctgatccgtttgtgtggacgtgacttgtgctttgtgcgatctctggtggtgattctagtctgatttttgttttagatctcgcttgttgggttcgcggccacttcgatctgttgtaatggtagggtttattgcgatttcgagatttagctagttctagatccgtaatctgctattgcgcaccgtaattttgtccgcaatagggctcattatatgcggggtttaaatagggtttagtcctgagagtaataatacatctgtatcaagtcagttcagtgtaaatctagtgctgattgttgttgatctagcgcccccaacttactgatcttagtgatttttaaaggcttctcaagtctaattcacacacattgctctaccgcaagtcaacacatgattcaaattattattcggttctgacccttcctgtactgcagctaagaagctccaagtcaatgctgatgacagcactgatgagttagttgatccgccgaaggtagaggagaagattggtggtgttccccatggcctgtccacggactctgaggttgttcagaggtgtgcacgatcttctgatcaatgctgatcgtttccatcttattgtgttgttgatatctgtatgagcaatatggaatgtgtgcagggaggctgagtcaatctcgaggaagaccctcaggagctcagcggagaaatttgagttccaggctgaggtgtccagactcatggacatcatcatcaactcactctacagcaacaaggacattttcctgagggagctcatctccaatgcttctgatgtatgtagttgtattgcattttgactccctttttagggcctattcagaacacaggaaaaggaaaaacacaggataggaaaaacgtaggaatatgaaaggaaatcacgttgaaaacataggattgaaaaacgcaggaatataaaagttgagagcattcggtttacaggaaaggaaataaaaagtaatcgaggagtaatctgtatactgtatttattatctaccgctatcttgcttatcccgtctgtcttgcttattatctagtggctgttttattgcttgattggcttgattctgtcaaagggaatgaaacaagagattggagtggatggaattttcctccgtttttcctgtggaatcagcagcaaaggattttttcctacagttttcccataaccactttttatgatccgaacgataggataggaaaaaatcccatgtgaacagtattcctatgaaattcccgggaaaagcctccaatccaaatgagcccttaaggttattagtagatgctaggaatttaatgtgtgctttttttttatgtgtaggctttggacaagattaggttcctggctctcactgataaggaggttttgggcgaaggtgacactgctaagcttgaaatccaggtatattaaacttcgtagctgatagtcttttttgtgtggtatatcttgttttggaaattgacttcatggcatctgctgtgggcacgtgtagattaagctggataaggagaagaagattctctccattcgggataggggtattggtatgaccaaggaagatctcattaagaaccttgggaccattgccaaatctggaacttcaggtattactcctttgtactgatttctcttaaagttatgtgtattctcttgctaaaactttagtattatctatttgtttgtaaagagaattttaccaagtgccatttaacttaaacttgagtgataccaattccttgaaatttttgcagcttttgtggaaaagatgcagactgggggtgacctcaatctcattgggcaattcggtgttggtttctattcagtatacttggttgctgactatgttgaagtgatcagcaagcacaatgacgacaaacagtaagacaccactgaaatacagcggctacatattgtgtttttggttcatcttcttttccttcactggcatgacaacctacttcatgttctgctgttgcactttttctctgataggcatgtctgggagtccaaagctgatggatcattcgctatctctgaggatacatggaatgaacccctgggccgtggaactgaaataagactgcacctccgagatgaagccaaggagtacgtggaagaagacaagctaaaggtattaccatcattactgtcaattggcttcatgctgtgacatcaaatatgcgatatgcacatgatagtggtacttggtgtctgcattgtctctgtgctttatgcttgtcacctcggaatgtggatgtagctttgctgcaagcttcggataggaattgtcatttcgcttgtttgcatatatggcttatggttagggttgttcaacagcttttttagcatgaattgctgcctttggttgaaacctagtctgtataactagtagggacaagagaccttttcattagccctgaatgtcattgcttacaaggaagtttagcattacctttttgtaaattcattttgctgcatagtctggcaaatttctgttgaatagctgctattgagacattatacaaagaaaataacttactatcttgaacatttcatggtcttgcaggatttggtgaagaagtactctgagttcatcaatttccccatttacttgtgggcaaccaaggaggttgatgtggaagtgccagctgatgaggatgagtcaagtgaatcaagtgaagaagaggaatcatgtaagttttcagtttatgtttttatatcttttagatgatacgtaagttatttgcacataagtgctaacatattagcttttcttggcagcccctgagtctacagaggaagaagagacagaagagagtgaagagaagaagcccaagacaaagacagtaaaggaaaccactactgagtgggagcttctgaatgatgtgaaggctatatggcttcgtagccctaaggaggttactgaagaagaatacacaaagttttaccactcacttgctaaggtacacagactgcagtgatgaatttacaggagcataacattttatgtaagccttgcagaagaaagcaagtaacctcatttaatatcaaattattttgtaggactttggtgatgacaagcccttgtcttggagccacttcactgctgagggagatgttgagttcaaagctttgctctttgttcctcccaaggctccacatgatctctatgagagttactacaactctaacaagtcaaaccttaagttgtatgttagaagggttttcatctctgatgaatttgatgagcttcttccgaagtatctcagctttttgaaggtactagattactatttcatgaacgacacggtattccattcattgacttatgcagcctaaacctataagctattatctgtagggtctcgtcgactcggacacattgcctctcaatgtatcacgagaaatgctccaacaacatagcagcctgaagaccatcaagaagaaactaatccgcaaagctcttgacatgattagaaaacttgctgaggaagatcctgatgagtacagcaacaaagataagacaggtaacaagttctctgtggatcacaggtcatatactgttatttatgatgtaattctcacataatcttctgtactcagatgaagaaaaaagtgcaatggaggagaaaaagggccagtatgccaagttctggaatgagtttggaaaatcagtcaagttgggcatcattgaagacgcaactaacaggaaccgtcttgcaaagcttctgagatttgaaaggtttgtcttctattctaatgtccactaattgctgtagttatatatgcgagggataatagaactgagtttttatctgtttcagtaccaagtcggaaggcaaacttgcctctcttgatgagtacatttcaaggatgaagccagggcagaaggacatcttttacattaccggaagcagcaaggaacaattagagaaatcaccgttccttgagaggctaaccaaaaagaactacgaggtgtgttaccgagaggcctcatttttttacagtatcttatgtcatgcattctatgttttttttttttgaaaagaatgtattctatggtttctccttatggtttttaatattacacattcatcgcattgttgtactgtggtatttctactcatgtctatttactccctcaaaaataagtaggttgatttctggaattgttaggcttagtgttagatttacccattcaagattgcataggtctatatgccaaagatttttgactcaggaatcatgaatctaatggaccataaccctgcaccgaggtcactgtactatgtttcaatacgtgtaatggtacatattatttctgatgtaccttagttttaccatcctctatatcgttgataaacctccacactcctccgcttttaacctaaaaattgctatgtagtatgaatgagggtaaaatcacaggtttgcagaacttcattcagaagccgggtactgcaccacatttattgcttttttatgagctcctccaatagaattactctggatccctggagcttaactaatacttttgttatcttttgttgcaggttatctacttcactgaccctgttgacgagtacttgatgcaatacctcatggactacgaggacaagaagttccagaacgtctccaaggagggtctcaaactcggcaaggactctaagctcaaggacctcaaggagtccttcaaggagctgaccgactggtggaagaaggctcttgacaccgagagcgtggactcggtgaagatcagcaaccggctgagcgacaccccctgcgtggtggtgacatccaagtacgggtggagcgccaacatggagaagatcatgcagtcacagaccctctcggatgccagcaagcaggcgtacatgcgcggcaagagggtactcgagatcaaccccaggcaccccatcatcaaggaactccgtgacaaggtcgcccaggacagcgaggtactgaagcttattagatcgacaaaaacctcactaatatttatcatttctttgcttccaaatacgtcgaaaaaaaaacttatggttttgtgcaatcttgatgcagagcgagagcttgaagcagacggcgaagctggtgtaccagacggccctcatggagagcggcttcaaccttcctgatcccaaggacttcgcctccagcatctacaggtcggtgcagaagagccttgacctgagccccgacgcggccgtggaagaggaagaggaggtcgaggaggccgaggttgaagagaaggaatcatccaacatcaaggaggaggcggagccgtcgtcgtatgataaggacgagctgtagtgatgtgtcgccaccaactgttgtttttttatctagctcttgtgttaggttgtttaaaaatgtgatggtttcgagggacgtccatttttccatgcgaaaatgcatagtaccatgatacggggattttgtcgatgtacgtagtttgtgatactctagttcaaattaatggccgtctaatttcgatcatccagagctgccatgttcattagtttaaccgttgtgccctgtccatgtcgggaatactaccttatttcatgacgtgattattcagggaacggacttaactcgactactgctaatgatcaactcctgttaaaaatggcatcaatctgaacatttccaaaatcttaactcgactactgctaatgatcaactcctgtgactttgggatggtacgtcgccacagtatcctgagtcacgtcagaggagcacagtatcctgagtcacgcgttacagtagaaaaggcgtagtattgaaatatactgttcaaagttactgtttggatattattgtaacataatgtagcaatcgatctcgtttgttcgctgcagatcgaacggctaaaaatatcccaagtcagagtactgtgcatgtgcatctctgacggatctcattcccccgtcttatcttatctcaggttgtagcgtatggaagaggaggttgaagcaccaccgcagcatcagcggtgtactcagacttaggcggtcaggttgtcaccatctttacggatacaagatctccccgagataactccatttgctttaacgtccagttcttgccctaaagattaatgtttcatgcctatagtgtttgccgccgcatgaaactgggaaacagaaaatacgatactttgctgtatttatctttgcaaaatatgttggctgggagctttaaggctcagttcagcaccccaggttcccaacccaaatatcccgcacggaaaacggagcaatccattagcacgtgattaattaagtattagctattttttttaaaaatagattaatttgattttttaagcaactttcgtatataaattttttacaaaaacacaccgtttagtagtttgaaaaacgtgcgcacggaaaatgagagagaggagttgggaacctaggtgccgaacacacccttagggcaagtacaaccgtgtagacagcttgctgtctttttacacaaatagacagcttaaa

SEQ ID NO: 432 - DNA, 5722 bp, Oryza sativa
actaaaatcgccatattatgaacatggatgattaatcatgtccaggttcatggaaggcctctcgttgcatcaggtttgtctatgttcatgatgcatcaggttatgaacatgtctatgttcatgaggcatcatatcaggtttaaacttatacaatgtcaaaagcttgaccttatttgttggtctgttgagttgagcagctcgaggccagcctttaaaccattgttaatctacttagagcaagtttaatagtagagataactatgagcttatagctaatattagagtttaatgcaactttatatcacatttattaccgatgtttcgctatggatcaccttttaaccaatattttttactttgaaccagatatttttacctttgtggtattttagaccaccctcaacttttttattcatttacatccaactcgtcgtatgctaaaaaatgtcttacatataactatgagagttcattgatgagtaggtgtcgacatacctgagatcgttcatatggttgagaagagagacaagtggtccaaagtgaaaacatagaaaataaaaatatggctcaaggtaaaatttactctataaacaattcgacttggcataagtgctcgcatttacgacttgtaggcgatgaatccgtcaatgcgatgacatgacagtaagacgtctatagttccttcgtcaatcttaaaatatgatggtccagcctattagagatgctcatagagatagagcatgcacatacgtgttcatagaggtaggtgtgtactcatgtgagcacctgcgttataccctatttcttttataaaaaaaatactactacccccgttctaaaatataacaaattctattttgggaggagtagatttgccgacccaatgataatatacaaaaacccagggtccaaaccgaaaaaaaaggtgtatcatgttttttaactatgggcaggtcattctatagcgtagtaggcccaggtagaaaggctggcacaggcacccagcagcagagggccacacacacctacgcctacgcggggaagagaagacgagacaagaagaggagaggagagaagagaatctcgtggaattctctccccctctcctcgcctctccaagaacccaccaatcctccccccctccccccccaacactccactggcgccgcacagctccgatcttgcctccgccgccgccttcttccgctcccaattcgggcccgaattcggtccggggggggtttcttggtgcgtcagcgtttcccccccccccccccccccccaaaatttactttgcctctgtagagagaattcccggtaaatttgtgcgtgtttttttgctttccgtgttgagatgttattgctctcgcttttgttcccccaatggaaaagggaaaaaatgcaagcgaggagaggaaaaaaaaaagggcttcctgaggctgacaggtcgggcccacctccgccggagatggcgtgtggcttgcgctgtttgtgatgagttctctggtggtagtaggttggcatatacggggtgctctttgctttgagcatggagctgcaattcgctttgctttgatttcatctttttctactgtgcaattgaagggcatcaagaacatcatgtatcaaagctaatttcatatgtctggcgataggttgtgtgggttgctcccatggagctctttaccttttttttgcctggttataaattgagagcaaaataaataaatactaatggatgataattcgattgatgcaccatgcaagctgtggatgcaagtattcgccttaactatgtatgctggctggttttctgttagagctttgcatctaccatttttatgggtcactctatttgcctaaccttccatgtaaagcagtatggtatgatgaatcaaattggatagatgtattggacagcgttgcacacgctagttttcttggtacaaatggcattttccttgtctatactagtactagtagttctttcctctgcaacaatgaaaacttccctatgtagttaagctcacaaattctagaaacacttgtgactgtcttagagatggacagaaaactgccactgcaactttgcactgattagttgtgtttttgtacttttatcaccggcaaacattgtttgtgatcgctgtttgtaaaactgatatctggctctctgatgtattttttcccaggtgatgatcattgtattaaccaaaacctgaacctagtgttggccctactgtaataattcagtcacttatcagcagcatatggaattaggtggcaacaatatgggcccagataatggagcaaacaacaattccaacttggctgcaaggcaacgcttacggtggacaaatgagctgcacgaacgatttgttgaggctgttactcaacttggtggtcctgatagtatgtattcatactgcaattgttgcaattatgttttcatttattcatttatttgattttatcaaacttatatagagactgttctgtatgatgcttttcttggagacaataactttactgcatgcatgtaatcatgctctcttaccattgaacttattaactgtaaatttctgcttctgctaacacttgaattcctcaaatgcaacaggagcaactccgaaaggagttctaagaattatgggtgtacaagggttgacgatataccatgtgaaaagtcatttgcaggtacatcttgttacagtgtgtcactttccctttaatattttttgtagctagtattttttttatcctatttaattcccctcctgtttctagaaatacaggcttgcaaagtacattcccgactcttcagctgatggtacgcggacaatctcttcatcatgcattgcattttttagtactctggcattcttttagcttatcctaatttttgtctccttggtaggtaacaaggctgaaaacaaagaccctggagatttgcttgctggacttgagggatcctcgtaagtatacataagcctaattatttctccgatatcatatcagtcgttttgtaaaaagaaaaaagaaatgctactgacatactgttatggtatgaaatggaagtatgctggtttgccacattttaccatttaccagtaaatctaccatgaccaactattgaaattattaccattgttgtttgcatgctgccatgctgctcggcaaatatcgctttctagattgtagtccctctgtagttgaaagtatcaaggaataataggctgctgctggattgagattgaaactactactagtattttacacataatttcttctgcccaccatttttggctttcaacatcctcaagaacataaatcctagatactagaaaacaacaaaatatgtgaaataacttaagtctgattaatatgctttttccttttagttgaaaaaattaagtcatttgttattgtgctttctatttatcttctgtaagatttcaatgcctatttatcttttcaatggacagttccattatgttactgttcgattggtgctgttctccacctcaatagtcaatattcatcgtgatattttttttgtacagtggcttacagatatctgaagctctgaagctgcagatggaggtccaaaagcgtctacatgaacagttagaagtaagtttttgtggaagttcctttcagcataaaattgttagcttctaacatttgtactccatccttatatatttattaagcctattccgaagttactaaaatattccaaatctatgcaaagaaattgttctggatgcacatattcttcaaatctttgtgaaatatccagcaaagagcaggccctaatgatatgataaacattctcttcaggtacaaaggcagctgcagttgcgcattgaggcgcagggcaagtacctcaagaagatcattgaggagcagcagcgtctcggtggagtgaaatctgaaacacctgctgctggtgcttccgtcacattgccaagcgatcagttccctgattccgaaagaactgacccctcgactcctgcacctacatctgaatctccaactcaaggtgtaccttcgaatagggacaatggaggacaaaacgaagcaaccaagagcccccagcgcgatgattctctgtcccgccatgaaccactaacccctgattccaactgtcagcctggttctcctaccgctagtccaaagcatgagagggcagcaaagaggcaacgaggtaatggtgcagagttctcggaaactgacttcgcccttcctcattctatcttcgagtcgagttcggggtcagagttccaacaatgttccatgtcctactcaggtcattagcatctggtgatactcctcacagcatcttcgctagcttgttcgagacgaagtaatgatctaagatccgtgttgtagctctcagtagtatatttctaagtcccaatggagatgttggtagacaaaaatgttgtaggtgttcagatgattgtttacatgatactacatatgacagctatttaagcttgtaatttcgtggcctgtaaattttattatcagctgttgagttgggaagtttgaaggttgcgctttgtcgcggcgtcgacttctgctcatctgggtaaatctttattgacaaaagtgtttaacatgaacaatttttcgcgtgtaatttgttgtaaacttgtaatggtcagtggtcagaagcacaagctgttgatgttatgctgttacacttggatgttactatcatggttacttttctccataatttcttgtgttctgtccataatttctgtgtgattactggaagcttctattatgtgctgatggcatgtacttcttttcgtccctaaaaaacaaatctagtatataatatgacacattccaatattacgaatctagatagagatatgatggggtattcgagaaaagagaaacaaaagatattctttacatcctaaaataaaccaacctaaaataaaacaaaatattacttagcataagtaacgttgttcagattcttagggcaagtacaaaggtagataccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaagagtcgactctatgctgttgtcatgcgtagcaaccatctttctcttttcttctttctctctcttcaacatcaccaaatatgcttgcatgacaataaagaaagaccgctaataaagatcattgtacatgtccttactactaatgtatcttattctaagttgatttattttagaatggaggagtagagatattgaataccatttctgggctggctatcctaaactccggagcccaattcgaattctcctaagaaatcctatttttcttgttttggcgcgaagcaaagaaatattgttttccggggggagaaatggcgggaagggaccaacttagcacgccattttggcgccaatcgcccagaaaaaaaaaatctctcctctcttcctccttcgctttcgccttcgccttcgcctccacccgcggccggcggagagaagaaggcggcgggccggcgggcgatgcagatccgcgtgcggtgcgggtgcggcgaggcggggtgcccggagtgggccatcgtggaggtgcagggcgtggtgcagccacagccg

SEQ ID NO: 433 - DNA, 5119 bp, Oryza sativa
aatctgtaatgatgcacaagttggggaatgttatccaattccaatatgtgcgctagtacttgcctagtgagatgactgttattttccaatgtactggagactcgaccttacaagtgtcgttaccaatcacttgcctccatctcaaacgtcttagtagggacaagctagctaggagaaatttcacatgacttgcataaaagattactactgacatgacatgagcaaacaattaattttcaaaagttacgaaaagcaatatagaggcttaggaggaacgaaagctatgaaccacaaataaattcatcttaaggcactgctgcagatttagctgcctccgattgatgcttcaccaaaaaacaatatcaacagcagtgcaaaattagaatttttgtatttttgtggtaacggaaaccatcaaaggggaaaaaacgtacaatgcttatgttgtatgttaagagaagtttgtgtggtgccaaatgacagtcctagcctgatggttatcgagaaagcagaatatgtgcaggtagcagagcaaaatatttgtggtagtccaactagaatacaatttgcatgccatgcctcatccaagaagccgggcaacgagaggcagcaaaaggcttttctgtggtgatgcaaaatgaagaggttatgtagtagctgagctgatgaagcaactggtcgctagctgccggccgggagacgaatgtgaggcaaggaaagaaaagaaaaaacagagagaaagagttgatcagaaatgggtgaattctgtggtgaggaaaggtcaaggaactgaagccaagagatccttcctacctacactaatacaatatactcctaactcgctcacagactccgatccaggtccaagtcatgctatgctgtggatcggccggccgagattgcgccacgtgtgcagaacccaatcttcagcgtgtggcctgtggaggatctggaagctgatccacagggacgagtgtgtgcctctcacagcctccaacttccatggcgacgtccaattctattgtattatttaaggcctaccgcagctcggcctctacactttgagcagcagcggccggccatcatcagtgatcctctacaatcatcgactttcagcaaattaagatggctgctgccttctcctccaccgttggagctccggtacacatacatacgcagctagctagctagcttgataagtacatgtttttgctgcaaattaaatgaggatacttacttgcgagattaatggatgtgcaggcgtccactccgaccaacttcctggggaagaagctgaagaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgtactaaatctaatttgtacaccacaccaatcgattttattcatcatattcatatatatgctgaattgaatcgaattgactgactggatatatgcatacatacctccaggtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaagttagtatgaactttcgaattaattagtagtatgtatgtacttgcttgttgctaattgacttacaacgtacgtacgtacttacagccccatcatgatgagcgccggagagctggagagcggcaacgccggagagccggcgaagctgatcaggcagcggtaccgtgaggcggcagacatcatcaagaaggggaagatgtgctgcctcttcatcaacgatctggacgcgggtgcaggtcgcatgggaggcaccacccagtacacggtgaacaaccagatggtgaacgccaccctgatgaacatcgccgacaacccaaccaacgtgcagctccccgggatgtacaacaaggaggacaacccccgtgtccccatcatcgtcaccggcaacgacttctccacgctgtacgcgccgctcatccgtgacgggcgtatggagaagttctactgggctcccacccgcgacgaccgtgtcggcgtctgcaagggtatcttccgcaccgacaacgtccccgacgaggacatcgtcaagatcgtcgacagcttcccaggccaatccatcggtacatccatctgcaaccaaaaatgctatcaatgaccaaattaattaaaattaaaggaaactgaaactgaatggtcgaattgctgcatgcagatttcttcggcgctcttcgtgcccgtgtttacgacgacgaggtgcgcaagtgggtgtcggacacgggtgtggagaacattggcaagaggctggtgaactcgagggagggcccaccggagttcgagcagcccaagatgacgatcgaaaagctcatggagtacggatacatgcttgtgaaggagcaggagaacgtcaagcgtgtgcagctggctgagcagtacttgagcgaggctgctcttggtgacgctaactccgacgccatgaagactggttccttctacggttagatccaacaccctcccactactctacaccatcatcatatatgatacatctctctctatcactgtatatatatatatatatatattatgaaagaaacaaaaatagcttcctctaaattaattatgaccagctaaaacgcacaaattaagatttgttatacatgttattctatctatagcgcaggggcggagccacgtgtcgagcagcttaattaggcttgagctccacacgtggcaagaaaattattagggccggaaaagcataaatttctagttacaatttgttatactaaatgattgagccctatgcatgacaaaattctacctccgcccctgtctataggttctgcgccatccagctgaataaaagatctctagctattcgcatcccatcgatgcatcgtaggcggcctgcataggaggaggaggtgatttaaccccttaactcttcactattccattttgtaattcctgtatacagtccttcagcatacatgcatgtatgaagacatatccggtgaaaacaatctatgtgttaggaaccaatgaaaatcatacaaaaaagttttgtaaattcatgaaaatactactagagatatatagtgcagatatgaaatatattcttaccaaatttcaagttcaaactcaactttatttgtgagaatttttgtttctctcaaatgaagttaagtttggacttaaatttggtaacaatgtatttcatatctacacctctctagtaattttttcatgaatttataaaatttttagatataattttcactagtttccaacactaagctcgttttcaaaggatatttcccttatatatatatatatatatatttatatatatatatatatatttatatatatatatatatatatatatatatatatatatatatattatattctactatatcttgtctgcattttctcaaacatataatactatactcctatgttatgtactatatagatcgataggttgctgattaaagttagtacttgggataatttggatcagggcaaggagcacagcaagcaggtaacctgcctgtgccggaaggttgcaccgaccctgttgccaagaacttcgacccaacggcgaggagcgacgacggcagctgcctttacaccttttaagcaggccggcttgacgcttgctattaattatttctcctttttatgttttctctttgttctgtgtatcagatcgcgcccaagccatagctgggcatgacaagtttttgttaataataatataatataaagatatgggctatactatacatgagtatatttcatttgggtatcatttgtcaatttctgtgtccatccagtgttttcttagaacaatactgtaagacggtttactgtcagccaaaatgctaaattaagcaatgggaacaatacggtttgcactccttctaatttattcggcaagtcttttgccgcttttcgtttcaaaaaaaaaacttgggagagtggaatgctaattcacatgtgacattcatggaacaaaattgagagatagagagagagtaccgatgaatgtaatcaaacaggtaggaagaaggcaggggtgcgagggttgatgagtgatgacgcaccttccttgtgaagcattgtgacgaacacacaaggggaatagcaagcattagcagcaccagcatgaaagaaagaaaggggaatcggtggaagaggtgacgctgaggaggaggaggaggaggaggaggaggaggaggaggaggtggctcagcgccatcgcctaatcgccatcgcaatcgcggttgaagatgggatcgccctttgaggcatttggacgaacacagatcaagcatgcatcaccatcggtgaagcaagcagcagcacgaaagagatcggtggacgctggctgagggtgggtggcgagcggaagcagcagcagcagcagggccatcgccatcggagttgaggaggatcggatggagtcggcggcgaatcgcagcgatggatggatatcatcatatcgtgaggtgaggggaggagaggaggggactccgtagtggagtggtatccgatagattctgggccaggtccattaagcccactatcccagctccacgtttctgggccggccaacgtaaatgcacataggcccctggcctatatttaagtggcccatatttctgtgatcgtggcccacacatccacatgtttcaatcacgtgagagtatgtacacttagactcccttaaatatatatgtccaatataattcgtatccctcggttacagtatcagatatcctaaaccctcaactattaaaacaggtgta

SEQ ID NO: 434 - DNA, 6602 bp, Oryza sativa
gtcttttaatacacctccttttcgttaacaaatagacaagtgccacctcagataaggatttgttacaaccaagtatatatatagttggggacttgaggtgctaaactaaccttttaagggtgcaaatgagctatgtataaatatttttaaaggtgcaaatgaatcatttacccccaaaattacggacaacctgcctagaatgaacgttccaacgatattttcatcacctttaagagtgtgtgtatataatcattaaagcagagtaaatatccgctcaaaaaaaagcagagtaaacatataacaacaagtttaaaggtggctccacaaatactactcgctccatttttaacaacagaggactccgttgcttgtccatttatcttatttaaaaaagaattacataattatcattcattttttaagttgttttatcatcgaaattattttaatcatgatttatatcttatacatttgtatacaagttttgaacaacacgaatggttaaatgtgtgttgaaaaatcaacagcatcatctattaaaagaatggagggagtacaaaaatatccaaatggatttttaaaaaccagttcaaaacaaaaaccggtgccaaaagaaacctcaaaacaaaaccggcttcagtgcttcacgcatcgaatccagcagcgaattagaaaaccagccagagccgaggcgaggcaaagccaagccagcccagccagggccagggcagcagcatctccgtggcccacgtggcccccctcctcctcctccagcccccgcgcggtaggcgacacggacgccgacggtggggcccactcgacatccccaattccttccgcttggctccctcgtgggccccacccccaccacgctggcctccctcctccctcccccgctatatataaacccacccccccgacccgcctcacgcccgctcgcccacccacctgcccccccccccccccacctcccccgcgccccgcccgcccgcccgcgcgccccacaccgagaggcgccgcgccaccatcaccacccaccccgctcctcgcgccgccgacgcgccacccgccggcgacggcgaggaccgcgccgccggtgtcatcgtgccgtgccgatccctcccccggcggatccacgggctgagccgatcccgtccgtggagaggagaggaggaggggagggggaaggggagagggggggagatggagaagtacgaggcggtgagggacatcgggtcggggaacttcggggtggcgcggctgatgcgcaaccgcgagacccgcgagctcgtcgccgtcaagtgcatcgagcgcggccaccgggttggttttttttgttcgttcgttccccctttgattttacttttttttggggggttctttttaaggattgaggtgggttgatcggtgggtggaggattgattgctgggttggattatgacgggttttttttcttctgggatctgtgcgtggcagatagatgagaatgtgtacagggagatcatcaaccaccgctcgctgcgccaccccaacatcattcgcttcaaggaggttcgttcgtgccacggatttgcttttatcccattttgaacgttttttcccctgttttatatcaaaagttgcttgatcctaattacagagtggctccaaatgatgcagataaggatgcacttttttttaattctgagaaccgttaaattttagtttgagagttgctgatttctctaaacttcatgcagtgacggaatcttctgaattgatgttaaacagctgcatttttgttccttccttccttttccccctttcatttctttcgttatagtctatcttacccttgcgtctctgtaccatctacacacgtatgaatgattctagtggcatggttgcatgtgctttgggttagacacagatttatctgtgtctttttttttcttttgcacaatttgaaacataaacgccaggacatctttcttttttccaatgtaggagtaaattgtgaagggacgaaggaatcgtgttgtcctgttggctttacctgttccttctttcagaaaagaggggcactctgttattaattgttttttttttgggaaaaatcctgcaggtgatactgacgccaacgcatcttatgattgtcatggagttcgcagcaggcggggagctgttcgatcgaatctgtgatcgtggacggttcagtgaggatgaggtcccgtgatttattcctgagttttactactttataaccctgtcttatgttgaacgagcaatattaatattcttttattctgcttgatgcaggccaggtatttctttcagcagctgatctgtggagtgagctactgccatcacatggtatgcaacaaacagttaactcattcaagaggaccaattcaccatctctaagcaataattactactgtaccctgtttcagttttatcattcagagtgttggtagttttcatttgattttataactgagctaaatctttatgagtttctaattatattattctggtgtcaatcttccaactacagcaaatatgccatagagatttgaagttggagaatgttctcttggatggcagcccagctccacggcttaagatatgtgattttggctactccaaggtttgttgccaaacccactgtcattttagcaatcttggagctattggaatctctgtagattctcagaataatgtctttccgttcttgatcagtcatcagtattgcattcaagacccaaatcagcagtggggacgccagcatatatcgcaccagaggtgctatcccgccgtgagtatgatggaaaggtgagttattttgaccccttgttggtttctgacatgcatttcattttgtttcttttgaatgattatttgttgatggaaaggtgaaaagaacccctagtaggtagtgaaatagagcgtttatttgtttggtgtctgaaacagaactccttatctggacatgttatgtgcaaataatgcaagttgaactaaaaagtgttttttggtcaaactgtgagagtagcgaggcataatattatcggttctccaagcttttttaggtgaataaagtagccaatgcctctattatagtttaacttctccatcaaatccacataatagatgcacctcttccaatgattgtgacattccatatattcagctcctaaatggctaaattcgttagaaatcgggttgaatgatccttcacaaaatgaatgggttccttcatacaatttacatgatcactgagagtatcttaataaatatcctacttgttagttactcattaacttggttaatgttcactagctaatcaaaccatactatttattattgttttttattttttgattattagtggttagtctgcagatctagtactagtatatatgcaaaacctcttttgcaactgttggtggacagccttgtttggtctaattaggtggaattcacagctattctttgatagtgcatttcataattagctacagtcacaaatattggaccagtagaggatctgaaatcgagtgatgcttctgatttggatgagtagtcattgtctgcatgaggtgctcaaacatcttctgtttggtttgttgaggcttaatgtaccacaaaggatgtagaacctttgattcaatagttccacatgttattgcctccttaattggtccacaggaatatatagagaatgtttcactgtgcttcatgataaagccaaaaatgacattttgattcaacacacatgttcaattcagtaagttttcacttgaaatattaccccttgaatatttgggtaacttcaactttttttttatccctgggaagtgggaacccatgtgctaaaacaccagttttcaaggtcaaactcgagatcattttgtacatttgctgagtttttaaaaggtgaaatagaaacattaccctgaaactgacctacaattttttttcttcttctttttattcttctttttttttctttttttttggggtggtgacttctcaattttgaagcaactaagttttcttagttttacttgaacaaggtcaaccaaaatgcatcattttgtataactaaactgtcctttttatattattgtacctgactaactgcttggctgactattgggtttcatgcatgtcatcctacactggatgtgctccacatgttctttagtattatcgcactgacatcgattataaatagtctaaaccacccatcagaacttattggctgctctcaattcattactatactgtatatcattcttactacaatacaaggaacctgtgtatcattctaaacttcaatgcgacagcagaacagaactgcaacaaataaaggtgatctggtcaaacaagcatactcctaagtccactgaacactggtgttggcacctcactaccctgaagcctagcaaccttgtgataaaaccttttaacataaatggcattaagcccaaactgtgctttactgtcacaacatgacctattcatcactgagttctgataaaatcctagtagttctgaaccttttcacttattttctcctgaagcatttcacttcattctactgaatgttagtagaattacgatcagagagtatggtcctactcattggcaacaatgggcttgttgatgtagcttgcagatgtatggtcctgtggtgtgactctttacgtcatgcttgtgggagcctacccatttgaagaccaggacgaccccaagaacattcgcaaaaccattcaggtgacaagctgaacccttaagtcattcatatccatccaatttctgcaggttttctttttgtgactcgcttcctcattccagtcgctgttgttcatccacagagaataatgtcagtgcaatataagataccagattacgtccacatatctgcagaatgcaaacagcttattgcccgcatttttgtcaacaatccattgagggtaatataactcaaattttatttccattttattttgaggaaaccatggtgtatctgtccttaacctaacatgttattaacacaataatttgaatgttgtccagagaatcacgatgaaggaaataaagagccacccgtggttcttgaagaacctccccagggagctcacggagactgcgcaagccatgtactacaggagggacaactccgtgccttccttctcagaccagacctcagaagagatcatgaagattgttcaagaagcaagaaccatgccgaaatcatccaggacaggctactggagcgacgcgggttcagacgaggaggagaaggaagaggaagagaggccagaagagaacgaggaagaggaggaagatgagtacgataagagggtcaaagaggtccatgcgagcggggagctccgtatgagctcactgcgcatatgaaaaagtttgtgtgcagctattgtgtagataatccggcttactatggaactgcggtgtatgcaattttcgctgtaaatttgcttctgtttggcgtttcttcgtgtaacataacttacttgggggcgcttggacttcaattgtctgattatgttttgtaagtacctacatattaagcgtatgctatgtacttggtgagaaacttctagcaccacatgtcagcaattgtacagtatattattggaataccgcagctttgccattgcctccaaaactggccctatacatctgtccaacaaactgcaattccacaagcaacagccaaacatagcaatttgcaattttgcattcctttagccatgccagctctatccaggatgacctcatacaagcctgggggccagctctatcaggatgacctcatacaagcctgggggtagagcattcatataagcctgggggccagctctatcaggatgacctcatacaagcctgggggtagagcattcatatgaaccttggatgagagtatccaggcaaccattcctttagccctcatacaagcctgggggtagagaccctcatacaagcctgggggtagagcattcatatgaaccttggatgagagtatccaggcaaccattcctttagccatgccagctctatccaggatgacctcatacaagcctgggggtgagcattcatatgaaccttggatgagagtatccaggcaaccagacaggccaatggcaaatttaggccatctatattagagttgctggagcctggacccactaatttaaatcgaaaaataacagcaaacggaggagcagaattagtcaaattaaaatgtagaagaatacacaactgggttagaccgcatcaccgtggtcttcacaaaatatgttgcattgcccgctacagaagcatgaatttcaatgattagcatgctcttcaaaatgaaacagtagttacaatttacaaattatctctgctgaatcgacgcactgaaaattttgtaatgtcaattagtaacaacagtttcaaatgctgatgtgtaattatttatgttaagatcaactaaatgctatggagatggcaaatcaacatgtacagagctagcaacatatgagatcagaactgtactgtgacgtgtgtttgcctggttagcaacttaaagcatttcagttagcattgg

SEQ ID NO: 435 - DNA, 7023 bp, Oryza sativa
cggtggtggcggcagtggtggtggaggaggctcgtcggctccctctttctctcctgggagcactccctcctcatctccgccatcctcccccttctcctcctccagatccggtgatgggggccgtggagaagaccgacgcgggcaaccctgtgttcgtcggagaggaggaagatgcagtctagaccaggttctgtgtttttttttgtgtatttcagctagtgtactcgtgatgttctttgtgtttggatcaaatgttgcaatagatatttggacagtgttccatatttctatttttgacatacgggtttgttgatgtttcaatggttcaaaagcaatgtttcagctaatatactcgtgatgtttctttgtgggtggatcaaatgttacagtggattttaaatagtatttaatattttcatctcgatgtacacggggtttgtttagatgtacatggggtttaagtgcttcaatggcttaaatcgttttgttacatacgttgaaccaaattgtttcatttagcgatctcactatgtttcacatttttttaagaattgaatcattctttcgctaagtgctaaaacattatttttataaagggtgaaacaacgccagactttttgggaaaaatcgagcgcctgatttgtaggcaccttcatgtaagtcacacacgtgacagatccacgtatcagtgatcaagtcagaggacaatatttgtttttacacatagagacttatttgcttttacgcacgataacggctcagagtcgactcttagcatttattaaaaaaattattatatggagctaaaatggttatctcagcaattatatattgaataatttagtgatatgtaagtattaactaaagagttcatatcaaaccatttgtacatgttaaatcatgcttagaaaattccaaaaataaaagaacttctaatcacacccaaatggccaaatcccaccataaaatgagagaaatcaatttcacacaggagcaggaggagagagaaaccgctactaataaataggagtataaaacagaagcctcctcgttaagcttcgaatcctcttccattccctccttcctctcctctcctctccaagaccaagaaccagcaggagcaagcaaggaaggcgccgaattcgatcggagcaggcaggacgggtccgggatcccgcgccgccatggagaagtacgagctgctcaaggacatcgggtcgggcaacttcggtgtggcgcggctgatgcggaacagggagaccaaggagctcgtcgccatgaagtacataccgcgtggcctcaaggtgcgtgcgtgattcgaagcgagctagggtttcttcttcttaatttctcgttttcttggctggtttttagcggggtttgcgggtggttttttgcagattgacgagaatgtggcgagggagatcataaaccaccgctcgctgcggcacccaaacatcatccggttcaaggaggtgaggccggccgcggaattcgcgggatttctgagaaattcgcggttcttgctcggtatttttattttctttttgaaaatttagttcgtaattttgggggaattttgttttgtttaggtcgtgctcacgcctacccacctcgcgatcgtcatggagtacgccgccggcggcgagctgttcgaccggatctgcagcgccgggagattcagcgaggacgaggtgatcatctaatctcctcgaattagacgggtcccaagtcttttccctctttttttttgccccctcaaaaattcgtgaggtttgcgtgctaattttaattttgtgttttcaaattgggggacgtgtggattgctactgttctagtcgaggtatttcttccagcaactaatttgcggcgtcagctactgccacttcatggtgaggacatcaataatttgttatttttctgttaatataaaaaaagctttaagtataaatttttcaaaatgttaagctgatgaggattgcgtgttttgtttgatctcgcagcaaatttgccaccgggatttgaagctggagaacacgctgctggatggcagccctgcgccgcgcctcaagatctgcgactttggctactccaaggtaacaatttcttctctctctttttttttaaaaaaaaggaagatttttatgttctttcataccgtgcatgttttttggtagaaaggtatacggaaagaagccttccttgttgaacttggcatgttgggaggacaaaaattttgacacgaaactgggtcgctatcctcattatccttattaaactcgtgccgctattgagaatcaaactttgcgccctttttttttctcagtcttttttatcggatgatgttatcaagcaatcctttagtttcttcacgtacataaaagagggacatcactcgaactaactgatggcaaaaagaacacttagacttacgaaaatatcgtatttattgctctttaatttagctctatagtgggttacttacgcgtactaagaccgttctttttgcgaatgtttttgtggtcagtcatcactgctgcactcaaagccgaagtcgacggtcgggactcccgcgtacatcgctccggaggtgctctctcgccgggagtatgacggcaaggtcagtctcagtcatcttgctcctctagcttgcctgtctctccagttgtgtccagggcagctggagactttgtgcttaatccttttcttttctttccttttttggtgtgtgctcaatccttgtgttatcttaaggcacctgaattttacacgcaaaattttaatatcccaaggtaactaagaagtttcacactagaaaatgtattgtaattttttaaggatggtgaaattaaccttgtgtgggtcacctatgcttgtgctagcttgctgcagtccctccggccccaacccaaacgtagtctgaacttttcatgtgaatgccaggactggagttttagtatgtgaacccaaacgtagcagacatatatgccttgtagaccaggctcatggtatcatgggggcacctctctaatcagtggttttacattcttggaattttgttctgaggtcaagtagacagggaatggacctgaccccaattgccagtgtttttctttgtccttacctctgtggggtggggattccagttttccaagctccaacttccaagtgctcctccaattatttgtgttgacaattttgtcaaaggagcaaagaggggggaagagatatcctaccgaaatgttcccgatgttgtcgctgggacatttttctttttactacctccgtcctaaaataagtgtagtcgtggggatccgtgtccaacgtttgaccgttcgtcttatttgaaaaatttatgaaaaaattaaaaaaaaatagtcacccataaagtactattcatgttttatcatctaataacaataaaaatactaatcaaaaaaaatttcaaataagacgaacggtcaaacgttggacatgaatagtgtaaaactgtacttattttggaacggatggagtagtaatcacagcatgcttgatggtgatctctgccccctccgggtgcgtgcctgctttaattgttcccttgatctggttcacagttggtatacatggtgaagtcttgtctcgcatggtgttgttgatgtgatgatccaaaaagaaagttagatttgatagataagagcaccagattctgttgatggagatcttgttatcatgcttaatgatctgcttgatagtgaggattaataaaaacaaaatcgctgtgtgctttgttgtgtggtgaatccttgaccagcaaacagataggattcatattgcctaaaaaaattgtggagttccaaaaacaataatgtagttatttcttcagaggtagtacatagaaaaaaaaaagcatgaacagatttgaaatggttgcgcgtgatgatctatgtatcgtggggaggccccgtggacatgttccatgaatcgaattgtgttcccattcatcatgctttatgtccttttctggaccgtatttccatcatgttgatgtgtacaataggggccctcagacctgatcttttcatgtagccatcttagactgaacatctggttggtaacctgtggtcctttgggactgtttttcttcatccttttttttgggcgtttcattttgccatctgtagtttgtctggttaatattgatgttatttgaccaattgctattgcactttatttcatacttttttgggataccatgccaaactaccaattgaatttctttctagcatgcaagattggttgcctttgctggtagaggctatcataaagcggcactgagattggttcatttttttaaaagtgacattgagatcagttaggagaatatatggttgtttctagacgaactgcccaaatgtccataggtctctgccatattttctattttcttcggctgctcccagaactccgctatcctcaaattgtgttcttcactttatttcatctgtcagttgtacatatttttctttatttttgatttcaaagataatgaccttcatgaatacctatttgcatattatctttttaattaagtgagtgtaactgatgttctcaagccaccatgttgtactcacatgtgaccaactcctaattgactcttgctagtttcacttaaattcgttgcttcacattttcctgaacaatagacttaaattcgctagtttcacttactggatactctttcaaagagctctgtccttgaactgctgggacttgggattcttctgctccttttttctgtccaccaggattcttgagttcttgatccgttaatatagtgccttctgttttttttttttttgactactctctaatttcctatgctttttgaggttcattctttcttgaaattatgcttctcttgtttttgtaacacactaacattattgtttgcactatgtgcagatggcagatgtatggtcttgtggggtgaccctttatgtgatgctcgtcggtgcttacccttttgaggacccagatgatcccaagaatttcagaaaaacaatcggggtaataattcacccacttcagcctctctaaattccaacttcaaacgccacacgaatgtacaaatatattatgctcacatttttattttgcagagaatcgtatcaattcagtacaaaataccagagtacgtccatatatcccaagattgtagacaactcctctctcgaatctttgtcgcgaatcctgcaaaggtgaacctcgcggaacttcaatccatgttccattatgttccatttaacataataccatttccaccatgtcatgcagagaataacaataagagagatcagaaaccacccttggtttatgaagaacttgccgcgggagcttacagaagcggcgcaagcgaagtactacaagaaggacaacagtgcccgtacattctcggatcagaccgtcgacgagatcatgaagattgtacaagaggcaaagacaccacctccatcgtcgactccagtggccggtttcggttggaccgaggaagaagagcaggaggacggtaagaatcccgacgacgacgagggagacagggatgaggaggagggcgaggaaggcgatagcgaggacgagtacaccaagcaggtgaagcaagcccatgccagctgtgacttgcagaagagctgataagatgttgagttcaagctttgctgttgccggcaagagggtgtttttgtgcatgtttgtactttgtggtagttgtgggggtgatgagatgtcgcatccttttcgttattagtttgtctttgtagcttttaactttctgttgttgccttgggtcttccttttcttttatcctgttctttttttttatcttgtgatatgttaacaccgtaaattattactaccaaataggctctccagtgcctttgtaatggttggatggttaagatagcaaggttgtatatagcttgtggaataaaccttatttcttgacaagtgtttatttagggagacaatattttttcttttcaccaacgagataagcaacacaaatgtgtatatatgcatgagatctgtttaacctcattccacgtattgaaataatttttttgcctctggacacatagttgaaattgatctaataaaaacaagaagaaaatggatatgttttctagattatattgtgcttgcatgttattttgggaaaaagagtgttatttttttagtgttagttggagcgtaatcgctactccctccatctacttttaatagtcatatttcatcttgacacacagaccaaggataagtaattctacttatcattcatttaaacatgctactaatcatccctcataaacaagcgattcattaatatttacatttctcaatatccatgtagccaatcttgtgtggaaaaatggagagtcatgcattaaatccgagaaagtaattaagatgataggttgttgaattgaaatatgccaatcaaaaataaatttttcagatttggaaatatgacaatcaaaagtagatggagggagtataatggaagagaacatctttaaagaatagttttcctttaatttgacactaatcaaattaattaggtgcgactgaggtgtcttaattgatctcatacgtagaaacataagaatggttatgcgtttaccaaatcctcctatatgttgtcaaatgtgttgggtctttctgtgtccacccaggcacgcatgtgcaactcacagcccaagaacaacacatttcatttagctgtgggttgtgttggcatagcccatctagccacgttgtgcttgggttgttaccggcccagcatgccaacacgacaagtgcatgtcgcgagcaggagatagggggaaatgagaactaaagaatcgaggaagctaggggatcaggaaagaggaagtaatgatgaacgctcattggcgtaggcctgcatagtagcattgtggtgtggccaaccctattcacgagcacaaccactaagcatgtcagcaattgggagctcaccggctc

SEQ ID NO: 436 - DNA, 4842 bp, Oryza sativa
aatcaaacgagggtgagagaacaaagggtttgttcacttctttaccattatcaatcattccaaaatttagtaataccaaaatagccttatcaatagttgataattaactttctattcaaaaaacttttctcagtatttggtaatgcatcaaactaaacactactcacctcaattttaccctaccgaaacttgataatgccaaaatcgagtattactaagtgtttttttttcacaaaatgaacaagcccaaaattccaagtggtacggggccatcactggtccattgttcaactacatgggcccgaaagaaaggggctcaaaagcacactgatccagtacaaatgatgggcttttggcccattagtacaaaacctgttaaaatatctgggcttctcaaataggcccataatatgctcatcccaaattgggcttaaaatctacagtcaccagcccaattaaagagcagcggcagacgatgatgatatgactgaaataccctcaccgtccttgtggccgcgtagccgccaatccgatcgcagccgtccaaggaaatatcaacaaccctataaaaaaagtcaacccatgtacaccgtccgatctccatccgactgctccagacgcgcgagggcacgatggtaattaaccaccccttggcgcttttcggccccaccgcgagatatttccggccgctttttccccgcctccctccgtcatccccacccgccaccgacctgtgagccccaccatcagtcgggcccacctgtcagccacccacccgaggatgcgggtagaataagcatccgtcccagcatcccgggatgttttttctcacctgaacgtcgacgagcaatcacaatgacatgtgggcccggtgtcatgcgggacccacgtgtaagtgatagagtgggtaggtagttgggtgggtttaggattcgtatgtggataacgtcctttgcttcgtcttcccccactttcccgcggcaataagaaaaagcgcgggagcaaaaggagaaaaaaaaacaacagcgagaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcgatggagagggcggcggcggggccgctggggatggagatgccgataatgcacgacggtgacaggtacgagctggtgaaggagatcgggtcggggaacttcggcgtcgcccgcctcatgcgcaaccgcgcctccggcgacctcgtcgccgtcaagtacatcgaccgcggcgagaaggttctctttccttcctctcttttctttgctgcgagcttagcttagcaaaattgagaagaaaaaaaagggtaaaatcaaagctggtttgatcgaccgtggaattcgactgcagattgacgagaacgtgcagagggagatcatcaaccacaggtcgctgcgccaccccaacatcatccgattcaaggaggtgaccatgacacgattctcctcttcctcctctcttctttggagatcatgctgattgctgatgctgaatgatgtaaaaggacacctttgtttgttccttcttgtttcgtttgcaattccgactctgacgaatcttttcaggttattctgacgccgacgcatctcgcgatcgtcatggagtacgcctccggcggcgagctcttcgagcgcatctgcagcgccggccgcttcagcgaggacgaggtcgatatcactgtcctgatacactatgatcatgtctatttctttcaccaataattgtgtagtatctgtattgtactgttgtattggctaactctgaacttttggtgtactttcaggctcgtttcttcttccagcagctgatatctggagttagctactgccattccatggtacagtatcattttgatttcaaagttaccgtgtgattttcgcttgtctataactataagcggtttgctgcattgagctgaagcgattttgttaatgtgtttttgcattgttcagcaagtatgccatcgtgacttaaagctggagaacactctgctagatggaagtactgctcctcgcttgaagatatgtgactttggttactcgaaggtactaatgtttttctatttatttttgctatgcttttagttgggattactttgatcatttggcaatactatgtgatactgatttgatgatctgaaggtagatagtatccacaagacatttagggtgcacaatgtggcttaaattactttctgtagtagtgaaaagaagagagaactttcgctagatttttctcgatgtgattgctgcctggataatattgtactgttgctttctgattttgcagtcatcggttcttcattcacaaccaaaatcaacagttggaactccagcttatattgctccagaagttttgctcaagaaagaatacgatggaaaggtattatctatcccctttgtgctttaaaagttgccatcctgcatgcaaagatacactgataccagcagctgcccaacttctatgccttttgctcgacaatagaagctgccattgtgttgtaaaggtgttgatccatgtttcaatggcatgggtagtgtatggtcttgtgaagtaacccttttaatgcattagttagctcaatccctaataatttgtctttggatggagattgccgatgtttggtcatgcggtgtgacgctctacgtgatgttggttggcgcataccctttcgaggatcctgaagatcccaagaacttcagaaagacaattcaggtatccttgccaaccattcagctttgcagcaccacaatttacagttataatcagccagctaaatagtaatgcctaaatactttttttagataaataatgtctaaatactgatctcaatttgcagaaaatattgggtgttcagtactcaattccagactatgtccacatatctccggagtgccgcgatctcattacgaggatttttgttggcaacccagctagtgtgagtaccaattctattcctgccacacaatcttcaattattcagctctgatgtgagacaacatatgcaatcatttgctcttgcagaggatcaccatgcctgagataaagaaccacccatggttcatgaagaacatcccggctgacctcatggatgatggcatggttagcaatcagtacgaggagcctgaccagccgatgcagaatatgaacgagatcatgcagatactggcagaagcaacaattccagcagcaggcaccagtggaatcaaccagttcttgactgacagccttgacctcgacgacgacatggaggatatggactcggaccttgaccttgacattgagagcagcggagagatcgtatatgccatgtaatcatctcaacatttgcaatgaaactgcactgaaaatcagcttgtttcagagcaggtagagctccagaagagatctgtgttcaggctactaggaagcaggctctgctgcctattagttcttgagtctgaatttctgatgaaccatactgcagctgagttgcagcagattgtgtagtatgtaattatgtatgttgtgccaaaaatttagcaccggatgatatcatgcaagactgtttcttgggaacactgagaaatgagaagcattgtatggaacctagttctgtattgtattaaacagagagacagaagagatgtattggttaatgtatttgctatgtgtatgtaaatatgctttgtgccaagaagaaaaaatctctattaattctatggttctattttctcagcaagctttggctgctgctggagagtcagttgcatgaacactgaacatgtcaaaattgcagagtggattgttcctccatcctgtattagacagggaaaaatatacacatcatctgtacaaaggtgagcttggagccaaaagcatccaggaacatcagtctacaagccagtccaggttataacactcttctgctacctgaacccggaggtctgggatgacctgctcagcttccctccacagcaacgccgtctcctcgtcgcacacgacgtgcccgagggacttgagcgatgaggacgacctcgggaggctcctcagtcgcgagcattctcgcatgtcgatcttctccaggcttgtcaggtgaccgagctcctcagggaggtccgtcaggttgacacactgcgaaatgtcgaggtatttcagcctcttcaggctgcataccgaaggcgggagccgccacagagccgggcaggcgtatacccttaggatgctcaggcaatgcagcttgcccagctcatatggaagctctgtgaggtcatggcagtttgagatggagatgctctccagggaactgatttcacatatgctagatggtagctccttcaggtctatgcagtggtcaatggtgaggttggataggcgcgggaatgtcatcgagagatccacctttgatcctctcagactgttggtcagctcacagaggacaagggatatcttgcgcaggttcttcagtgggattgtggtttttggtagcggtggaagtgtgatcttctcaagccaaaggctcctcaggtcactgagcgtggtgaaggcggataggttatcaagggttgcactgatggtgccatagttgatcagcaccagggctttcaagttctgcatggttgcaatgaatggtgggagatagtatacacttgacgcgaagttgaggataagcacttcggccttggggaagctcatctggaaccagtcagattctttcatctc

SEQ ID NO: 437 - DNA, 2878 bp, Oryza sativa
gatcaccagagctacaagataagggtctacagcacgaatcgcaaagcacatctagtgacccaaaactataagggcctatttagattgtagctaaaataaaccttaccaaattttagcaatgccaaaattttggcaagatggcaatattgctaaaattttggcatgatttcttatgtattgactaaatttggcaacaaactaaacgtagatacttttttttgacaactttattaaaaaatggtatagttgaaaatggcattaaagtaaacaggccctaagatttggggatgtttttttatcgacaaaaggttagtgattattatgaaatgaccatataagtttatgcttacattgtaaaacgtgtgaacggtctccttttttgaccgcttaggcgtactcaaagtagaaattgggagtgatgggtttctatgctataggccagaggagatgtaggacttgttcatttttcacttggaaaaaacttatcaaattttagtaattttaccagaatcgaagtttagtagtaagataataaggtaaggatgtggacgatgtttggtttaacacattactaaattgtgtagtagctagagtagaaagttcccgaattactaaaatatggttgcattggtaatagtatgtttagtatgctgccttgttaaattttgatattaccaaaatttaaaaggtcttcgttttaaatatttttttaaaaatagaaataggaacaaatctaactatagttcacaatagatacatggcaatttctatattaacatggcagaaggaaatcggcaattgtaaatctgtaaccagagtcccatgccgtttggatccacagggccaaaagttctggaaggcactcgatgattcggcccaggcggccaggctccaaatcaggtgttttccagtgcattcttgaactgacgagaattatcaggatcccacctctcaacgccgcccacagcccgtataaatccggcctcccctcccgctctgcggcccagacaaagatcgaaagcaactcgcaaatcgcgatcccttgtgctcacatcccaagcttcccaagcacacactgttttagtgttcacaaacacagccttccttctcgcccaaatccgtcaaccatgtcgctgatccgccgcggcaacgcgttcgaccccttctccctcgacctctgggatcccgtcgacggcttccccttcggctccggcggcagcagcagcagcagcggcagcctcttccctcgggccaactccgacgcggcggccttcgccggcgcgcgcatcgactggaaggagacgcccgaggtgcacgtgttcaaggcggacgtgccggggctgaagaaggaggaggtcaaggtggaggtggacgacggcaacatcctgcagatcagcggcgagcgcagcagggagcaggaggagaagtcggacaagtggcaccgcgtggagcgcagcagcggcaagttcctccgcaggttccgcctccccgagaacaccaagccggagcagatcaaggcgtccatggagaatggcgtgctcaccgtcaccgtgcccaaggaagagcccaagaagcccgacgtcaagtccatccagatctccggctagagccccgtttgtttattctgctgcttctcctcaatgctgcaattgatctcctcctttggtactttgcttgtgtcgtgagggacacagtccaaaatgtgtgtgatatgatcatgtgtttatgaatgtgtggtctcctccaagggtcccaaatgtgtttgtctcctatgcgtttatgtacgggaaataaactttaagcttgattaatgtaccaatgtttgagtttttcttgagccttttggaatggaaactgggagtggccagttcggttctacaacattggttgttctggtagctcggttgatttagaaggatcagttctgattattatccagcataactaatatacgctgaatctctcccattttcttcttataagagacgtaatagcagaatccgaatcgaccgtcacaatactatgccggtgaattagcaaaacataaaccaacgcaatcacaaaggtatggacaaacgaagaagcggcaagaacaatgtacgcacctggctgatggcatggcacacttcccggattcattctcctgcatcaccatggacttatccagcgttaagactaatgccattgccacaacccaacgaaagcgcaatgatcattaatctctgcacagaaataccaagaagtaatacaacaggggattaggaagaggggcacacgagccccttcaccaacaatctgcgcgaggcgcatagggtcttgactcttgagggttgaggcaccctggcctctgccaacgccgtgggaccacgagagagaacggaaggggaggagaagaaaataattggcgccgcctcttcaggaccccaagcccgcttgagcatccaagatggagaacggctaccggaaccagccgtgcaggcgatttgatcgccggcgaggccgcgagggatggtggcggtgatggatgaagtctttgtcagtgacataaggcatgttgcctttgaaggtagaggatctcaatctccgtttatggaccaaatggtgggctccaccttctcttgggcaaagagtgaaccatctgcacatggtcccggaacaggattaggacaattagatctatttaccctagtcggatttgctatttagcctacgtgctttcgtaacatgaaagttttcatgtaaaacttttcagatgaatttttcaataaaatcatttcatatgaaaaaagtttaaacaaagttttgagaaaaagaaagtgcgctagaaacaatctcgtgctaaagaacaataccctcatattagttgatctataacagg

SEQ ID NO: 438 - DNA, 6488 bp, Oryza sativa; identical to SEQ ID NO: 333

SEQ ID NO: 439 - DNA, 3474 bp, Oryza sativa; identical to SEQ ID NO: 409

SEQ ID NO: 440 - DNA, 4561 bp, Oryza sativa; identical to SEQ ID NO: 370

SEQ ID NO: 441 - DNA, 14123 bp, Oryza sativa
ggaagtgaatcatctaaagaaagttatctaaactcttcagggtcatacatctaactgtatatatcattgcattcagagtaatcaactaagggacaacaaaaaacagaaccaagcataaaagataaaactgatactctccatattgagcgataagccgataacctcctgctctcaggatgattttagccgcctaactcatgaagttcagcaataacgagggaatgaccaacccagaacctattaaaactcaacataatcctatttcagaaaaatgtatgccctcatcgcctttccacgcctttgcagaacgtcaactgagatcaaacgtatccaaaaaaaaggtatgctacaaaacaaatccgtaataacaaccctcatcgtcatatatcaaatccaggcttttcccaattcactaggcaaccacgatcgctagctgcgacgaggggctcatgacctcacgcgcacacatcaaatccacaccgaagctcgctcgatcagaccactaaagcgtaccattccaccacgcatcgcgaagcgataaccctaagggggattcggatcggacgcatcgtggggtgataccatcagatctagcgaaatggagcgaggtaaggttcacggtttggggcgggacgggtgcggctgaccttgatggccccgaggccggaggcggcgcggtacatggcgacccggtgcccgcggaggggtcgctcgtcggagtcgtcgccggcggcggcgcggcggcggaggcggaggcggagatggggaggaagcgaagggaaggcgagggcccgtcagacaagtggaaggggaagaaattcgaggcgctggtccgcatatagaagtgggcgagagctcttaaatgggccgggccgaataagaggaataattctgtggcgattgggcccactttggcccattttctagatgcgttgggccttacccctctcgcctctcgtgggctcgtggggagtcgtggccatctgatctctctcacaaagccatcctccgctgcgccggcgctcgccgagtcgccgccgttgatgcgccgccccggctcgacgtctccggcggcggagacgaaggcggaggcggctacgcggagggacggggtaggcgtgcgacggcgacggttgtgaggctaacggcgccggtcgaatcctccctcaaagtttgcagatgagttgcttgatcaaatgccgattagggatgtcacgcttgaacgtgcttgtgcgtttcgtattttttttctcccctttctagttattgctgttggtgtctagttaattttgtcgcatttgcaattacgtctggggatttgctcctcgcgtggtagatgacttccaatttccacggcattgagtgaagagagagtgatggtttctgtgctgaaatcatccccgggtgggtatgcaatgcaactgatctgaccaccaccacctgtttgagggaattccagtttcagttcataaattttagcgggtacatcttctgttctgtctgaaagatgtgtcgtgtgcaaagttgtcgcttgtcagaatggtccaaatctgcttgttgagctgtgggctttcgacagattcaggacaagctgccaaggacggctctagatttcgagcatgtgtttggtgtatgcgtagggttggtgtatggaggtagttggttattgtgggcgtttgtgtagggtcttaacagttattgctttgatgtttgatcagatcacgcttattaggtggaggacctgtacagattagtcatttgcgtacaggagattgtgtcaatgctctcgcaggagacttttattcgtgtcaatgatctatgcagccatgcaggagaccttttagagtgcttgtgagacctaacatccgttgatcattttaagagggacacatattaacttgattgtaatgtgccttgtatgagggagtagctgctagctatagttgttggccaaccacagcaatgcattttgttcctatggtctttggatagtgtactgtccaatgtcaataaaaattttcactattggtggttgtatgttaacacaattttcttgcagtccttaaaaggagggcaaaaactttgccttgtatatgttaatagagcaggagaactctcttgcattatcagtttgctatgcctcccagttaggatgtagcttacatcctgagaatagaccgccatatactgtgttattgtctgtgtacatccaattggatgtagaggccgggtttaacccattttctaaaaatactgtgccatttggtggtgtgcatttggagcaaaacagattcatattccttctatttaagttgttgttattgattccttgaacaaatatattatattcttcctgttttcgatggaaaagttttacattgcttgaagtaacacaatttctgaagcacctggacatgtctgtgagacagcacatccacttaactgatagtattccatagtattattctgcaccttcttgttttagtgcaagcatctcagatgggaaaaactgcctgcagttgtaaaatatctttgttgtcacaatttcctaccagcacgacattttcatttagttcctcatgtaatgtttcttctctcaataaggtagctgttgcagagtgatcagctaatgattgttggactcttcttgtcaattaggtaaatacttaaaataaccgtcaaggcatcaagggaagcatgtgctggcggattgtgcttgatgatgtttaaaagtcctcatggcgcatgggaggggaactgtgctgcctgtgctttgagcatgaccgcagcaggtgcaagccacggttttatgcatgatctttatatgctcttttatgaaatgaatttgttatgtgtcgtaaacttgtaactgttcctcgaaagctcaccacaaattgtagttagcctcttgtatttcctatcactttcatgcagcatgtataggttcaattggtccgcgtaaaactgcgacaggctaacatttttccccgcatgatgtctgtttttcatcttccttccccccattaggtggcaatgtgttttcaataaatatgttggtagaatatgtgctctgatttttactatatgcatacagattaaattgctcaaagaagatatggcttagtttaccagcttcagaaaactatgtctctcatatgtctacatgcacaggtgaacggtcagctcgtcagaaagagatcggttgaagttgtacgcctgaatgcgactgcgtcaattaatgtgattcaacagaagacatgaattgatcaagagagttgcatgtccgttcaggtactttactctttgacattttcttgattgatttggtatactctgctaatgaatagtggagtagtatacaattatatacgcatttatacgctgtgacttgtgatcatatttttgtacgtataccaagcaacacattgcaattattaattatgagcttgtgacaggtccgtcggttggccagaaccacgactccaagtgtacgtacgtttaccacacacaaacctcttattattccgagcaactcatgcctcgtgcggattatgtatagtcaatagtcatatggcctcatgggtgatattcatgaaaccccccgtgaggtgttcctaccatatcattttttttccctgataacgagacacatgattaagaatgtgtttgcctaatgatgctgatgaatctttgccctgccaaatgccaagacggccggggctatcccccctggaattttctcgcaggtgagcaagatgtcgtgtcgacattgggaggaggaggggttatcagggtcataatggctctgatttgggcatgcatgagaggcacaatgcaacacacggccgcggggtagagaggtggactgatcggagcaggcaggaaggcagctgctcgacggatgagcccgatttttccctgttcaggatttatttacagctcctggagtaaggcgtaagcgaaggcgaccgcgcgaggagagacacagaaggagaggaggaggacgatgctgttccagtccaggtacggttgaacctaaccgagctaaccttatcgccgctgtcaatgttctgcaacctggtttatggatgtgtttagttcgtgaaaagaaaatttttcggtgtcacgctagatgtttgatcggatgtcagaaggggtttccgaacacaaataaaaaaactaatttcataactcgtctggaaaccgtgagacggatcttttgagcttaattaagccatcattaacacacgtgggttactgtaagcttaaaagattcgtctcgcgatttccatgcaaactatacgattagtttttgtttttatctatatttaatgttttatacatgtgttcaaagatttgatgtgatgtttttgaggaaaaaaaaaaggaaactaaaccaggcctatctatctgggcctgacgccggccgtcgtggtcgatcgatcgcgcccacaggcacaggcacggcaggctggccgtatcgatctgatctagctaaccccacctcactgcagcagcagcagcagcagcgcggggacctgatctctctccctgcccggtggggcccggagcaccagctccgctgctctggtcatgctttccatggcaggaaggaatgtgacacacacggtggtgccggggagaatggcagctgggccccagctgctagctgcgcgcgtgtactgggtcatcaattaacagttttcgtcagcttgtttggatgtggccacctaagctagcgctgaggtgacatacaaggagagcgtgtcgaaactggagaagacggggcttgctgttcaactgcttcagactttgcaggagggcactgcttaaggaggtaattaagcaactgtccagtgtcctactagcaatatatatattcgaagtacatccacattggatcaatcgtcctcgagtgaacagaggtacgacattctccatcagttatgagtacttgcatgcaggttctgtctggctcattggcagtttggcacaaaagcatttcaatttattgctgcaatttctgtttgtttaaacctgagcatgtagtagtagattattatctttatcgaatacggagtggattagatgctggccggcattcttgctgacacacaaaaggggttaattgttttggatgtctgagagccaatggctagggttctgcttgcaggagaaggttgctccctcccctgggcaggcatgcgaggcaacacgagcatataaaatttttatgtatgttctctctagccttagcttgtctacatgtacccttgttggggtccatcaagtgttgtgtagtactgctccatctgccttgggtgggaagcaagccctgggattcacctctctctctctctctctctctctctctctctctctctctagtctccaacatcacagactctcatgccgaaaaggatcatcattcgagcacaaggcctcctccatatgcccatgtgagaactcttatcacctgctccgtatatcttctttctactgcaatttgcaaaccccattattgtgcattggaaagaaatatccttttccatcattccgcgaaagcgaatgtgtgaaagaagtgtttcttcccagctgcatgcccaatacctcacatgattattttgttcacatcgtaattaatttagcactttctcctgtactggcaatctggatttaaagattttcttgttgagtatcaggatttcttttgtttgtttaacagcttgatgaagtgcatggcaatgcaacctttgatgagtcgatcgactagcacctagctcgccctccactcgtaggagctttatgctgcgtgtgagtgagtgcagtgcagtgcagtgtgtggaatctgcagtaacagctgtgatgtggtgaggcagcagttcttcttgccttttgctttttagttgtaggactggccagtctctcttaagctctctaaattaataaatatacatgaatcagctagctagcggtaaacgtctaagccaaaggtgcttggtgaggcgtcgggggtgtttggatccccgccaaacattgcctcgccaaacatgcggctgccacaacagtttggctgatgtttggttaatacgtgagttgtggcagccatactttttgctagttcatttgcatgcttatttccgccacagtgtggcgattatttctctcgccacaatctctggcggcgccacaatcttacagtcagttcaatttagcatagatgaaaggggtttgtgtgtcttgtgctatgcttaaattaacgatggagagagaaacagagaagcgatggagagagagtgagtgagagagatggagaggctaaggaggaggggccctttaacttttcctctataagaggtgtggcttcagttaaagtaggcaggaattctgctctctctctctctcttgtattaaacttgtgaaagcagcaggctgcctgcctcgattttttttttatatgtacacctctcccacactccttgctctctcgtttgctcttctactgctcatcctcctcctctactactcgtcctctttggtttgcttccggcctcttcttcctgcatagcttctgttattcgatttcgatgatcttgtcttctccttgaattgtgtgtgtattaattaactgtatgtttgtttgatcccttgcagctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggtatgtgaagagtgaagtgatcaacttcgttttgcctagctcttttcagtaattgcacacttgcacctcggtcggtagcgagggttcttgggcttcttgctgcctggtgcaaaacttgttcttatggaattaattggtgtaactgcaagaaggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggtaattaatttaattaccacttgttacatgcatactgccacttttctgtatacatactgtatgaatctttgatcagttttcggagtaatgctggttaggttacgcatcctaatcagtttctctccaagtaaactgctggttaggttctgtgccgttttctgcatgcatcttaatcagtgcacgtcatgcagatcatgcaaattaaccatggtccatattcccatgcacgcatgcatggatatatatacactcgctcgcatggatatatactgactttctgtttttctaggtgcagattgggatacatatactttctgtttgattagatgagcttccttcaatttgttgcgtatggatgagcggtttggggcggggtagctgaccaaatgtgtaggatgcgccaatttaaagcaaaagatgagctacacatcacacagcagcatggacccttttagttcgagcctcacatcattttactcagattgcaagcaaccctaaaaccatccacgatccacccaccgtgaaagcaaaaactagtaatatatataattggcccggtctcattctttcaattattccaaccaaaaaatgtatatttcaagaaagttcaaataatatacatactactgtaacatacatactaactgaaagggagtgataaaagacaaatataatgggaacattatgcatgtatgttagttttataaaaaacattatgcatgcatgacatggaatttttccatttgtttgcatcaaacaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctataagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttatacaattaatgtgcagtagtgcacctgtacctattggcatttcaagtttcatttacatattacggtgtatatatatagctactaaattaaatacaaattaattaacagctatttaattattgcatatcaatttaatgttatgcatatagtgtgctattttttgacaagtttgattacagttttaggctagactattttcaggaggtacatacgttttttttttaccaggggaacaattaatgagcattattagtattgttggatatatactattacattttagaaatacaaatattagtatattctaatttatcactattgcatatatagggagatctctgtgcatcgtcatactattccacagaatatattttttttgtgtgttggggggcactaacaaatatcacagtataattaacacaccctgctatttatactttaataccgtgcatgcatgttattgtcaatttatttacattaagttgcatgccctacatagaacataaggctttgtttaatttaacaaaaatgactcctttcaaaaaaaatttaacaaaaatgatgatttttggagtacttgaggattaaactgaacgaatccgaccccagcatgtacgttgcacacacatatatatggaatgaaaccaaaattgcattgttttttactgctccttccgtttcataatgtaagttattctagcatttcctatatttatattgatgttaatgaatctagacatcaatatgtatgtgagaaatgctaaaataacttacattgtgaaatggaggaagtagctagcatcactagatgtactgttttttttttcgggtaatgcacatatcactggtggtgtactcctacctattgttccaaattaaagagctagcgcttgtagttttcaggcaaaagtgcaacatatgaatatatgtcgatggaagaagaaaggtgcaggcatatgtgctagctgcttgtttaaggttgtcgctcgcatattctactgtgtacatt

SEQ ID NO: 442 - DNA, 9139 bp, Oryza sativa
catggacgtgacgtgtcctttttttttcttcttcttcttttctttttcggtttcttctcatacttctttttttccttttttttctgcatgggtcacaaagaaaggagaagaaaggggaaaaaagagaagaaaaagaaaaaggaaaaaacttaaatgggtcccatttatcagtcaaaataataccatgtcatgtccgtgtagcatgctacatcaatgccacgtaggatcctgaaggggttgtgtcgatttgggacctagataacacactataacaagttctgggacttggatatgcattttgatagtttagggacctagatgacatacacttacaagtttaaggaccgcctgtacacttttctcatatatatatatataatcattaacttctaaataaatatgagcaatactagaaagttttacaatctaaaacggagggagtattattttttcgtttgtaaatatgttgaggatgagccagattgtacaacataaaaatttatgctagacttgttagtactatcgctaaaatgcagccacgcccagcagccagcactacaagcgtgcaagccctataccgtgatagaccagcaatgtgatattctttgactttataaaaccaacggcataaatagtgtacaaacattttctttttctgtaagaagaaaaagtgaaaacccaaacactgaaagacacccgatccctctggaaacaaaacgacgaaaccctgacgcgactgtcggccgtggccccaccgcccacacccccatctccgctccacgtggagtccagctggttcatcctcccccgcgcatcacatccacttgatgacacccacgctacacgtggacccccactccgggtcaagatccactacgtaccccaccccctcccactgacgtctggggcccacgcacctggccccacccgtcagtgtgatggcccgcccccgtcgcgtgcgatagatacgaccgatgcgaggcgagaagagttcgagttcgagcgcgagagagcacgatacgaaacgaacacgcggagagagagagagagagagagaggaggaggaggagacgacgcggcgatcggcgagaccggaatccggcggcgacgccacccatctcccccgccgccgttggccgcggctagaagtagtggggggggggggggggctcgccggcgcgcgggcatcggcatcggcgtgagtagatcgtatcgtgcgagtggtggatcggaggagggtgatcgcgatttgtgaggaggggggggggggggggttgggatttggatttggatcgtggggatcagggggaggaggagatgggggtgctgtcgaggccggaggaggtgttgccgctggtgaagctgcgggtggcggcggggcggatcaagcggcagatcccgccggaggagcactgggccttcgcctacaccatgctgcagagggtctcccggagcttcgcgctcgtcatccagcagctcggccccgacctccgcaatgccgtcagtatccaccacctgttcctcctcctccccctcctcccatctgctgttcccgaattctcatgtgtttttacggtctcccgtgctcgaggagattctgatggccgttgtgctgattccgcaggtgtgcatcttctatctcgtgctccgagccctcgacactgttggtcagcaatttctctgaactactttgtacttttcaattgctttttgactttaccacgatttggtgatttggtgaatttttcttttcaaacaaagtggtttgtggcgccttttgaattattgaattacccatggtttttgtgttttcctttatcgacttacatactatgtttttttttttcatgggtgcgtgcagaggacgacactagcattcctgccgcggtgaaggtgccgatccttaaggaattccatcggcatatctacaaccgcgactggcattattcatgtacggtatcgctccactaaatatgctgttctcaggctgagcaggatggcggcttttttgtgttttgttaatcggagtttgattggtttgatgtgaccttgcaggtggaacaaaagactacaaattactgatggataagtttcgccttgtctccacggctttcttggagcttggtcaagggtaaattcagttccgagtcttctgaatgttttccttgtctgacttttcttggttcctagtacttcgcgacttgacatctttgaggcttctcatatattggcgttttctcaaattctttggacgcatgccatttctcaaattgtatattggcgtagtctcaaattctttggacgcgtcagtccagatattcatatccatgaaactacttcaagacttttctacataatgtggcgttcacttggtagtagtagctagctgagaaaccatcctgcatggtcagactcaaatggtgaaataaaaagctgatcatgatatttacacagtaagatgatttgtacgatgataattgctatgaattagcaaacaagcatcctacagaaaaacaggggactacacaaacttgaacggcagttatattcgtgaaccctatgaaccgtgttcttttgattgtttttgttagaacttcttcaatcctgttaatgttaagtattcttcacactcgattatatttggtcatatttatattatttcgacgaggagcagaccaaattttgttggaataacggagagcatgtgttcagccgtttctgaatgtaaaattgcattttactttggttgcccatatccccggatacttgcatcactcaatattctgatatactcttttctttcttagttatcaagaggcaattgaagaaatcactaggctaatgggagcaggaatggcaaaatttatctgcaaggaggtatgttgttaatatagccatcaaaacatctaagcaaacataattttgaaataaatgttttggtgcaatgttcttaacataaggagatcacaaggtcattttattcaaaaaccagtatttaattttagtgtgaggcgatgaccttgtactctttttttttttctggtttccatatcagcagtagatggtaaggcctatgtctcatcacttattagaaatgtctgccctgtatatggtactatccgtgcatattcttttctggctcaaaaaatagggtacagtccatggtgtgtttcggtaacttcatgcttggtaggagtgttactgtgaattttgaccaaagagaatgacaaaagcctgtgtgcttgtgtccatatacttttccacgctattcctaagtcctaaggtatctagtgaatagccagtggccactatatatcgtgcttaaaagaacaaatgtttttactggtattcaagtgatgaccaaaggctataacagatggtcatatgcttcatgcaaccttgacatgcttttatgccttcttttcagttccatgtccagtttttggctgtcctatcagtaagtggttgtacttttggtttcctccatatgaaagatgttatctaccttgtggccatttgtagtctcacagaatatactatgaaatgcctgatctgaaacaataacaaagacacaatattctcttcaaaattgtgataaatcttttcgatggtatctagtgtccaccctcaattggctacattattacgtggatctgaactttattagattccctcatatttccatgggatatgcttagacatgttttagttgcatctagtaaaattagggagtaaacgattaattgcaatatagtttgtcattagttttcaagaacaaaaaggagtttgtagcatatgtattgatgaaatgctgatttaatactgtttttaactaacatgaaacaactttgtttacataggttgaaactgttgatgactacaatgagtactgtcactatgtagcagggctagtggggtatgggctttccaggctctttcatgctggtgggacggaagatctggcttcagattcactttcaaattcaatgggcttgtttctgcaggttttttgttgattttgttgaatcagttatgtgcacttacagtttctaattgttgttagtaaccaatatctggacttacactgcagaaaatcaatataattagggattatttggaggacataaacgagataccaaagtcacgtatgttctggcctcgagaaatatggagtaaatatgtcaataaactcgaggtatactgtccatgtatcttcttttttcttactgagtactacctccgtcccaaaatacttgtcgttctaggttatttagcatgtactaaggtttgaagacaaagactataataccccttaattaataatgcatagttggatgtggaatgatggttgggggtataatggggagaaatttgaattggaagtggttgatatgacaagtagtattttaaagtgacaactattttgggacaagtattgtgggacggaggaagtagctttaaatttattcgaaatgattaaattgtcaccacaattgacaagagatgccatttgaagtgttaaatccaactgtcaataaccaaataatataaattcatttattatgctggaaagtccactacagttttatctattttctgtgtgtaataatacacatttttttataaaatcaggatttgaaatacgaggaaaattcagaaaaggcagttcagtgtttgaatgatatggtgactaacgctctgtctcatgctgaagactgcctccaatacatgtcagcattgaaggatcatgccattttccgtttttgtgcaatacctcaggtatatgttaatcttttatagtaccaaatttttgaaccaatgcaaattgtgccagtctgtgtcaaatattaacagtttatgatattctcttgtgcttgcttgcagtatataatgataacttttatattggccatgaagtttagttaagctattgctagtgtacacctattgctagtgtacacgtctaggaaattttactcttttttttaaaatatctgtatgtaatgctgattgtaatgcctagggtccaggtatggatctaagcccaactcatctacttgaaccacacatctgagtgacggttaaccgggaatttattctaccagactactacttataagctggtgcacatggagccagctagccgaggtggtactgagcaagcgttttcaggctatgctagctagcgtactcttctgctatcgatgaaaccgaaagaaaataccagtgctctttcatatagatcgagatgcagtaagacaggctttctcgaagtagggttgtaccattagaaatagttaggctaggtccttgacccctaccttttctgagattcatggaatcatcacattaattacgcacgaatcagaatggggcctatctatattccaagtagtacccctcgtccagtgaagtcatgaggctagcccccctgaatgaagtagcggagccctctgcccacaacgctttagctaatacacagaaatgcatacctttatttttctgtaattcaatgactgcatgcattgctcggtgaatgtgaagaactaggctgttgtcgcggcaataatgaggcaatctaaaaaactagctacaggcttgcttgctgctgctgctgctcctgctcctgctcctgcatttgctgtcgtgtttactagctagcgctattgctgctgtgctcacatgtggcccaaggccagatggctgttctgcttgctgctcacttgcgcctacgctaactagcttgctcattgctgcctgcttacttgctcttcttctctatcttttccccttcatctctatttttttcctaattattctggggcgtcacagactcacagtaatttactgctatagcaaatctttgtaccatatctgtggtaaagaggagccagctatttgaattggtttgtttattagttcatgtttgatcactgttgacatgctaaatcttgggccaatgatagttgatatttgttggcagttgggtagcattcctcgttggttgaagctgttaattgacctaacattttgtgtttgagtattatacacttctattcttgtaatatgtttggtatgtattattttggaacaaactttaggatactaatacatcattccatcttttcagataatggcaattgggacatgtgctatttgctacaataatgtgaatgtctttagaggagttgttaagatgaggcgtggtaagattacataagacatactaagtaaattcaaattgcagtaacctctctttactttgaggagaatagttattttatctccatgaccaccttgtcagagtttgcttaatggaattcaatatggataggctatccggttctcttcttttgtatggttaatttaagagtaattgtatttatttactcagttgtcagaaattgatcaatgtgcaacaataatcctattggttacacaatggagtgctcctgtgttcattgtcacaagttggcatcattgtaacttgtgtcagttttgttgattagtgtatcataagatttcaccacttcattgctggcatttctttgtcccttttggtttagacaaagaatggtgatttgttgagtaagatgactagatgagtatctttagaattattgtatgctttgttttttgggcacatggctccatatctcagtagaacagctataatttagttagcagaaggtgcaactataatttatatatatttatcactgaatttgcatagtagtaataatttccttaagcaactttattttgttttgtcacctttatctattataaactaagtacatctgctccagtctctagttacctttatgttctctcacctcaggaaattaacatgttctctcagggctcactgcacgagtaattgatgagacaaacacaatgtcagatgtctatactgctttctatgagttctcttcgctgatagaatcgaaggtaaggaccatgatctttgctaccatgaatgtagggtggctgtcgctcatttcttccatatagataataagacactcaaatatttcattttttacaatagattgctatccatcaattgtattgcacaaaaatcttcactcagtataattattttttgttaatatgtaaacatttcttttgaacttgttctttgagccacttttgcattaaatgttgtgttgatttaaggatcatgaaattattttagtcttcagcagaatgttctaaacagcaaatataggatgtgcactgttatttctggccttcaaaggctaccttagttgtcctgctcaagagtgtatgatgttttacccacatgtccagattgataataatgatccaaatgcttccctaacgcggaaacgtgttgatgcgataaagagaacctgcaagtcatcttgctcactaaagagaaggtttgttggttgattctgatttagtgttccatttatttctgttggcatttctcatccctaccgatcatcttaattatgcaggggatacgatttggagaagtcaaagtacaactccatgctggtgagaataatatataaaccttaaatccttttagtgattctgtttctatttatctttctcaaactgtttctgtgacttgctcagataatggttgtacttctgttggtggctattgttttgggcatgatatatgccaagtgattcgtcctaggtggtccattgccctcaactagacaatctatgcgcatcaggtatgtcaaatggtttcaacaattttacctgttctatttcgttttaaaatttgaaacagggaagggcctgctgaatttgatcatgaagtgaatttgatatccagatttcttatcagcgccaactccaaagcacatgcagcaattataagtactgactgactgcaagaatagactgtacttctatgaagttggatctcttcacctatctgttcaccctaaaccttttcatggtttataagaatgcgggttgtttcttgcaaaattttgggtagaatggtgcaaaaaagaatttgttcgataatgaagatagctgtggttttgttagcttgtgttatattgatgtaatttaagatcatgcgagtgtttattttcccggcgacattcttttgtttattcattatatgcagtatccatttatcttggctctcacctgcctgatgaaaaacatgtatgtttatccataccatatgtaacaccgtcgaatgttaatcacttctgcgtaacaatgcaaatgtgccaaaactagtatagaagtattccggtcaaaaatgaaagaacattaataaacaaaagaaaaaaaacatctggccagtaatgcctcgtccgaaactagtaaactacgcgaaacaatcaactgaaaaggacaggtgaatcagccaaccaagactattgccagtaaacgagaaagccagtgcagtaacaaccatccataaattgaaggtaaacgggcgcattttccagcaccatgccaaccaggctgattacaaatcccaacacatcagatgttttcagggaaatcaatagaatatgatcgttgctcgcgacagccgggaatcagtatcagtcccacgaactagttgagccttgaccaccaccatagccaccgccatatccaccgccccctccataaccgccgcctccatagccaccaccgccaccaccataaccgccgccgcctccacccctattgtcgcggcggaagtcacggccaccaaaacgggcaccgcctgatcggcggtttctgccaccaccacctccgaacgaagaacgggccgagtatcgttcaagccattgaggaacctcctggtttgcttcctgcattagctcacataacggcctcgccagggatagattgccctcgttgaaaaatgcagttgccaagccagacttccctgctcgtcctgttcgtccgatacgatgaacatagtcatctatgtcatttgggaggtcaaaattgatgacatgggcaacatgaggtatgtcaagtccacgggcagctacatcagtcgcaacaaggatgggtgttgctccactcttgaatgatctaagcgcgtactctctttcctgggaataccaagcatacagagataacaaagatgttacatttcagcagacctaaggcatcaacaaggtgccataca

SEQ ID NO: 443 - DNA, 8023 bp, Oryza sativa
aagttcattttcttctaccctttgcatgtatatatgctaaatactggagttcagagtctgaacatttctgctgtagtttacaatgactaagctaataacctttggactgtcaaaattcagaagaaagtcaggtgagtcatctggtaagaactgaactttggctctatttgccaagagatcaaaaagaaacagtcatcacagaatgacagaaacataaagagacactaaaattaaggagaggcatgcaggcaaccaatatgaactttgacccataatagctgcatctaatcacaaggtccaagacatggtcacatgtgtgtaggcccttctctcaaatataacatgcacacactaccttgtgctctctttcccataattttgttgcaccacacacaaaaaaatttcacactcctataagtccacaccacatctcccccctctctctccctaaaaaaaattctctctatatctaaaaagaagtttctccttttgtcttcctctaaacaaattctctcttaagctttctctccataaaaagcatttatctctttcctcaaaaaaaaatctttctttctctccctaaatttttttctccatttctctatctaaagggttcacgtcctctaccataatctaccattacagacactgacgtgtgagacaatagtagagttggactcacataccataccaatgactataatggtagtgatattatgatagaggatcctcacccctgtctaaaaagtttctctctttgtccgactaaaaaagtttccacatgcttatgatgagatgtatataacacatagagaccaagaaggagctcacctctgcaaaaacagtagcttgcacacatacaagaacacacacacacacacaccaaagctgaataagctgagaactaggccagagtgcatgcatgcatggatcatctaacaatgacgtccacgtcgtctgaaaatgcgcccgaccacgaccacgaccacgacgcctcttcgccggcgccggcgacggcgacggcggcggcgctgccaccgatgatcccggcgtgcgacccgcacgacgggccggcgtgcctggagctcatcgaggtgctgaccacgcgcgccgccgccgtccagcggcgcgtcctcgccgaggtcctcgccatgaacaccggcaccgactacctccgccggtttctcggcgacgaggtcgtcgccgccgccggcggcgaggacgagctcgccgcggcgttcaaggagcgcgtgccggtggtggagtacgaggacgtgaagccgtacatcgagcgcatcgccaacggcgccccgtcgtcgctcatctcctccaagcccatcaccgagctcctcacgaggtaagctcaagctcgatcgatctcgatctcgccatggctaacctcacaatttgacacaatcactcggtcgatcatggcgatgtgcgccgcagctccggcacgtcaggcgggcagccgaagctgatgccggcgacggaggaggagctcgaccgcaagaccttcctctacaacctcctcgtccccgtcatgaacaagtgagtctctctcgctggcttcgccatcgatcgccatggatgctgacatggaggtgcaggtacgtggaggggctggacgaggggagggggatgtacctgctgttcgtgaagccggagatcacgacggcgtcggggatggtggcgaggccggtgctgacgagctactacaagagccgccacttccggcggcggccggacagcccgtacacgcggtacacgagccccgacgcggcgatcctctgcccggacagccgccagagcatgtacgcgcagctgctctgcggcctcgcccgccgcggcgaggtgctccgcgtcggcgccgtcttcgcctccgccttcctccgcgccgtcaagttcctcgagggccactggcgcgccctctgcgccgacatccgcgccggccgcgccgacccggccgtcgtcaccgacgccgcctgccgcggcgccgtcgacgccgtcctcgccgcccgcgccgaccccgacctcgccgacgccatcgccgccgagtgtggcggcgcgtcgtggcggggcatcgtgcggcggctgtggccgcggaccaagtacatcgacgtgatcgtgacggggtccatggcgcagtacatcccgctgctggagttctacggcggcgggctgccgctggtgtcgacgatgtacgcgtcgtcggagtcctacttcggcatcaacctccggccgctggacccgccggaggaggtggtgtacacgctgctgcccaacatgtgctactacgagttcatcaaggtggagaaggacggcgacggcgagaaggtccgcgacggcgaggtggtggacctcgtcggcgtcgaggtcggcgcctactacgagctcgtcgtcaccaccttcacaggtgagcgcgtgtgcagcccgttcgatttctttcccacctcctgcatgggtttatcaacgccgtccgatcgcaaaatcaacggctgagattggttgagcccgtctcacgttaatactacctccatggtatgacgccaacatttaaccatttaacttatttaaaaaagtatataaaatgttatttattttgttgtgacttgtttcaacaaaggaaccataatattaagatatatttttaaatatttatttatattatttttttaataaacgaagtcaaacgctatggaaaagtctaacagcgtcatgcgtaaaaacagaggtaatattatttttccaagtactgttcctcgaattttcttttaccattttcgggtgggtaattttaagtttaaagtgaataaaacataaaaatattaacatgtagcacagttacttaattattgatcaactaattaactgtcgcaaagacggcacggaaactgtagcaacaatacacacagcatgtaggaaccattattcagaaaatcatagctaagatgaagtgcccctataggagaggattagcgatccaaattgggcaaatcttatttatatctcctcgaaataggaggggtgaagtccctttcccagaaaagaagaaatgaattagtgaaaacgtttttctaatgttccataatgaagataataatcatgcaccttgagaaaaaaaatcatcatgtaagttccacctttactaagatacgcgaattgcaaaatgacatcgtacatgagaatgacatgtaggacctgttctacaagtcgatgctaaaatgatggtatttttcagctccgtgttttttgcggtggcacgtaccaaaacaataaaatgaaacttttttgcgatgtgataccattcctggcatgcattgtggtctattcgaaagataagtgcaggtgtcctttagacgaaaaggttatgagtcacctgttctatcttttaacttgtttagatttttgttttggtttttgtggtctccctgttgttcctctaatggtggatacagtcacacactaatgaattctgcttccctaagccacagtacacaagctcgatttttagtttacaacagaagtaacatcacacatcttttcccttgaggctagctacttaatatctaaaagaaggtttaatttaatttcatcgagaaataagagttactagcaagtagtataagctataagctaactgcaagtcgattggttggggagtcagagaattattttcttaggtaccatttttcaaattaatctaattaatccaaggcaatgcatgggtgttaacataaaatagatttttattagcttactgtactttccatttcttttatattgaaggaataagtaaagagcacacttgtttagttgcttatgtttcttgtgatgagatgtggcaagattaaaatattggtaacttgattatttgagtagatttttttcagagtttgaccaaataattaagttatagcttgggattccctactaggccaacggggtatagtgtgtagagtgcttgactcccactgcattatctcctagcttgcctatagcctttcatgtctgcacttaattatacttactttaacccgacatggagacgttggtatcaactacttgctccctctgtgtaatatgtatataatttatatattgggtgatggaaattatatatatcactagaatatttgaaaaatatcttgataattaacatactatctaattacgaaccagtagttatcacaagaaaggatgtagtcacaatatatagttcattgcatacttaattattaagaggggtaaaacaaaaatagttgcaggaaaattaaaaaaatatttgacaacataaacattatatatgtatgatgctatctactactacacgaaaaatggtattagctaaagaaaagataaaaaatgatacgtctagcttttcattgagaaagttcagttgtacagatcactagagaagctgcatggttgatatatgacatatacctcatttgattaatgcagtgcgtagagtgcttgacttccactgcattatctcctagcttgattaaatttactcaaggattcattaattccacccaaatcaaaatgatatatgtgcatcatctgaaaacaatgatatattatgcatggaagaatcaatgatagatgacacaaaaaaaagttgatcgagatgtgacatattaaaacaatatccgatttctttgaccttcctctctcaaccctgcactaccagctgaataaatttattataaatttgcatttccataaaaaaaatggactgtgcacatcatctgatggatccgccatacataaactatgctcctaaataaaagttgtttaatgcaatactgaatcaaatagatagcaattgcacgtggaaaagccctacacaagtgtgtgacctggcacaaagtcaaagtgccaattattgtagcatatgcatggccagtgatgtgtaccaaaatatttcagcaatttaattcagtattaaaatttataaagtcctccgcaaaaaaaaggctaggtagattaaatagttgctaattatcttgaagcatatttattttattttgagtaataagaataaaatatagttattacttcagtgggagaatttttttttttgccagaacttaattaagcaacactgaaactgacttcttgtcaaagtactacctacatctctcaatgtttgacgttggttaatgcaaatttgcagtaaccaatgttaaacaaaaaagaacggagttagtataatttatgtgcctctttatctcagtaaatttcacggattgaaatgtttatgtagtttcattatcccaaaagatagtatgtcacttaaaagaaatttagatagaaaggtgttcttttagagggcccaggctaaaaacacagagcctctgcaccaaaaaggacaggtatcctcagtgggctgaaaaggccgtgctggcattttctttggcccaacaacttcttactcccctacttacattgtcggaatacttagtatattttgttttccaagcattttactaacaactatcacactcctcacataaaaaaaatcacttaaaaaatgccacaacaatcacctaccaaaaaaaatcacgtgttccaaaaaaaaaaggcatataggtacttagtttgtaatgtgaggcccattttgaattttaatatttagcggatcgccatcatggattgtacttactagggatgaattaaatattttgataaacaaacttaaccaatagtttagaacaagcagtataaacaatgcattagaaactctctttttttctgaggaaacatactttttaaaggatggagcaaataatgaaaaatgctatataacataccccgttcggacatgatgatacatcggaggtatcacctgggtatcagctgatacctaccagatatcaggtgatgcctctgaggtatcatcctgttcaaatggggtataagcgatacctgccaggtatcagacgatacttctagaatatcatccctttaaacggaataccgtactatatcattcccccaaataattcgttttaataatccaataataaataattgggttaataattaattgtgtgcagggttgtaccggtacagggtgggggacatcctgcaggtggccgggtttcacaacgcggcgccgcaattccggttcgtgcaccggcgcaacgtcgtcctcagcgtcgacaccgacaagacctccgaggacgacctcctccgcgccgtcaccgctgcgaagcccctcctcgaccccctctcctgcgtcctcgcggagtacaccgcctacgccgacacctcctccatccccggccactacgtcctcttctgggagctcaccccctctccctcgccaccgccgccgccatgccatgacgacgccgacgacgcagccgacatcggcgaggacaaggacaaggtggcacacgtcatggcggcgtgctgcgccgccgtggaggccgggctggactcggtgtaccggcggtgcaggagccgggacaggtcgatcgggccgctggagatccgtgtcgtggcgccgggggcgttcgacgcgctcatggacatgtgcgtgtcgcacggctcgtcggtgaaccagtacaagacgccgcggtgcatcaagcaccccgacgccatcgccgtcctcgagcagcgcgtcgtcggccgcttcttcagcgacgccgtcccgcactgggagcccctcaaggtcgacggcgccgccgccgcccccgccaccggcagcgaccagtgaaatgggagagatagaaggttggaggagtaaaatcacaaaatgcaagtagataattaaaattgatcattgtgtatgtgcctgatcgatcgatgatgtttaatttaattagagggtaagtgtgtcgtcgctctccgtgtttaatcacttaattaattaattctgtacgtgttcagatttacattttgagattattgatcattaattgttaattagggccatgcatgcatagcctgtaattgtgtaatgtcaaacgttgctcattgactccatcgttaaattgttggtcaacctaatacgagcagtgttctttatgaatcaatactttctagcattgtctacatttatatacttcctccgttgaagttttagagttggacacggttattaagaaagtagatataagtgaatgctgaggattgtgattggattagtagcgaaggtaggtgagaaaagtgaatggtggaaagttgtaattggttgggaagaggtggtgaagttgttatattttaggacaaatctaagggtgttatattttaggacggagggagtagatgttaatgaggcaacgctagaaaatcttataatatgaaacggatgaagcactttttaaatgttgaaatagaaaattatttttaaataatttaataaaaaagtaaaataaaaaaatccacattttcatatgcccaacggatctaaccattgcggattaatgcccagttcatgttaaaaaccaatcggttcaaccagctcactggctcacaaagtttgcactggtcttggtttttgcttgttgagccacaagttcggtccgacgtgtacgtccgattgaacaggtgttgggctttaaaaatgcattatcatagttggccaagatgacaaaccatcgaaatatattttgtgaagtggcaaaataccatatcagtgaagcgtaaatatgtgtagagtacaagttgttctagcttgtcccctttgttgtcaaaaacataccccagcaaatctttgcatttactaaaatttagcaaggtaatggtgcaaagattatcctaaatggcatccactacacgtactctatccatcttaacctcacaaaacattgtaacaccaaaatttaatacggttaatttaggcgtcaaattaaacccccatagacaaatgacaattctttcttccctcctacttcatccgtcctgaaatatagcaataatgtgaatgaattgagcacaaacacatctcggtgctacaaaatttatccagatttataatacgaagtactaagatatgtttaatccaaca

SEQ ID NO: 444 - DNA, 4004 bp, Oryza sativa
aaaaaactattttagatctaattttgaactttataatcgttaaataattattataaatcattcacttatttattcattcagttcgatttttcctttgttataacacggcagatgtaaacacaccactaaacacatagcaccacactcatatatccgcaaattcctctaaaaggctaaaacacactagaaaggacgaaaccaacgacacattcttaatctcattaaaattctatgaaagcccccttgcttgtgaccaatattcaggtacagaatcaatgatgtacatccacatcaccttaaccttcttagatttaccgctctaacatcccacataccggattaaagtcatcatttaaaagtgtattgcggggattgaactaaatcctgatttggtattgacacaaacatatacgaaaaagaacatattggacatcacgttgtaagctcgatgtcaatgaattaagttttctgtaaacgtcagtctgtcatctttaaagcacacagcacagtaaagatacttcctctcttttagaaaaaaggcaaatcctgactacgtatctaaagataatacatgcctaaatatatagcaaggatttgtcttttttgacgcggagttagtaagtctcgagagaaggaagaaacgtccaaaggttttccgattagctatacaaggtggtgagctagatgacctaaatttaaagcctcatctcttttaattatttgatattaggtatttctctaatattcgtgtcttttttaagtcttataatagaaggtaaaacattaattccgtagaagaaaaagtagaattttgatatcctacgaggccatgagtcacatgagtaagacgctcggtcacgtaagcacgggggcgtcagccgcgtcactgctgatgccaacttgctgtcgtagtgagcacaatcggtcaagtcaatgggggagaatgccaaaatctcctttgtgggcttaatttatatgtggatcaccattatcctcgcacaaagttcacgttttggtccccctcctgttcggcgacgggcgacgtacggcgccactataagaaacgtgccctattgctgtcacgccgtacttcctcccgcccaccgggcagctagcttagctgccgccatggacgacgacggcgacggctcatcgtcaccgaccgacgacagcgccgccgccgggcttttgccgctcttcagccgatcgccggtctgtccgtccatcgatatgatcgatcgatctttgcgtgtcgtcgtcaatggctgatttggattgttggttgttaattcgaacatgtgtgatgtgattgcgcgtgggtgtggtggctggggagtgtgtacaggccgaggatcttgaggagaagctgaggcgggcgatggaggagaacgcgcggctgacgcgagcgctcgacgccattctggccggtcaccacgcccaccagcgcgcgctcttggcgccgtcgctgtcgccgccgccgccttccgccacagcaagggcgccgagcgtgtccaccagctgcgcggcgagggaggacgccgcaccggcggtcgccgccgccgccgcgtcgacggcatgtccgtcgagacagcagccgccgaccgcggagccacggcccaaggtcaggacggtccgcgtgcgcgccgacgccgccgacgccaccgacgccaacagcatggtaaaactcgatcgaacactttgaatgcattgccatggcgctcgatttcgagcatgatctggactgaatcttttccccttcctggcatcgccaggcggagaccgtgaaggatgggtaccaatggaggaagtacgggcagaaggtgacgcgtgacaacccctaccctagagcttacttccgctgcgcattcgcgccgtcttgccccgtcaagaagaaggtacagaagcaagagaaatgaacataacagaaaatgattgcattttttcgagtaatcttactatgcgcacgaggtttcaaattttacaataaaaaatttaattgcctttctggttatataatttttcaaatttcaatttacaatgaaccgaaattaccgacagctccctctcttaggagtgacgaattttcagagttgttaaaaaaagttacaagcttacccgtaaaaagcatatgttaaacaacctatggtaaacggatcctcgtgtacggggtatcaaccttaaaatctcgggttatttgtggctttgacttagatttcttcttagcttaaaaaaggctgtggggatacatttttccccatccatcgagtttttattataagttttatttccgaaaacatgtacgccctccgtctccaaaataaaaacagtatagaaggggatgtgacccttatgttggttttttttagaacggagggagttcagtttattgctgaattttgacctcgggctctatgttatatgtagctccaaagatgtgcggaggataggtcaatgctagtggcgacctacgagggagaacacaaccatgccctgtccacgcagacaaccgaattcgtcgccagcggctgcactacgagccagcacgccggggggtcgtcgtcgtcgccgctgccgtgctccatctccatcaactcgtcgggccgcacgatcacactcgacctgacgaaccaagcagggtccggatcgatcgcgagctgcggcgtcgaggcggccgccgtctccggcgagctcgtcacggtgctctcgccggagttgaggaggcacctcgtggaggaggtggtgcaagtgctcaagaacgacgccgagttcgtggaggccgtgaccaacgccgtggccgctagagttgtggatcaaatcccacacattcctgttcatttgtagttgttttttttttctctttgagaacgttgatttgtagtttgtaggcagtatatatatcccaaaatgcttgcaagtatatgtacacatgtattcgcaaatgtgagtatatacctatgccgcttttgctatacgtcagttgcctaatagttttattgcttttctatttagcgatccccgaacacactttttatttgttagcgagctaaacttatataatgtataaattattaaatattgcaatacgtaaatctataatcttagtataaatttgtcgcaacttttaatatgaattattgtgtagggaaaaattttagcatcaagattgaaatggaaccaatatataccaccaaaactttattaatgtccttaacaaattaaaaacattccataggcttttaacaccgtaacctcacaaaacttctaaaacacactactctgttccctttatccataaatataagaatttataatgtttattttaatagagatggaaaactagatagttgtgattggttcaaataagtgagtaggtgaagaagtttcaatttctaggataaatttttaagcattagaagttattatattttaacattttagaaagtactatgtaaaatatggccatgtgtatcctatttagtagaaagatcagaatttactacccacaataaaaaccaaatttccacatactttaattttatttctacagacagatcataaaggaaatcccgtttgagataatagcgagtgcgcccaagggcagcccatatatatcaagtcaaggttattaatgtgaatacccaaaatttttgataaaaaaacatatatacaatatgtgatgtgtatgtgcatgaaaatgacaaaaagtaggttgtattcaacccaagaggcattattcaacacataatatatacgctatatattatataattaatactatgtgatacttcctccgtgccacaatgtaagactttctagtattacccacattcatatagatgctaatgaaatatctacattcattagcatctatacaaatgtgggcaatgctagaaagtcttacattgtgaaacggagggagtaatacatgtcaaatattagccttttggtagtattttcttttaccccttcacatttaataaaaaacatcaaactcctagacttgc

SEQ ID NO: 445 - DNA, 3303 bp, Oryza sativa
ttttagtaaagttttgcactaaaaaacttttccaaagaacactaaaaagtgacatgagtgtgatgcaatatcacaccaaatttggtgtaacactagctgtttccggttaactgtttgcgtcaaataaagagtaaaccgtccggtttgaactttgaagagcgccgcgtgaagaagtcaaatgtcgttgctctttgttttagtcaaatgtagttcgtctcccacatcttactgtcataaatataatattaatctatcactagtatagttgtaccaaaaatgttggctccttgcatttagctttgtttatttgactgtggaaacttgaaatagtcttcttttataatagtcatgcaccgtctcagacctcttattagtcctaaattacctccaccttttcaatatgaataactgttcaaaagctttgagtggtaatacatacatttccgcatttagattcttattcctctctttaatcatggttgatggttgcatacccaaccaaaaaaacaggtaaatatcagacgaatatttttcttttaggctgttttagaatttattttaccatcgagcaaggtcgaaccattaaattgtttctttagacaaagcaagtctaaaactagccaacgttttattttacatatatcacctaatttaagtgatggctcaattttctaatgtaaaagtaagaagaagaaaaacgttttcgaaatgaattgatcttgtagatagatatttccgaagatgctttccaaatcaatattggttagttgttatagactttctttctttttttgtcaactggttagttgttataagttataactatctatctatcttaaagtaaaccgaaacgtgtaccatacgagtaccatccatgacaacgaccagaaaccacagaaactctagaatattttgtaaggcggcatcagtactagtaaactaagtaatgaaggaaaagtcttatagccgacctcttcttcattttaccaacaccacttgcacacacacacacgtgtactaggtcaaaccaaacgtgccctaattattttcctctctttacccccaaaaaaacatctagatactttcatcacaactttggtccgcatattaaaaagagttttagaaaaatatagtaattatctaatcgccaccttcactcttcacactttcctaccacttgtcacgcaacttccttctccacactccacctactactatatatttacacacactttcattacttcttcttcagcaattaaacaatttcttcactgcaattcacaagcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacatattttacaaacgcgttgagtcttttttttatctgaataagcataaagtgacaccactacaactctgtttttggttctgtttttttcaaaaaatttataacacaattaagcataatcaagaacgttctagtttctactaccatccacatattgttctttcttatattttggaaagctctaagcaaataaaaagagttgtgatatcttacggaagactgccaaagaaaactcaactttcatttttcttttaccaaaagaataccgtaactttcaattgaaaaaagcctttcttgacgggtcgtttgttttctttagtagcactgtttaattaacgtagataatcccttctttaatttggtgaattatctacgggaagtccaaaactcaatggtcataaacgtgtatcaaaattcatctaaaagttaattaatttttttttgcaaaagtctgatgctaatatgaataactgtttaagaactccaacattatattcaagaaaaataaattttgatatacaagaacaagcccagttaccgaaaagaagaacagaacggcgcgcagtgttttatccaaaagaaacaactaccgaaaagaagatcaacagaacggcgcgcagtgttttatcaaaaagaaaaaacgacacggtgttctcgcagaatctccctttatataaaaacttgcggaatttggaatcttattggatacaacaaatcgtttccttgaaaattccctcttcgttttgagctattgacgtttggtaccgcgagattcctccatggatctctccattgtcaagctcctcgaagaagacgaagaggttaggtttcgaatttcccactctcattttcatttccgtactgtctgcgaaaatccacgcgctatcttgttctgtggacgaagctcctaaatgtcgattcccgctaatcgtgtcgttaggttgactctaagcattcggaagatgacttgcaaatgtttcaggactctctgattcgagatattgaaggttcgttttggaccctaaaattcatatgcgaaactgtggaatgtatcaaaacagggaaatgcctttagatttctttagtgatttaggttcacgagtcgtatttttgtggtttgtcatgtatcttcatg

SEQ ID NO: 446 - DNA, 4443 bp, Oryza sativa
accacttttgagaatatcatacgtatgattcattgtgaatctccacattcttcttgcatcataaatatgttagaaatacatatttcaatcgattaaatatgcaaaccctgttggtgacggtggtgttcatttctactgaagataaaaatgaagttagagtcttacgtaaaaagaaaaaagataaagttagggcattaaaaaacaataaaactgttagggcgtgattaattaagtttttattactatgaacttgagaaataaattaatttggtattttaaaacaacttctataaataaagttttcatatgaaaataccatttagcaatttaaaaatatatttatacaaattgatataaaatctatatgttaataaagaaagacccattgtggaccaatgaagtgagtatacataatccttaaaaaaaatcaatggggtaaaaagtcctggagacaataaactattgaactgttggaagagtacatcaaagcactataaccctacccaagaaaaagatctaaaatactgtcccctcagaaaaacaaaatctaaaatactgtagtatccaattacacggtgtaaagctcgctacagttcgatgtgggccctgcggttcctccccccaccaaaaaaattccaaaaataaaacaaaaaatccctccaccgacatgtgggccccaccacgcacgacgggctcctcctctgtggacccgttcccacgccgaaacccggacacccaatccgccgcaacggctcgcaaccgcgttcccaccgcgggcactgacacctgggccccacccgcagtgacacgtcgacgcggcgccctcgtctcgtgtgatccacacgactccagaatcacgtctaattacttattaattaattgatttaattaaattaatccgaaccctgcgagattatggagcgggattattaaagaaagtgccatgtggatatttggaaggcgtggcggcatgtgcccctttatttaagcggccacgcaaaaataaaccaaccgcgtcgtcgtcctcctccaccttcccctccctcagcctcgtcgtcgtcccccccaaaaaaacgcgaagagagagagaaagcgagatagagagagagagagagaatcctccggtgaggaaaagtcccgtgcccttctcgcctcgcaggttggtgcgcccctctcctcgttcatcttcttcccccagatccgatcggcggtggcggtggcggtggcggtggccgatctgagccatccgccaccgcgggttcgtcgggtggttggcttgattttttttatttttttgggggtttttttggggggagggggttattgggagatcgggatgggtgtggttggatctgtgattgttgttgttgttgttgataggggttgcttgcttgcgatttgattgtgtgttcggaggttgaccttatggttatcgattttgctgtgatttgattgcttccaaatttgctgcgatttgatttgattctaagatgtagtcatgtaggggagatgatttttttttttttactttttgagccaatcagcatagggaggagtgggagacatagaattctctcgcttatgaggaaaattggatgtggcatgttgctcccagccttatctcaatcgtgtgaacctccatgagaggtgagggaagctacgccaacgattgatacacggtttctgtgtgctttgcctttgcgcggagattgataaaggattaaagggatcaacctttcttgccgtgcatggcaaatcagcgattgattatattctggggggatagcgccatgggatttcttgataagcctgtaaaaaaaaaaaagaagaaaaggtcagccgccttttggatattagggattgcgggaagctagagagaggtttcttggattgtaggcacatccggatgggatgaattgaggacgtaggttgcttccgcggtttgcataagttatcgtggagtgaacaatccagcaaagtctatgatttgtctgaggctgtgagcaatatagatggacgaacgatgaggtagaagaacattggttctgcctaatgatctgctcatatagcagaacgattgtagcgcggagtttcaggtatttcgtcactgctgattttgctctgcaggaatcaaaagcagagaagaccgttggtttctatgtgtttcccattgtagtgttttaagaattgctcagcttttggagggatactactataatactaggacatagcctctcgggagaatcatataacctgctgtttttcaatgtttgaaatcggctacctaacattgccatctccatctgcttgcgaacacaatccttagctgtatgaaattatgaaattttatcaattccctggtttgatggtctcttgaatttggttggctagaacaatatttattagaattttgttaacctgggatgtatccagtgacacatttggctgtcctactgcgcaatgctgatacatgctatatcttttgcaaattaatttgagagctgaaacaataaaaaacagattatatcacctaattaaatgaaactgaaaatggtacagatccttttcatgataccgatccctagttcccccacccatttgcagcctgttttcttgcatatggtgttttacttatttcctattctaaaaatgtaattttcatccacatttactcataatttgttttgcacgtacagcctgccggtagcaatggcacaagaaagctggaaaaatgagtctgaggagactgtccacacaccggaggccccaatattgtgtgtaaacaactgtggcttcttcggcagtagcatgacgaacaatatgtgttcgaagtgctacagggactttgtgaaggtcacgacaatggctgccccagtagtggagaagaaggcatttacgccagcatcgtcttcgaagacaccattggagccagcaaagccagatgaagttcctgccgcagctgtagaggataagcaagcggcacaggagcctccaaagccacccagcaaccgatgcctgtcatgccgtaagaaggttggtctgactggcttccagtgccgatgcggaggtaccttctgctcaacacaccgttataccgaagctcacgactgcaccttcgactacaagaaggccggccgggatcagattgccaagcagaatcctgttgtgatagccgagaagatcaacaagatctgattgaaggttatggaagggccatttaatctctattcatggtggcaaccgagtcttcaagtttacttcagccagtaggttccttcaggtctgggttagtgtgctaggagtcccaattgtgtctatccttcctccttatcatggtttcattctctggcaattaaggaataataatgtaaatatatattatattcttaactatatttccatcttattgcttattgttacagccttgatgctctattttcatccttcgttttgactcacaagaattttgtgatgatgattccttgttgatggcttgatcttaacgagtggtttgttgcatgttaaaaagattaattagaggtgatgaaaccttgctactgcagcctatttcctggaagttccattcaggatttttatactatttgatagtggtattgaaaggatggcggcttgtgctatcctggaaaagatgccgtggtttcatatcgcttcttctgaaagttgatgagcccatgggcagttgtccaagatgataagataggattgtatatgaggtcccaaatggtattgacaggtcacctgtttttatgttatcatcacttgtgtgctgaatgttgcactagggaattatctattgctaagtatgcttatgaagttgtataggagtacaagataagcactgaaatgcctagtctgatttttttgcaaggtacttgtcacacatgtcatgtgaaattgttatcatcggtctcataaaagaaaatattctctcatgctgtcaaactcatgcaaaaagtttgttgatggctatgagcagtgtagttgaagagttcttcagtggctaaatgacatcccaaagaaacatgacatctgaatcgaccaaaatagatgcccacccaatgggcagctgacactggtcaggtggatggattaacctagtggtaagatggtatctaccttactttgggcaagaaacaaagatgagcgtactgtgttgtaatagatttttcacgaatgctgtcgcaggtcacagccatggcaaacaaacaaaaaaaatgaacagtatctcaacagtcacaaatcttgcacataaaagggacagtatgaggggcaatcgatattgaccccttcttgatttttgcaatatacgactatcactggaactctaagtaattgggttgcttccatccctgacgaagactatcgtaagcaacattgctagttgttgcttggcttatcagccacagcacaaaaaaaaagaga

SEQ ID NO: 447 - DNA, 2961 bp, Oryza sativa
gaaatacacgtatgcggaaaaagaaaatcaactgaaacaacaggaggaacaattaaatttcaattcgttccggaattttatatgcctcgccacacgtacaggcgaagtggtcgttgtcccacacgcctcacgccccgtgcgtggcgccgcacgcgtcacgtccgccgccgcgcgggttcgccggttcgcatgctcctctcgccgacgtggtctacacggccgccgcgcgctacactatcctttcttccagtagatttattcccacgatcaaacgcgcgaatatttatcagtacacgatacactagcttagctcgatcgggtgtccatgacgacttgttgcaccgtccactgacgtgacggaatggccagtgcgtgcactttcgattcgtcaagatatgtacgtacagttaccagatagatggtcaatgtacgcacacgattaagcgagatggacagccaagtgggatgactggacggatactcatcaactcgtgacgaatatccgtatcctgcccgtgagcacacggagagtagtgtagtgttcctttttcgctcgcacacaactgccaggtgacgtcgcggcaaacgtttccgtttcccacttgctgatatattctcctgcactctgttggagccagtcgaaaacggaagctccaggagaagattttttttaaaaaaaaattgaaacggcggctgcagaagcgagttcctgaagttgacgaggcttgtgaatgatcggcttctggaaagcgcgcaaaagcaagcaaacttttagcccaaccgataaaccatgtgtgcgcgaccgagcgcttcgttgcgttccgacccgagtcggggcacgccacgggtgcacatacgtgatgcacacgtacgcgagcagcgcgaccgcgtcacgtttcttcgtggccaagcctggcgcgctagctacctcctaccgctacctcgctcgctcatgcggcttgcttgcttggctctagttagtagtttggcgcccgcgcgcaccaaccttgacgtgaacgactctatcacacctcattagcgcatattaaccgcgtactctctatatataaaacgagtacgtccgccaacgtgaagggaatttttagctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaattgttttgcatccttgaaaaatccttgtttccatgatcgtaataggaagtgttctttcccaacccgcaagaaagtaagaaacggtcgatcagagaggaaaaagtgcgaaaacgctaatccatggttccattccatggaggaggtcaacatttccaggcgtatctggacctcctagaagtccaatcgtattagtctgggctgtgaaccgatctattacaaaccgtgtgggctgtgagcccaagtcaccaactcatattttgtcacttgggctagactatgtaacactgacgcgagcccaatacactagaagtccaagattttgatcagtgcttgtattcctaatagattacttgcacactctccagaaatagttctttagtacataaatgatgcattcattctccagaaaatgatataacccaagacaccagacagtggtcagaggctagtcactagaggcatatacagaacataattaatggctaacatataggagtatcaatttcggaattatcatcccgtacaataggtagtatgagatcaccacaccggcgcaagcctgaacccaagcccaaactcctcatcccccgtgccttttgctcccgtactgcccgttcccgccggagatgaggtaggcgccgccgtccttcttgcccctgggcctccgcgggatgcatctgtcgtgcatgtccacggcctccgtcgacggctccaccttctgcaccctgccatgccgcgaggcagagatagcataccatcatatcaccaactcatcatcatcatattctcatcgtactccatgacgccacacagaggcaggctagcctggctagtagtattgggttctttttaagcaacggcgagcgccgtgcagcagcagatatgatgataactacgttatcaggttctgggttagggctctggaccacgcttaaagcagagttcaatgacttcaaattgctgacaaaggctggtgctactgctgctaggagctcgcgtc

SEQ ID NO: 448 - DNA, 3881 bp, Oryza sativa
gatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctcacacttcttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaaca

SEQ ID NO: 449 - DNA, 3323 bp, Oryza sativa
ggccatcgtctagatagaatattttatgacggagaaagtagattagttagtataataatttttattcaatctcatagcataactagttaatcacctttatttaacacatgcacaccggtggtacgcaaaattaaggctgtgtttggtccgatgagttgaaactaatctctcgcacgtaaaacaaagtgatttattaggatattaattaagtattagctaattttatatagaaaataaaatattacgatttttaaaacaacttttcctataatttttttttaagaaaacgtatcgtttagcagttttgaagtgtgacgtaagcatggaaaacaagaaccaaaactaaggtaggaaaattgccttgtgaaaatagaatttctgatggatcagcatgcacgtagtgtacacgtcactccagcctgacagccatatccatttggaagctactactactacatggatcacactagtacagtagcacaagtacaatacagtttggcagttggcaccggtcgccgcctctgctgcccagaccattccattggatcattccacgcttaattttccatcctgtggactagctcaattagctcctctacaccaacacaattaattaattaattaatacaacaagtaataaatactccatccggtcctataatatagcaatctaatacaggacgagacatttcatagtacaacgaatttagacatgcttcctatccagattcattgtactatgaagtgttccatccggtactagattactatattaaagacgggggagtattttgcaccatgcacacactacagtactacactctcttctcttctagaataatcttgctagtagaataatcaataactaatgaatcccaaccatgcatgtagtactaagcaagctagcttagtagggtatttagcaacacataatcaatcatccacagacttgattataaatctctaattcatccatgttgatccatatatttttctcggtgtttgaccccaagactccactccatctctctccatgtaggagtatatgtttctagtaggagtacttgtcctcctcatataaaccccacactcttcccctactcttcaattctactcaccactcctcttctccatttctctcttctccttccatttttcttgtgcacttctctttcccttgcaagctcaagaaacccaattaattaagatagttgtgatcatctccaagcttagctaattaagctactagtggccatggcggtggaggcggttcttgaggcgtcgagaagtagtagtgaggaggaggcggaggtgatcgtcacgcacggcggcggcggcggcggcggaggaggaggaggacaggtggaggggtgggggaagcggaagcggtcgcggcggcggcgaccgcagctgccgccctccgaggaggagtacctcgcgctctgcctcctcatgctggcgcgcgggcgacgcgacggcgacgacgtggcggcgtcggcgtcggcggcggcggcggcggtggagcaccggtgctccgtctgcggcaaggcgttcgcgtcctaccaggctctcggcggccacaaggccagccaccggaagccgccgccgcccgccatggtcgacgacgacgaggtggtggtggagacgaaaccggcggctatcgcgacgccgtcctcgtcggcgtcgggcgtctccggcggcggcggcgggagggcgcacgagtgcaacgtgtgcggcaaggcgttcccgacggggcaggcgctgggcggccacaagcgatgccactacgacggcacgatcggcagcgccgccggcgccggcgcgtccaagccggcggcgaagacgaccgtggcggtggcggcgagccggggcttcgacctcaacctgccggcgctgccggacgtcgccgccgccgccgaccagcggtgcgcggcggaggacgacgaggtgctcagccctctcgccttcaagaagcccaggctcatgatcccggcatagctagccaagcccacaagatttgtttaattttagccataaaattccattaaattaaacccatagttttttctgttaattactttcttaatttggtgattagtcttaggaatgatgattagtttgtgtatatagccattgtttgttcatctatcatttgtatcttgtaattaatcccctgttagctagatttggtttaattggatataggagttacagatcaattctttcattggttgaattggtttaatttatgtatatatatacaatatgtaaaatacatgtataagaaaaatacgcatatgtatttaatttttttgttaattaattcttggttgctcagctatagctaaataattaaatagctatagttaattctgtgataggtagtagttggagttaagagatcgatcagagatagctgttgcttgccgtgtgatgctactaccaatcagtgatcacttagctagcttgtgtgcacatcttatctactctaagactgaccaaatcatttttagcacgtgtatgttttatgatcgatatacaaagtgtcttgataatactagtcattataggttaactggtttcgtagcttaattacctacaacctcttgagatactgtaacttggaaggaaacgattaatagctggctggctaggttgcttgcttgagatgattaaattcagaggccgtgtacgtgtcagtacagcaacagaattatgatatttgttctaattaagtcgatcgatgatcaagtactgaattaatactgttgtcacaatactaattaattgctgtacagttagtgtgcacgtttttatcacctatagaataaagttatactttataattagcgggataatgcatgttatgtgtacatgtgctttactatacactttttatcatgtagaatttgggtgtgacgtggaggagaatttagttgatcaaaacgtggttgttgtttgaccaacctgttggctaggttgcaggaaaactctaggtaactaacaactgtcacgagttgaaaaagacattatctataagcatatgcttggttagtaagttatggcactaattaaattacttctcctaggtaacgtggtcaacacctgaattaactgaagaaaaattaaagactctaggaacactctgggaagcttgctagcatggctctcagagcaagtttaatagtatagcccactaccagctccaattcatttatagacaatctaatagttaattcatacaatagttgcttactatactattatatatggtcccacctgtcatacacacattgtgtcttggagcccgcgctgtagctggc

SEQ ID NO: 450 - DNA, 3100 bp, Oryza sativa
ttgcacgctgctgtcttcctgataggatcgttttcttcacgttattgaaatacggcgcatccggcgtaattcctctgtcctaagaaaaaacaagatactttttctagtataacaaattggataagaaaaactctcatcaatactagattggtcttttgtgaattccctccatccacagaaaaatgaatctagctaggattggatatgatacattcatattcatagtattagtccgataatatgttgttttttataggacagagggaatatgtattatcatatcttgtgcaaaaaacaaaaagtagtagtctagtctagcatccaccgttccacacgatacggactcatcgtttcgcttattcgtcgaataagtcaaacggtatatttgtaaacgaaaaataatttgtgaataaaacttttatatatgtgtttttagcgatctaaaatcaaagattaaaaaataaacttcgatgaaaaaaatctcaaatccagttctaaattcaagattaaaaatttaaattttaactgataaatataagtataagcgaaaagataagaccttatatgcaactggccgcctacttggcaaacagaaagtacaggttcatcccactgcctgcctacttggcgcatgcccaggtcaggtgggtcgaccgtcgacgccagccaagtactcacgtcgcgtgcgagcaaatcgagctgcccacaccaaaaccacgcccgtttttttattttcaaccgtcttttgcaagttgcgcccgcgcgaaccaacgtagcaacaacatacggccgctgcgtttgcgtgccgctgaccactggactaaaagccagcccacacaggcagaggcagccgcatgtttgctttgactacgcacacgtacacgacttgttcactgccatatgcctctccccaaacgtgcgtgcggcgtcgcgtcgctctcgatcggtttgatttctctccatccctaactatatatgcgccaccgcgtgcgaggctagctcatcatccatccatctccctgcagctacgtactgtacttgttagcaatcaatcccatcaaatcatccaccgctcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgccactactgggacggcacgtcggtgtccgtctccgtctcggcgtccgcgtcggccgcctcgtcggccgtcaggaacttcgacctcaacctgatgccgctgccggagagcacagccgccgccgggatcaagaggtgggcggaggaggaggaggtgcagagtccactgccggtcaagaagctcaggatgtccaactaattcatcatacgccatcttgtaaaaacaagagatctgcccattgatcgactctattgaacagagtctattctttgattttttttttcttttcaactcactaattgtttggtttctgtcatcgagtatgcaacaagctaagctggtgaccatggatcttccaagattgattgtcgccaagggacatatatggttctaggagtgttgattcatttgattctttgtatatttgttcaatctaaaaattaatgtactcaatctgctcaatatatatagacgctatattattacgactccatctgctctgttcattttcttcattttatattttaatttccaaaagtaaaatttgatcatgatttgtcaacctaaaagtataatgttttcacacaatattagttttatagctatcaccaacggttcaagtttataatctagcttaatgtccttttcaaataaaaatatataccatataaggaggacacttaattacttgatgttttagataataacaccggctttggcgcaatttttttcatcatttttatttactatatattcataaaatgtaaaatttaactatataaaaaagtgatatttagacatagctactaatataatttttaaatatcaaatttaataatgatatcactgtgagtctctatgtggcctttgttaatggacagattaaacacaaaagatttactttagagaaaacaattcaacgctcaaggaggaacctgatgtgtaacatgcaatatgacaaccgcagagtactctttacacctctttttcacatgtccctttgctcaagaatgctagaattacactagccctaaactggaatctaaacatggagttcataaaacaatatacaccacaagaaacaacttctcacacacatccttcatggaagttatagcaatcgggtgttagaatatttggagcaaagaaatgatctcatattgaacaatgtgcaagttaatttcgtcaaatggaaagcagatttcaaggaggaatttagtcagcataagcatagagtaaaagaattagacaaacccttctggcaatcatggatacacaatgttacttaatctattcttttttgtaatctcttttgtaatttcttccatttcttcttcttctttgtaaatcctttctgtaatcttttgtgtaaattttatatcatttttaatatagcacagtagaagtttattctgctgtttataccatcaaaaaaaatctaatttaatattttccaactattgaaaagtaatattttgaagtccggtagcaca

SEQ ID NO: 451-452 - skipped (2 entries)

SEQ ID NO: 453 - DNA, 3979 bp, Oryza sativa
gcagtgcccataaaaagctcccaagtatattgtcatcatttttcacaccaatctgacgtacaccacacgctcgcatcattttaaaaaggagtggcttgatatttgagaagaaaaaaaatgtgccacattttgtttttttttcaagcaccaaaatcttccatttttttcattacgaagagataccaaaatttacactttatttagttactgaaaggtatcaaattttatttttagaaaacatgatatctcctgatacgtctacaaacatagaaatatgcattgaatcaaaacgatacttgagctgcattcggcagcaacggactgagagaaaagctaccttgtttcttacgggcacacgcttccaaaatttttaaatggcttgtttttgcaaaatttctttttctaaagggaacttgctttagaaaaccatattaatttatttttcaaatctaaaataattactacttaattaatgatgcatcaatggcttacatgttctctccccgactcaaatttgaaaaatgacaatttggagtatgaacatatatacgtgccaattttctccagctggatggatatacatatactacatcgtgcgcgccgtctgaccgactgaccgatcgaggcgagttatacatgtgtactgtacactccttgtcctaaaataaatttatctgtgggtttttatattcaacatttaacagtccgttttatttaaattttttatatgattagtatatttctattattagatgataaaacataaacaacacttatgcgtgactcatttttttaattttttaaagatggatgatcaaatgctggatacagaaacttataaaatagatatcttttaggaaggagggtgtacatgcagatagagtactggcagcagagctgggtcatccatgcatgatgatccatgagagagagagagagaaacgcccaaaaaaagggcgcgtacgagggcggccaagagaccaggggagacgaaccccctccccccttcgtactaagtactatattcccaccaccatcatcctccacttgcatggcgacgacctacccacccccggccgccagatgcactgcatccgccgctctttgcatcccccacacccagcttgctttcttgcttagctagctaccccaccactgcctccctcctgctgctgctgcttgctgtcgcctcctgtctctcctccctttgcttgcatctgtagctagcagcagcttgatctggaatactccagccagctagctagctcggatcgatcgatcgggatgctgcctgggcgtgaagagatcgaggtgatgatcaggtgatccatcgatctatatgctgctgactagctgctgcatgcatgcctgccatcccgtctcttgaatcagcaggtatatatatatatatatatatgctcgtaagtcgtatgcagtatgctcgctgattcgtgattaattacagctgattagtgttcatgtgtaatagatccttgcatgcaatcgtctgactcattcttacagatgatgatgatggatagcttagactgacagacatgcatgagatgagatgtgtagtgcagagctgttagctgtacatcagtttaatttgctggtcatcatatttatctctgattctctgttattaatcgatcgatctgggtggtgattgattcattgggtaatcactggttgttttttcgtcctgtaatttgtcactgattctgcgaattagctggcgagctaggatgcatgcatgggcccttttctctgaaaagacaaggaataatctcccttgtctcccttgttatgatatcctgagtcctttttcctgtggccggctagctttaccaactttaatttcaacttcaattccttggtatagtagtaacaaaatataatgtgacctgtcctacgtaaagcttacgcatagatagatagatagatagatactgtgattagtgactatcacctgcttcgattgcttgcttcacatgctgacaattgattcgatccatctttcttggcagataccgcatgcagagattgcaggaacagcttagatctgatccgaatatatatctggttcagtatcaagaaatcgagctacatatgaaaacttcatttctaagctccagcagctagcgtgatatgatagtgtgattgatatttgatacttccttgagagagacgcatacgatcgaatcggatgcactgcacctgagctaagctagctcaagctcgctcgatcagctcatgtacttgttgagcccaagaaatggcgacgaggaggacgaacaggaggaaatccaggagctgatcagcgacgacgagccgcccaatctcaagttggcatcctgcgccactgcagccagcagcagcagcagcagcggcagcgacatggagaagggaagaggtaaagcctgcggcggcgggagtacggcgccgccgccgccgccgccgtcgtcgtcaggtaaatccggcggcggcggcggcagcaatatcagggaggcggcggctagcggcggcggcggcggcgtgtggggcaagtacttctcggtggagtcgctgctcctgctggtgtgcgtgacggcgtcgctggtgatcctcccgctcgtgctgccgccgctgcccccgccgccgtcgatgctgatgctggtgccggtggcgatgctggtgctgctgctggcgctggcgttcatgccgacgacgacgtcgtcgtcgtcgtccgccggcggcggcggcggcggcggccgcaatggggcgacgacgggacatgctccctacttgtagtcttgtagataaacagctgcatcgatcgtttttctcttgtttttttttctttcccttggatttggaggtgtagagaagctccctctctaattaattacttagtgcgcatcttcttcatcaatctcatccaatcgttgtctttgttcggttaatcatagtatagtggttggaggtgtgtgatttgaaccaaggtccgtattcaattctcgacacgctcacaacttctttaatttggtaaacaaaactagcacacgattgtcccaattataaaatttgggatctttctgaatcatgaatcactttgatcttgtgaattataggttgaggcggcttgattcttcttctttcttccgccgccgcattactgatttactgttcggttgactcatctgcatggttaagaaagcccttaactagtttgactcgtgggtgcgagtaaatttggcccataagtacgcgtagtttcggcccataattgccagtatattgggcccctaagcgtgcggaaattgggccggcgagcgagggcaactttagcccatgaacgtaagtttcggtccagaagtgcgcgacgggatctgtctccgggcgcagcatcggctgggcgggagaagtgacgtggccgctgcctcagctccacaccgccctggtggcatgaacagagacagggcgaagctaacatcaaaataagaggtacactgccattaaaaatcaacaaaatttcaatgcaatattgtatattttagtatttttatgtgcaccctctagctttaacatggctttgccactgaacagatataggaacgaggggagaaaggggaggaataagacatgaccgctgacacgtggaacccacgctaacttagttgggttgatcgcggttaacttgtcatgttaattgaaatcgggcaccatgctgtcctaggatcttaggtattttggatttttggtgatgtaaattaaaagatgtactgtatttggtattacgatttaagaatgcgattgaaatacgacgccaagataagatcctgaagtgaactaattccctacttttgccaccgttatgcggaatacgttcacttgaggtctcttaatttctcgctgagttcgaaattcgtcccttgagtgcaaaaccagatacaacacatcccctaacttataaaactatgcaaacaagatcccttgg

SEQ ID NO: 454 - DNA, 3511 bp, Oryza sativa
ataagtacaaacatttggtacttctgtttcccttagcacataagcaacttgccagccatgtcacggcgaagtggtgccctactaatcgaaaatgacatgtactgtttctttcctcacccttcaggtaaaaactatttgggcattggccacgcagttttgttaatgttatctcgtggcggtgacgccatactctaattaacagaagcaactaggacatctgaatctcacaaccgaatattcaggttggagcaaacgcagtggccacctgtcctaacattgctacgtcggagagagagagagagagagagagagagtgaaaaatgacaaataagtgctagattagccgttaattgattcgtcatactccttggatcttttgccctgggctgcttcccagaagctagagcgaccaatcggggctaacttcaccgcgacgaagtcatcgatcgatcggcacaggaggaaacgcgttctgaattctgaatttatttttctgaatatgccagcgctgtctgtctctttctgaaactctgcaatcttcatcctgctgaaagcatgcgtgctgacgctgctggttaagctgcgcagctgccggctcgcttctggtcagacaacaaaagaagaagagagtgtcaatgtggcaatgcttcccttaatacgtctttgctgccattgctggagttaattactaacctatgtgcatgatgccttgtccgtttgtggatcgaaaaaagaatatctcagagcagccgtgaaaacacatcataaggggaggaaaacgaagcccctctcttgttgtgttatggaaatttcactcgaatcttctttctcatctctggaaatttcagatctgcgcggtaaaatcaataaaaccttcatttcacttaaccaaccgagttgattagagcaaaagatgaactttttttttccaaaaagatactagtcggtgcacacgtaattgaactatattagacagtactagctccagtactagtcaatgcacatatataagtattcattgatcatcccctctcccccacacaatcttgtgtatccgcaaaaccacaatcaacttcgcaaacctaagcaccactactactcttctgcttccccattcctccctccctttcgatctgttcgtcctcctagctctagctagcctctttggtcaggttatagattacatagcaccatgaattattctcctcccggttggctcgatcgattcagctagctgagcttctcgatcgatcaaccgatcttggttgcttcttcttcgatcctttcactccgtgtagttcttgatttgaaggatcgacgacgaactccctgtggcttcttgttcgccgggttcagccgcatccatgtcgatcacggaggctagcctccacttctgctacctccactcgctctccgtcgtgttcctctacttcttctacgtgatttcctgattcgcctcatccgcttcctctccaaacctgatcaaacaaagcttcgtgcacgatccatcttcgctgaaactaaggaccaaaaactgaagctttgtttgatccaaaaaaatatatattctactaaatgtgttctagcttgttcctttcctagtatcgccttgttcctgcacgcgattgcccaacttggagcacgaaatatttctgcctagtacgtgttcgatcggtgttccacggtgagtgttagtttctctttgtgctctgtgatacattcaagatgtcagttgcgccggcgacggaagggtccgcacgccgctcggcggcggcggcggcggcggaggaggaggagcggcagcgcaaccggaagaggtcgaaccggctgtcggcgcagaggtcccgcataaagaagcagcagtacgtggacgggctggccgtggaggcggagcagctccggcgggagaacgacgccatgcgcgccggcgccggcgccgtgctgcagcggtgccgcctggtcgagcaggagaaccgggtgctcgccgcgcacgcgcgcgagctgtgcagcgcgctccagctccgcgcctcgcagctccgcctgctcggggaggtggcaggcgtgcccctcgacgtgcccgacgtcgccgaccacctcgtgcagctctacggcggcgacctggggatgacgccgctctcgccaccgccgctgctgccgccgctgccgccacagatcgagatgctgtacttccagccagactcggtcatggatccggtcagtatgctgcagggctacgaaaacatatgaaactctacattgtgtacttgacttatgattgttgccacatgcgtgtcttcggtttgtatggtgtgatctagctactgtacgttaatactgttgttgattttacgatccatattcctgttttgattgtgtagtaaaaagtatagcttgttgcgaggtacaagagtggagaaataaataaagtgtgtgaacattgtataaacttcagttagcttagattgtgtaatgtgttctcgtggtatttgatttgatacacccttcatttcatattatattataaatcgcttttaactttttattagtaaaatattttgatgtttaatcaagcttatagaaaaatttaacaatatctagaacaccaaatttatttcattgaatctaacattagatatattttgataatatatttcttttatgctgaatatgctactgagtatttctataaacttaatcaaacgtatttaagtttaattagaaaaaaaatcaaagcgacttataatataaaataaagagagtaatttaacagtcatctaaaactaaacatttccaagcctaaaatcagagctatgcaatctgcagttttagcccattttaactaaagctttatcattgtatatggttttatgttgttctctatctaactttggatacttttacttgtaattctatgattgtatttactagttatcaatttatttttgtgtttaggttagcgtagtttattgtttaaccttttcaatagtgcaagtaatgggaaaagtgaccaactttttcaaaaacttctaattgatgtctctccaaataatagcgatgcatgcatgttctataatagtgataccccaatactggtttcttatcattggagtaagatccaaccatctaggttcccctcaactttgtaatgccctaaacttaacctatctccacatcttacatccaacaaataccaccacatgctcaacataatagggtggcaactatgtcttgacagcctctatgcactagcaataacttttaaatttcaaattgcatgtcccccataaaatagccatgtggtcctcatcgtcttctccaagagctcactaagtgccctttaattcacttgcacttcctcttgctgcctcataaccattcgattattgtctcccaaatggttacctcgttgcattgatgcacccaatccaccacagctacatgagtttttgttatataaaattagagaccatggttaactcttacaagagaccatgatataaaaccttaatgt

SEQ ID NO: 455-458 - skipped (4 entries)

SEQ ID NO: 459 - DNA, 3630 bp, Oryza sativa
ctacagggtcgcacgcttaatgggccggaataaggggattggatagagatccaatatgagtttaattcggatagggatccgaataggagtcctatgggccttggaggtccgagtgatggatcctatatattcatgaggggtgtgaccggcggaggcattgcatcacgtgagaaaccttagtcgtcacttccctcccgagcaaaaccctagccgcgcgcgggtgctagcacatctgcgcgtggtgttccgtccctgtacgtatggataccggtagaggcgccgctggtttgcggtgctgatcggcgtgtgagtacagcgaggagaacgcatgaggaggagaaggtcgagccggtgcgatcgactacttcctctacatcgacgcgcgctacttcgcgagagttgcttcgacttctcagcgtcttcttctgctgcgcagcgcgccgagtggtaacgatctatgatctaatacttgcatggtcctggtttacgcgatagaaaattttgatttatgctatcgtagcctacgcgtatcccaacactagggttcagaggcggaagaggatgaggtcatggaggagtaggctgtgatcatggtaggatttcacttgcttgtgcagtagaaataagctagcttggctactctactgggaatactgagctcgagctctagtgtgcagttgttgccgcctgctgttgccagcatcgtcctcctcacaggccgccgtcggctgctgctcctcaccgtccgccgccctggtgagatgggaatagaggggagggatagagagagataggtgaagagagataagtgtcattaacatgtgggggcactatgtgagtcccacgctgacttagattgtcttaaaaccgaagataatactgcctagaacctcgggtgatccagttttgtgaagcgggggacctgctattctggtatttcggtttagggacgaattgcatactcaacgacaacttgaaggacctaaagtgaacttattcctctggacagccagaaacccaggagaggccacagcccatcgctctcgtctcttctccgccgcgagctgagccaattattccccaccgccgccgccgccgtctactcgctctcgccgccgcccgcgactcccccctcctcggccgctcgcaccctcgccgcgtcgacgctcgatcgctgttcgcgcttcgcctcctcccaatcctctccgccatgcatctaaccctcgaattcgggtgggtgattcactctctctctctcgatgccttccatcgttgtgttgctgctgtgtattttgtggttgctgatgagctgtgtgggttgattgatggtggtggtggttgcaggggagggctggagctgctcctggagaagtccaccaaggtgcacaaggtggacctccagcccaacgacggcgatgggaaggtgacgcccgcccgcctcgacggagccgcgccgcgtgcagctactgcttagctaatcacggacttagaattctgagctgtttgtgtgtgaacattttctttgttgtttgtttcgttttgcaggtcgtgatgaaagggttgctcgcttgggtgaagtccaatctgatcaaggagaggccggagatgttcctcaagggtgattcagtgtatgattttccctttccgtctcatggtttatgtgcatgatatgatttgatccgcttcaatgatcaatggtgtgtccaaagcattttatttgttttcggtccacttcggtatggatattgctaggtgatgagtggtgtcgcttctttggtgatgctggctgttatttctgctgaatttcaacttaaccatgcaaacttaagttataggagaaatgctcaaatattttatttctgttatttcgttaaaaatgtttgtcattgtttctggagctacttcctccgtttcacaacgtaattcataaatgtgggaaatgctagaatgacttacgttgtgaaacggatggagtaaatgttaaatatgcaaccttctaatgacagtttagttgatttcattagaaatatgcataatgaactagggttattgatccggtgattttacttgaataaggaaaccttctaatgacagtttagtatgtgcttatgaatgctttgggtggtatacaggttatttgctgttttctttgcagagaagtggatgctttgttagcgcaataagctgggggatatcattaaacttttgcaatgtcaaacttgaaggaaatttagaaattctctttctttaatttgtggacaaagttaagtccattagtcttgatgaggtgcttcttttcgtgcttgcagaaggcctggtgttctcgtacttataaatgattgtgactgggagctatgcggtggccttgacgcggagttggaggagaaggatgttgttgtttttatctccacattacacggtggttagtacaactattaggactaccgaaatcaccactgatatcatgttgctaaatgcatcttgtaccatcagaaacagaggttgtgtgccataaatttctggagagaatggattgtggagaggaatctgctgaagttgatatggtcaatttctgtaatgaaaaggcagttgtcagttatgaatattcaatatcacagatttgcagtatactgatcctgtattttccaatgctgctgtgcttttctgcatccatcactatcgtaggcgttatctgaagtctgaaatgtcgatgactagatatttttaggccaagcatccacgactttgcttttaccctgctctgtggatcaattaataaaacctcatacatggtgttgccatcaaatcttaatctacttagtgcacatatatagcatggaaagcatgggtgaaaaatgaaaacaatcgtaagcgtggctattgctgccacaatgatccttttcaaaatttggcaataccaaaactttgttagaatagattaagtgtgctgttgccaaaatgttttaggtattaccaatgtttggtaacaaactaaatgcattcacgtgtttgtcaattttttttttcaaaaaatggtaatggttcaaaaatggcaaatctgaatgggctcatcgtgtgatcgaggtacattagtatcagactatcagtaatactacctactaaagccagccagtaccatggttacaagcttgaaaaattactgagcaaattttgtgaactctgttcatcagtcattacaacagtatcactgagtgagcaaaacatgagttcattcaaggccttgtcgattcggcaatatgataagtagcttaagttttgttgactatcattcagatcattttcacatctttttgcgtggactaaactatatacaatttttcctttttattttaatctcaaacgctatcatgtagagaacctctttgcccaattcttctttctgctgacagtttcccatctgcatagaattgatggtatatcacatttattggaaacagaaatttgccatacataaaatatgcccaaagaaaaatgcagatatagagaattagttgaaacatgagagagtagacgatcacatgaaggttcgcagtggagctaataccatgatatcacttgaaacaaaaccatgatatcagtacattgtccaatagcagtgtgcatcagtat

SEQ ID NO: 460 - DNA, 7468 bp, Oryza sativa
tccgtttcacaatgtaagactttctagcattacccacattcatttagttgttaatgaatctagacatgtgtatatatttagattcattaacatctatatgtatatggacaatgctagaaagtcttacattgtgaaacggagggagtacttagtatattacgactctctccgtgtcagtttgatattataaggcgctttaattattttttaagtgaaacttttacaaacttaactaagattgtagaaaaaaatataataattcttatacccctaaattagtcatgttaaatcagtattgaatatattttaatagtatgtttgtttgttgtaaaaaatatttctattttttcataaatttggttaagagaattttaattaagaaaaaagttaaaacatcttatagtataaaagaaagaaaacgtagtagtatatacttcctccgtttcaggttataagatgttttggctttggtcaaagtcaaattgtcgtttcaggttataaaacgtttcgactttagtcaaagtcaaactgcttcaaatttgactaagtttatagaaaaaaatagtaatattttgaacccaagaaaaatttactatgaaattatatataattattgatttgatgaaactaatttagtattataaatgttattatatttgtctataaacttagttaaatttaaatcagtttgactttgaccaaagtcaaaacgtgttataacctgaaacggagggagaatataattatatatctaatgcacacacagctgcagctggctaggctacaaagtacgggcgtgcactgcattgtatgtcatgccatgcgtgcatgtgtgtggctgacacggttgggcccctgcccactaatcgaccatttgtagctttcccggtgttttgatctaccgactgaaatgcacccatggatggatggatggatgctccttctcttctcccttcttcctctattatattagtgccccctccttccctcttcggctctcatcttagcacgctaaaccggcttccaagatgaaggttagtgtttcatctattgaacatatccatgcttattagtttcgtaatgtagatactaagtttatgtatatgtagttctcttttggaacttgagttgttaatttctttttgtaaatattttttgtttggtttggttacgttgctggcctagctgatcatgctttctgggttgaataaatgtagctacaactattaatcctttattttgtttttccatcattgccgttgtcatcatctttcattgtcatcatcatcttctccttttgacgatcttcatcagatcttgatcaaaagtaatagaccatgcattttcatgattgatgaagttcataaaaatttctgatcctcatatgtgtatatgatcagctcttaggttggatgcatcgaaagctacggagtaataatgacgtgttcaaagagttcaacaccggaggaggtatgcacgcacaacttaattaatctattttttgtcctttttttcttatgtttaattgatgaagtataattgttttgaaaaatacagtagctcgtaacacaaacgcactcacctctagtactctctccagtgtttttatatattaaactaacgtcatataaaaaattgaagttagtatatatgtataatagttcatcggtacatgcagaaaaaaaaaagagtttgtctctggttttagatctgtaagcatgcccacaataatgagaaaaccactgcaaaattgttggccggccggtcccacatgtcattgaccagattagccgtctgaagtgctgaactgtatggaacactagcaatcatcaatgggagttttgcactcttgcgcttggtcacattggagatggcacatctatctataatatcacacatgccacttttcttccagcctcaatatctatagttccagcactagctagctagctagaccaactattgcatagcaagaaccctatattatcattttgcagataacattttcttttccatgtagtaacattgccatggaaagatcacgagggcatgtctatcttttgtgaaactctctctctctccttttgaaggcttcctttgagagttttctccttgttggactgttgctcttaggctcagcatgttaatatcagagttttcgcccgtttttcataaatcaattgtgccgttgtaagatttttgcgtccagttttccttataaactggacctctctgcctgtttcctcgagaaaaattgtccaagagcattctcgacgattcaacaactagaattcaacaaataaagatttttatatatggtgcatatggtacggtgagatattgtatttttagtgtgagataccaaaagagctacaacaaattaatacgataaaataagggaaatttcatggactaactagttagaaacatattttgagtaaatgaaaattttattttattaccttggtttacaaaagacttataataagtgctgtcaaacatctaaaatgttaaattcttaatagacgaaaagtattagaatttaaaacgtgaaaattatatactttttgatgaaaaatagtaggaatgtgaaaattatattagtagactttttttgatgaaaactctttcatatagttatatgttaattttttataactatatagtttgagaaagtaatcatataacttttgcattaaaaaatgtgtcaatgtccaaaacattatcttaattaacccggtccttctcctcccaaaggaacacataaaaaaggacaaaaaccaatacatcttgaaaaacttacatagaaaaagcttaatcatattttatatcaccctgatcccgttgcaacgcacatgaatgtaactatttctttttaaaatggtgttgtacttcataaatttgaaacaaaaaaaatacatataatgtaacccttttaatttctgaaacacatcaaaacttttctttctcaaaaaaaagaaaagaaaacacatgaaagcctgcataattttgcatgcaaatgatcgtactccttcctttttaaggttacaagactttcttacattacccaaatttatatagataataaatctagacacaaatatatgtgatttattaatatgtatatgaatgtgaacaatgccaaaaagtcttataatataaaatggagaaagtatttaatactccctcagtttctaaatatttgacaccattgattttttaaacatgtttaatcattcgtcttattcaaaaattttaagtaattattaattattttcctatcatttgattcattgttaaatatacttttatgtatacatataattttacgtatttcacaaaagtttttgataagacggacggtcaaacatgtgctaaaaagtcaactgtgtcagatatttagaaacggagggagtaattcactgtgtgactgcaggtggggcctgcaactgcatcaccgggcttgcctcgcctgaccacgacaacgactacttctccggcgacgacgccgcccacgcctcgccgccggtcaccgccggcgacctcttcaccttcggcggcagcggccttctcaccatcggcacgctaggcatcgccgccgtcgccattcccagcggcggcgacgacgacgactacgacatcgacttcgaggtggacgccaccagcgacgacgacggcggcttcaccgtcgaggacgacgacgccgacgtcggcggcgccgtcacgcccaccttcaccttccccgcggcgacggcggcggaggcggtcgtcgccaccgtggagaaggcagtggccgcggtggaggcgatcgcggagaaggacgacgacaccaccacggaggacgacctgatggtggtgagcgccgagctggagaaggtgctcggcggcgtcgacgtggcgtcggcgcgggtgagcttcgccatgggcggtggcgtcgactgcccgctccagggcttcctgttcggctccccggtgagcgacgtcgagtcgcgcccggagtacctgcaggcgccgcgggactcgtccggctcctgcggcggcggcgggcggcgcacctcgctcggcgagctgttcatgcgcacccgcttcgccgacgagaaggtggcgctcgtcgccgtcgccgagggcgaggacggcgtcgccggcgacgacggcgctgctgctgccggcgtcggcggagacagagcggggaaaggcggcggctacaagacgatgaagaagaggaaggtgaaggacgagaaaggcggcggcggcgccgccggcggtggaatgccggcgacggtgacgaagagcaagtttcagaaggtaacttttttttttgttgttgctagcattttaatttgctttgaagaaaactataaaatatctgcaattttggctgactatttcatgaggtttccttggatatgatcatttgattaattagttcgttcgattgctatagttttagttcatttttctttaattaatttgtaataaaactcaagagttattgtgagttttttttttattatttttgcttcagtacgtgcattttctactagtgaaacttcaatattaaccaggccagtcgacatttcttaattgtgatttgatttaagggtcaagattagaactatagattgaatatgcaaagtttcagctcggacgacatttgaacatttgactaattatatatttccgagttcaattgtttgccggtaaaattctgaacttgcagttggaacattcaagattcaactctgattcacatgatctcgaactcaatatctccaactttataaaaagacaaaaagattactgctcaacggtgagtttaatgaaggaatgctcatcacagcaaatccataattctatataactctctgtaatatgtaatggtaagaaacagatattcatgattaaatcatttttccccttcagaaagaaatactgatttttcgtggtacatccaaaattactccaaagtttacactgaatttcacgctgttcttggtgtttaagattaattttaggtagatattttctagtcccgcaacaaagctgacaatgaaaaccccaaaactaatcctaaatgaaattctaaaattaagaaaaacagctttagattataaattttaatagtaagtccaaggaaatagccagcaatgttaataagattgctgataagaatatataacagtttggagccaatccatttcacatgtgtatcctgctctgggacataagtagacacaaatcccgagttttgactatcatctcataatcggaagatctttcactgtgtcgtcagattcgagttaagtttctgtagaccaacttggtgtgtcaatggtgttgttaggagtggggatactgggggcagtgagttgacatgcgatttgtttgcaatctcctgtctaatgctatctttatggatcatttcatttgtcatttttcgtttgccccataaacaacaagggattcttgatttgatatattatacatccttctaggtgctctcttgcatttcttttccttggagagatgctccaaatatccctcaaaagaaattctagattccttttgctactacttggtacttacatttaattttgttacaacgaatgaaagaaactgagtttcagaaagtgatcaaaagttgacaatgttctgaaatgaggaaacatctgctcattgcagatccttcaaatcttccacaggaaagtctaccccgagaacacactcctcacaaggaatctgaccaagaagagccgcaaccgcggcgccaccgataatggcggtggcgccgtggccaccggagaccccgacgggcctctggcctcgccggtgctccggtgccggaaggaccatcccatgaggggcttcggctgctgcaccaatggcgccttcggtgcatcgtcaccgggaggcaacgccgagatgaacggcaacaagagcggccactggatcaagactgatgccgactgtgagtagcactgcacaccttggtgtctccatccatcttcaatggatctatctttgcaatcatgcattcagtcttgacagctacatctttccatactatttttggggaatcttccaagagctatccatcactagtttctgagttactgtgtgctgatgcacacactgcaaacattgtgctttttcactgaaaccctgtctctctgatctgatgcagacttggtgctggaattataatggggaaaagaagaggagctatttgtttcatcaagaattaaagcttgaatagtgagcatctcatatatatgaatatgtgcttgctgttacaatataatctctatctgtttggtatagaagggcttgaatgtgctgtatatgtcactatatattgggggggagaggattactatgagatcaactcataagtgtgtggtgtttatatacattgctctgtgaatgtatgacagagatcagaacttaatgtattgtatgctttcttgatgtgattggtgtttatgagcctagctgatggcaatattgtgtgtgggtccacccctaatcatgctttgttcttgaactcttgttggtggcttagcttgcatgcaggggatgatgatccagtgacagtgatggcccctaactacacatggacattgtcctcattagattgccctctagctagaatcattccttgggccctgtttgaatttgggagatgtgttaattaatatggcaccatttggccagttgtatgttgtccatgctggattagggaggagcaactcatcaggttcagtgtttagttgggacatgtgtgcaagtgtctgaaatgtatcttgttcttgtacagtgaaggatagaggtagaccactgaagatctgtttggtagagtagtagttctgctaggactgaggcctaccatgcatgcatctctcatgtacacaaactatttcaaggcaaatactgtggctagcatggcaccttatacagatgcttactttggccacttacattttggcctcatgtttagggagattctggtagactaaatttaaattaatatttttaatacttcatatggactagtatatttgtggtagtaggaatagtatatctcttgcgaattctagattacatagactagcatatgcattacaacatactcatatgtctagggctatgaatctagcagaaatcatggcaccaattttttttttttaaaaacaactgcttagtttattggtttggttttcatggcagttacgtgctgtgcgcacaagagggggagggcggactgacgactttgtcttttaagtagtagagagtactgaagtttaatgatatggtcttcaagtaaaagaaattgttataaaacaaccatttgagaattgaaggtttcttcattttttttaaatgaaatcttcattctatgccattgagagcgaaaatttatatggtatttgtgtgtttatcttccataggtaggctgggcacataaatt

SEQ ID NO: 461 - DNA, 3455 bp, Oryza sativa
taaacgagtgcacgtgcacttgagtaggtacggagcacaatttttctgcccactgcactgatcatcagaaataactaggccaattacgaaaacattgcctacgtttttttattaatagaagaagccttgcgttgatcctttttcaaacgtaattaaactcatcaatttaaattaattaaactcatcaatttaaaatcaattcaaaccctggtcttaggtgggttgactgtaaccctattttcttcttaattgattggcagagttcctatcccttttctataagaattcaaagcatcaaactatgagactagagggggaaaatacaataacagtgcatgatgtatttcttaagaggggaccgtctattgtccaatataaaaattcaatcaaattaaaagagtagccagcttacatcggactcatgtaagatcgtaatctaatatatatttcctggtcctattacataacccatgatatcttcattgtacatttttgtcacgctctcgtcaccaatgaagtcgctaaaggccccttctctcttccccacctcttcagcaatactcccatgtgccccccttttcttctttgtcggtgattcgtcttgtcgcacttttcctgtctgtagtggcttatgcgacacactccctctactacatacctaaacatacttggtctttctcaccttctagtggaatctaccactgcctcatccagttcaattcattgcttggaataatataacgacgccctttaatttctctgctcacctttaggttttagccatctagatcatccctacaagctctagacacacacttcatgctgtgtctcttcgattggcgtttttaatttgttggtgtcaagtcttagagtatgaatctcaacaccaattctcttatttttcctctttattaaccgatttggttcagtgatatcactgaaccaccaaatcacttacaagattgaccaaatcacttacaagattggccatgacgatggttaatccaaataacatattggcccgggttccaacttctaccctcttagggtaagttatgagcacgagaattacagaatctaggaacaaagtaaatatcaaaccgtacttgacaaagctttatcgatcaaatataagaagctttatctgataaaacttcttgtccagttataatttgtactatacatggttaaaaaagatcacgcggagtaacagaaccatgcatctatgtgcttatactctcccatgcgattgtacgcgcgcagtatatatatgcataccgcgcgtctcctcccagcaagcggaaatagctccaggggctgaaacaaacccagcacatttgtgtttgtacgcgcagctagctagccacgagcgcggatccatctcctagctagcgcaccatctatggatccataccacgactaaaacatgcatgacccacgcggcttccccatccacccgcagccgtaccacctccaccccacggccggcggcctcggcgagggcaggatgcggggcggcgggcggcggcgccccggcgccaagctctccaccgacccgcagagcgtggcggcgcgggagcggcggcaccggatcagcgaccgcttccgcgtgctccgcagcctcgtgccgggcggcagcaagatggacacggtgtccatgctggagcaggccatccactacgtcaagttcctcaaggcgcaggtcaccctgcaccaggccgcgctcgtgcagcacgaggagggctgccagcacgccgacgtcgccgcggcgttctccgccgccgacgccgatctggcccttgagctgaaccatcgccacggcggcgccggcgatgatgacgccgggatgacgacgctggagatggcgccgatgcaagaggcggtgggctacggcgacggcccggctcatcagatgatgcagcaagcgctcgatccagcggggcagctgatgatgggcggcgctcatcagctgcctcctttgccttgctgtgtcttcgtccaggagactgacccctcgtgctactcggtgtgcaatgtccacggtgaggagtctggtgcgcaaggatcttattagctagctagtgagacagtggcttgcttaggtagttaatttccttaagtatgctcgaatattggctctacccactagctgtctagctctacttagcttacctaggtcgtcaaccaatatattaccggttggtcatggtcccttaaattagctagactcttgatttctgtaagaatgcatatatgcatgcatggggttctgttggagcaatgcataacagagctttgttttacatgcatgcgtgcatgcttcctagatatcattctgaaatctgaacttgtttgctcgatcgcttaattgctatctcaccatttcggttagtctgatgtttatcgttcagctccattctgtgttaatttcttttcctttccatttgcggcatgtatgatagtacgtatattcttctcactacgtcctaaaatataagggattttaggtggatgagacgtatcctaatacgaatctggacatgctccctatctagattcatagaattaggatacattatatctaaccaaaatcccttatatttaggaacaaagggagtacattactactcgctcccccggtcacaaaaagatggtttgaacttttaaaatcaacaaggatggtagctcacgtattcacgcgggcaagtatatcataagcccgtatttgaaaaacttataaggatcagaagtacattttcttcataaatttatttgctggctttgctcaaatatttttcattaggtatttgttatcttcatactacgtaatatttaattcatctctataagtaattattattttcttcttcatcatttaaaaatgaggtagacttagtttgtttagaaaacatgtctaatagttcaaattaaaaataaggtgcttttttctttttagattgaatgttttgggatttttttaacaaatcttaaaaaatattatttttaataatggaccatcaagctagccctccttttaattggttcatattaatgtaatttgttatacatatatttacatatggatcagtaaagatagattagatatatgtatcctgatcttgcttacaggagacgtgcacaggtacgcccgacattaggaagagatgagttttatttcctttgagatagattcattggtttcaccaacttgagttatctatatttacaaacataataatgacccaaagttctatacttattaaatatatattttctaattaaaattgtttattattgcatattgttctatttaaaatatatgtgttgctaaatagattgttaaaatatctatacgattttccctataaatgtgttttatttcttttacttactaaatatagttagtttgggtcttcaactataatttttttggtaaatattctaatgttctaatg

SEQ ID NO: 462 - DNA, 9060 bp, Oryza sativa
ctgtccttgtacttggtgtgctttaaaatagggaggaaataagtacttaacaattggtgtgttgttcacacctgcaagtgtaagcaaatattatgcagcatacgtgcttgagaacaacatgtgtcttgtcatccgtttaattatcacaactaggagatgaatattctagggtgcattattaagggtggctcatgcagactaggaaagattgtcctttcagtttagggggcgatgatcaaatgcaaataatctaataagaaatcagcacaaaagaaacaggggtttatcttgattggtaaagggtggctcatttcctatcagagtcgttaaagcctggccaaattggatttatgagaaatgtcctaaagtgaaaaggagataagtggcaacatgggcaatggcctaatatgagacaacaactaatttaaacaaataaaaatcaaaagataatagtgggacatgaccatctgatgaagtatatgacagcttctaattgtttaatcatgcaagtggtgaacatgtcatcaaagaagcatgagtgcatgaccatttggaaaatacggcatgtctatatatgttgatcctctttgcttccttcccctctccacccgtacatggtgtgcttgcatgggaaaaggttctgcctctattatttatgtgtttcagactacgtatttagggtacttacgtgaaataaagggaacttgtttttgccagattttctgatatgatataacagatgtgcagtgtaggtgtgtgaccctgcaaatgtttttagtgaatgcaatcaccggtgccacaaaccttttcagactgagctgattctgagactttcatgctgatcaagtgcagtcatcacaagaaaaggcacctttatattatgtcccctttgtcttcctattactgaatagttctgtagtggtcccattatcttatatatcattaaaattgggacatctattcccacttttctgtgacatcattggcatatctttgccagggaattttcttccttcgtgcgccaaggaaataagtctctctctgtgaaattcatgctgctgacagggatatcattctgcagttggaaagaaccgcaggtattagactgtttcacactgcttcatagacgcttgcatctgttttataccatcacatacatatccccttgtttccatgcatactttatttgcatcctactgttctgctctaaaaagcttattttatcttctataaattattaactggtagaactgaataatctgtcttgaggaattattccttatgcattataataggaaatctttgatctgccatctcctggacaatcaatagctttgtccattagcaccaccaaattccattggtgtattctcttcagtggcgcacagtcacactgcatgcacactatggaaggggagaaaaggcaatgcaatgctctctgttggcatgaaaacttgagctgtagtagtaggtcaggaccaccattgtactctaccagccatatgtaagatgatgcgcccggcgagtgtcctgaggctataaagcccgaatctccttgggcccaaccacaccatggcttttcatcctcccaataccaagtagttccaaaaactaaagggggggactcagtggaaagggtgtgcctgctcttttccatacagatttgtgttcatcaatggcgtaggggatctcatgaggtcattgggctctttgcaagtggggaggaaaagggagatctaggaacgacttagtggcccacctttttttctcttccttttttcccacaaggacgagctcatggattggagaaggaaagcgattctgcatttgggtctcaaatcttggggaagatcatgtagtgtactctccactcaatcggcaatgaggcattttgttattgcgtgatggcaccctgaccctgatgatcatgcataggccaaagatatcagacgtgagagacctggtctatatgtatgtggtcactaggataggatgctaacagccttgtgcggtttttcttttcttcaagctttcggtttatcgtcacacctctagatatttgcaggttacacagttacagcactaattttggacggcttggctttgcttagttagtggctggtttgcaagttttaaggtatatttgcaatatgcgatggcaatgaaattattctcaagcgcttgatagacaatactagggtacacatcaacatcaagctcatgccgtatcttattttacttggaaactttggaatggagatatgattattaagtatatgttccttagttgtttaagctcttcttagcttgggatttctaaaggaaaaatattgtgctgcttggagcagttgcacaaaatattgactataggtttatgtcttctataatgatttcagtatgtgctgatgtattcaggtaggcaatgtaatgttactcttcattgtaaaagttcagtgggatattggacgtaatctccactgatacttggtctgttcttttaaaagacttttctttcatccatggcaaacatttcagctatttgatactgttgtacgattctattcttgacattggtaatgacccaactagattatattcccttggcagcagattgcttccgaatgaagacaagataacatattgtaaggttctcttttttcttgcaaactgcagttgcaacgcaattcctaaacataacaaaaagcctgagaattaatatcgtaagtgcggaaatgtcaactgctttctatcaaaagaaaagtagctatagggataagaaaaactaatcatatatataatagcaacatgcttctttccaatgcacgttggcagagaatgaaaaagtagataaacaatttcctggatgagtcagctaagttttgccgcatcatcaaattcataaggtagagaaaccttctttcttttttgttgaagatctggaactcaaactttgttttgtcattaggttatggtggtgttacttgacgatgagtggacttctttttatatcagagaaatgcaacaaccttctaacttcaccaagacaagtaagcatatttgtcttcagttctatatttatatatatctaatctccttcatgaaacaaatggagtaggttttctgcgcttgctgttaagttgtatccagccacacaatccgtgggcatcctccttggcatgggtggtggccaatcttcttcagtgagcctgggaccctgtgaacagtattacacaacagtaaccctgcaaaagatttgggtatctaagagctgaggcccaactggtgatcggtggtcaagggcaacaggaggagccatggagattggctctccttaaaagactggtggatgtggatcagaacagcccgggagaagcaaaaggtaaaggttaatccggatttccttgtgagctcaataatctgagtatgatcgtcttctccattggctgtttgaatgtattcaacacatgcttggtatagagagttgagagggagagagaaggtgagatcgagctgatgaaaataaaatcacatggacctctttttggtacagtcttcggaagcaggagagagtgtgtgcagtgtgatcttatattgtctttgctcctttcctttggcaggagagccttgcttgcaggcatgcacttgcccagttgtcctcttcctctgtcctcatttatattgtgcgggtttgtttcagctgttttcccttcagagagagagagagagagagagagctagtgctcctaggaggggggggggggaggggttgaagatcacatggtgacctttttttgggtatgtgacagcttcttcctttagtcttttagtgcttccttttatctcctcttcctcatgaaacccctttcaaaacctcatagcctcatcagctgatcactgagtgccttctccttctcctcctcctttaagaaccctcttccctgcccatccttttcttcatcccctcaactttgcctaaaaggcaagaacaaagccatatgattctctgatcccttcttccaagctgcatcccaacacaacacattgtggtgacacagcaaacataatatacacacatcctcttcttcttctaccaccctccatattcctgcaagaaacaactggaggaagaatcactactccaacaccatggaggttgccatggtctgcacaagagttaacctgctcatcctcatcctttctctctgctccccatacaagtttatacagagccccatggactttggccctttgaacctccttcccaccaccaccactgcatccagtgactttggtagaatcctcttccactccccatctgcagttctaaagccccaagctccaagggatatatccctgcttctcagcttcctctctgcctcacctcttggcaaggtgacggtggcagccaggggagcaggtcactccatccatggacaggcacaggcccttgatggcattgtagtggagatgagctccttgccttctgagattgaattctacagaagaggagaaggagatgtttcttatgctgatgtgggtggtggaatcatgtggattgagcttctggagcagagcttgaagcttgggctggctccaaggtcttggactgattacctctatctcaccattggtggaaccttgtccaatgctggcatcagtgggcagacattcaagcatggacctcagattagcaatgttctacagctggaagtagtcacaggtgagagatgcataatgaaacattaaaaaatattgataaggtcttatatttgcccctctctctctctctctctctctctctctctctctctctctctctctctctttctctcaacgtctttcttgcccaacgtcttttaactgatgggcagtagattttctgttcctctttgcttgacaggcaggggtgagattgtgacctgttcacccaccaaggatgcagagctattcaatgctgttcttggaggccttgggcagttcggcatcattactagggcaaggatcctgctgcaggaagctccacagaaagtatgcagctttagaactgtcctttgcatattagtatattattatatgatcttaaccattatttctgcatgtcatgtttctgacacgcatatatataattaaacaaatctggaatttcattttaggtgaagtgggttagagccttctatgatgatttcgccaccttcaccaaagaccaggagttgctggtgtcaatgccggttttggtggactatgtggaaggtttcatcgtgttgaatgagcaatcccttcacagctcctccattgccttccctacaaatgttgacttcaacccagattttggcaccaagaacaaccctaagatctactactgcatagagtttgctgtccacgattaccagaacaagaacatcaatgtggaacaggtaagctccaaaatttactctgctttttgtgaacttatcaagtcatggtaatgatcaaacaagtcttcatctatttcaggtcgtggaagtcatctcaaggcagatgagccacatagcatcccacttgtatagcgtggaggtgtcctactttgattttctcaacagggttaggatggaggagatgagccttaggaacagtgggctctgggaggtgcaccatccatggttgaacatgttcgtgccaagcgctgggattagtgacttcagggacctgctcatggacagcatctcaccggataacttcgagggcctcatcctcatctacccactcctcagacacaagtaagcagtactgcccactaatgctaaataggcttcacattatgatatgccaacatgagggcacagcaatgcgtggaagcattatttgtgagaaaaaggttatctattggttatttaattgatctctctttcatgatcagcaacattagctgccaagcagtcctagtaggacaagtacttgtctgcattatccaacgtggtgcccctttgtgttatagtattagtcccttttggcattaatatgttggtccattttttttcaattttacaactgcccagtgtagaagatatttacatgcctgattaggttaatatttcagtgtggggcgtctttttgctcttctttggaaacatatgttgctcttttcatagcatttatgatttgagtgtgttctcatcgattctgtaaatgttaatgtcatctatttatgatttggtagcatccagctatttatgatatcaggaagagagcctttctttttaataaatgatgtttgatttatccttctgcctagtcccacttaggttctaaagccctagtatcattacttcatcagtattctcttgttggtcccgcttaggtctgttcttgtggtaagaagtaaagcttctgcttttcacatattaagagggctggggcctgagggggatccattcttgcctaggctttcagcgcggcagataagtttcaggcttgcttcatccaaacgttggacacaagaatgggaatatgcgataagttaggcagttagtttgtctaatgctgtggcagcttatttttgttggaaagttacatgtttgcataaaataattttttggtcgaaagtccacacctacatggctacagcgactttatttgtagactgttgcttgattacgaattgtatcatgttttatgggtccctcaaaatagaatgccagttatcatcagcatattatgattcaactgaagcaatagcttaatcagtggcatcctacttttcagagtagtttggtcacctttgttcagtagcaacagtgaatatagaaacagaagttgcttgatctctcttacattttagttttttgacttcaatgaaaagcataccgatactttggcttgtttgtgcttagataaatatgcttattccagcccatgataaataattatctaggtcaaatggaactaatgttgactatcggcaaactatttgttgtgatgttgacaaggcacaaattctgtgcggtgttaaaaatcaaacaagttttatgatctcattgacctcagatgaaagaatttgtaatgtgatcctccttccaagaagtttatacaagtttatctgcaaggggggtttaaaactactcttggtggcaggcagagtcagctctaatcttgttgaaccaatgaaccttaacaaaagattcatgttcactgtactgaaataatttaacagcaccaatgtggacttcactcccccaaacactaaaacaaacctctcttgagtcagaatacactgaactagtactgaatgtcagctatattatcttgtactgctcatttttttttcatttctaataattctgatactctgttagatgctgggatatcatctaattgttgcactatttatgcctctcactgacaggtgggacaccaacacgtcggtcgtgttaccggactccgggtcgacggaccaggtgatgtacgcggtgggcatcctccggtcggcgaaccccgacgacgggtgctcccaccactgcctccaggagctcctcctccgccaccgccgcctcgccggcgccgccgcgtcgggcctcggcgcgaagcagtacctcgcccaccacccgaccccggccggctggcgccgccacttcggccggcggtgggagcggttcgccgatcgcaaggcccggttcgacccgaggtgcatcctcgggccaggccagggtatattccccagggacagcagcagcagcaatggcgcatttgcaagctatagctgacacgagaaagtgcagtgtagtgctgtgctgtgccgtgccgtgccgtgccgtgacagctggtggtacaataagagggggacataggataggcaggcgaggctaggagggagatcttgttctttcttttcgatagctttcttttctgcttcgatttgaggccggcatcgttttggttggttgatgtggttgggcgggggttgattttgaacggatcctcggtggtggtgatcaccatcatcactgggaattttggaactttgtacaggctgaggaagcaagaacagctctagggcgaaaggatagtgatagcgattctatttcgatctggattccatgctcgatctttggcgccattagtattaattgttgttgccattgttctcactccacgccattagtatcagtgacgccattagtattgctttgcacttagctcgtttgatttgttcgcacaaaccgacgccactttagttaaccaacttttacttttgttgggctagtgcagattgtagtgttgcgacccctttcgtaagtactctgttttttctctaatgccgccgcacttatgtgtcaagcagtttgtttgccaaaaaaagatgtggtcatgtggaagtgtaaagacagtggagtgccacacttctgaatcgtgtacggacttttttcgcagtggaaccgttttctgttttccctttttttttccccttttctaccaccaaacagcgttaagatgcgagctgttgtggttttgtgcatgatacgtcgattgattttgatgtttcatcggtacgactccataagtggcatgttagtatcttgtactgtatccacaaacacaccactagctgatatgaaaagccagctattacattcatacgagaaatgaacggtaaagagacgtaggctagaacaatccaccagccagcagctaataaaaatcgcctagtggtgcaggcaacatcaagggacgatcaacacgtagcagcaacacagttacatccacaccacaagacgattacatttttctcctccccaccaaagccgataccgaaaccaaatcctaacctttctagtcacctagccttttattacccaatcctccccctatcaaacgccttttcgccgattaattatcacaaaacacgttgtctagcttaagctaatccctcccccctctctgattagccttttcgggctatgttagatttgcatggatttcgaaagtggtgcgagatccataaagccaaagaggcaaaaaaaaaaaaaaagttgctagccagctactacagctacagctgctgctgctgcggccactgttctcgga

SEQ ID NO: 463 - DNA, 7379 bp, Oryza sativa; identical to SEQ ID NO: 286

SEQ ID NO: 464 - DNA, 3645 bp, Oryza sativa
cgagtgcactcccacttgcacccagggatatatattatcgtcatgcatgtgccttatgctcttgtcaagcaatattttttggcaagtttttgtccaggcatctagctttccctccaatgctatccatttctctgaacctagctaattgtcacggtgtgcaagatttctgcttgagatctgatggacatcttggcagggctgtgtctgtgtgtgcatgcgtcaagacaaacagcccaaattatatgcaacctgggaacaaattaagtgtgataaactgataatcatcgaccgcgctctcggtcgtgaactagtaggtccggtagctagcacgacatgtgtgcaagaatatttgtctgttctgcaaggtaattggaaggccatgaagttccccaattcttcggcaaagcagctactattcccgtttcaaaatataagcatttataatatttaaatttcatacacaatataagtacttttttttctagagaactgatttcaatgcatgagaattcaaacattttgcacccaatcaaatgcttaggtggagaattcaagcaaatcaaaatttgacaaatcagatgcatgattgtaaatggttttatactaccttaaaagaagatagtgatagagacagcgaatccgccactgaaaattttacatattaccctttaaacttcttaatattaaaaattaacatgaatattctctataaaaaaagatggataacatattaatacattatatttttttcatagtaaagcacgggtatttagccagtaacttaaaactgattatatcacatgtttttctaacactgttcctgcctggtccgaatggcgccaagctagagtcggtcaagcgagagagctaaattgggctgataaaaaatttgcattgctcccaatgcgtttcgtccaaagtacagcgagccgccgagcccatccagtatccacgcattccgcctgcccgcgcggccggccgcggctaccaccctccacccttcacggcttcgcacgcgcccgcgcgccgggcagatctagatgctatacccctccgcctgctactgctagctctcccccccccgtcccatgcacgcggttgcacgcgcccacgccggccgtagcatccgttccactataaaaaccccctccggaaccccacccctccacattctccatagcttggccaccgtagtaaagccggcgagctaattctagttctagccagctacacgagatcatcgctgtgacgggcggggcattgagagggcgcgtgtgccggccggggtcgatgcatggcatgtgttaacatgtacaacccggagcatcaccaccaccagtcgtcgtcgttcatggcgccgaggatatccttttccagcgacttcgcgctcgagccgccgccgccggcgcagcagcagccggcggtgcgggcgcctggggacgccgacttcgagttctccgtcggcagccacccgatgatggccgccgaccagctgatctccaagggccgcctcctgccgctccgggaggccccgcacggccacggcggcgccgacgccggcggccggccactcacgctccgcgacgagctgcgcacggacagccgccatggccgcgtcccccgcgcgcccaacattcggtggaaggagttcctcggcctcaagaaggcgcccaagaaggcccccaccgccgacgctgccgccggcgccacatcgtcgtcggccgacacccagatggtaataacaagctcactgtttcttgcgccatgaatgcactctgctacagctctgcattgtcccattttgcttgtcgcattgcaacatttttcgaatcttcaaaaacaccctgcttgctgcaagaccctcctgcgcagtagagtacaagcactttctgcttcaaagatttctcaaagtttggagcctgagatagatgtgcattgcatgcatgtactactcatgcattgctaaccaccagaaccagattgcacagaaattttagcggcacaactactcatgcattgttaaccattttcctgctgaagtgacaacaaaatgtatgcaaaaccctgtaggatcttggaggtcaagggagcacgagagactgaagcaacaaacgcaatgaagtgtattactgatcaatgagtactacgtagtagtgaaactgaagtagccatggttggccagatcggatgcatggtggcgatgcgcctttcagcttgctgtctgccatcactcatattcactcttgctgatgatcttagcagctcattctaatggagaactctgcagggcaaatggccatttccttttacctctttgctgcatcttttttgggtgtaaaagggaattttgatctctagtttttgggtaatggtcgtcgtcgggtagatgggtggttccagtgtagtcaaattaactccgctgcgcctctgatgttttgtattggaagggccagtaaaaatgtatttttccccacatggtgtggtcctagcttagcttttgtacgtgttgtttagctgttcccatgcttgtctgcttccgccacctccgctctctcccccactttccctatgtacaaaaatgcttgtaatctagtagtagctagcaattcaagctttcagttcaatgaagcccatttcaacgttaattagcttccatcaattgctgaacagtcatggagctaactagtactatgttcaaatcaggcaatgcaagcctggcctgtattcaagcaagatatggttcaattaaagaagaatggagagaacgtacagtggggactatatggacatatggtacaaagacacttgagaattcagtgaccatatacaacatatggggagattgtgttcttgcctccaacctttagatgcaattatgattttacctctgttttcttttttatgattttgcccttcttcttttttgacgcaaattttttttggacgcaaacccttcttcttttaaaacgaaacagagacaaaacagctagttggttggtcgaaactaggggcaaacagttggttcgttttaaaaaaaataagagttaaaattataaaccttaaaaaacataggcagagtaacaattgcatctaagagcataggcgagaacacaattaccgctatatatggatattgtgccagccagcgagtggcatgcatctgatgagccaggcgttcaagcattagtctatccggggtgccagccagcagtcgatcgagcagcttgtcctgacgcggccggcctcatggcccgtttagttcctaacaagttttttccaaaaacatcacatcgaatctttggatatatgcatggagtattaaatataaataaaaagaaaaactaattgcacagttatggggaaatagcgagacgaatcttttgagcctaattagtccgtgattagccataagtgctatagtaactcatatgtgctaatgacggcttaattaggctcaaaagattcgtctcgcggtttcctagcgagttctgaaattagttttttcattcgtgtccaaaaaccccttctgacatccagtcaaacgtccgatgtgacacccaaaaattttcttttccccaactaaacacgcccttagggccctagcacatctccctccctgtcgtgtaatgctagctcctcctcctc

SEQ ID NO: 465 - DNA, 4368 bp, Oryza sativa
aattggtaaaaaaactaaaacgagtgatcttcaattttattgatgacagctcttcttcagatcaattggtaaaaaaactaaaacgagtgatcttcaattatattgatgatgtgaattatgtattttcttactactctaagcctttcagatatactacaatattggtaaaaataaattgtcccgtccaacgctatatgatgtactgccgaagtttatataaaaatataacaatatttttcatacaaagaaaaaaatatatcaaaacatgttcaatattagatgtaaatggaatgctacaagtgttgttatattttaccataaacttggttaaaattttaagaagtttgacttaaaaaatttaaaacaacttacaatatgatgaaacggagaagtattctacaagtaaatttgaacatgatgtgaaatttcccaatccagatcaatgcgtaagaaattccccagtccagttcaaattatttgttctgcgattactagatataagctaatatatattttcatctatagtagatacaatataataataagagtgaattacgctttgggccacattataaatttgctattgttgcaatttggaccaccacgaacgatttttttcagtacaattaacaatcttaaacacatcaactttaatatacggccaaactcctatatgtatggttcatatgtttgttgaaagggaagttaggcatgacgagaaaaattgtttacggtagtccaaactgcaacaatgataaatttacccggtccaaattgaaaagataggtttaagggtagttcaaattgaaacttgggtaataaaaggtagaccaaagtgtaatatactctaataataattaaaagagagcaaaccaaataaagcccaaacagcaagtgctcccgggtccaccggtcagcacccagggtctcgaacggcccggataccccggctgcccccatcgcaccggcccaagccgcttctcccttctccagcgtccgatctcctattccccacccttcctcaccgcaccattcaccaaccgccgtctcctcctccccccactctcgccttcccccctctctctcctctcctctccgcgactccctccacccccgcgcgcgcgcgttttttttttttcgtaaggtacggatccaacgacgctgctcggctgctcctctccccaccaccatctctgatggtttgttgctgtgatgatgatgatggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgagtgagtctgcgcgggctcggtaccgtgatcctgccctccccacaccttcttttgtgatggttggtttagggtgtgattttgctttgctttgtggtttgggcggtggtgcgggatgggacagggcgagcgacaaatgtcagaaggagaagcgcaagaccatcaacggggaagatctcctctttgcgatgggtacgcttggctttgaggagtacgttgatccgttgaagatctatttacacaagtacagagaggtaattgtgcgcttcgtactctctgccagtataaatgttaaacctttcgttgttgtatgaatatctgatgtctcttctgtcctcctggcaaatttgcaatacgtggggatgtgcactgttaactgcagatggaggtacaccatctaccattctaccctcctcaaaatccccttttttccccaacaatatgctatggtttcatgtgaattttttttttgtcaacgcaaaaatgtgtcactcttgtaatcctgcttttagaacaatcccacaaaaaattgatatgcaattatgccctttgattagagatagttggtgctcaacatgaaatgtacatatcctactctgaactgtaaggttaacacctgaatcattctttcattcctctgcttcatatacattgaaggaaagctaaccgcatccatttagtatgtcactgttcaatttgcctggaaatatatatttgtgccttagtaatactctaagatctatatttgtgccttagtaaaagatctatttttgtgcatcaagattcaagatgtattgagttctaaccataccactattccttattcttggtagggtgatagtaagctgtcctcaaaggctggtgatggttcagtaaagaaggatacaattggtccgcacagtggcgctagtagctcaagtgcgcaaggggttggtatcagtaacttgtactgctttgttctttctgatgtttgaaaacactgacatactgataatatttttagatggttggggcttacacccaagggatgggttatatgcaacctcaggtaacctagcactagcatagtatcatttgtcagcacaatgctatggttcatccttgaagctaaacaagatataaagtaataatgcacattcaactttttttttctagctgacactgtttatgccattacacgtgcagtatcataatggggacacctaaagatgaggacagtgaaaattttcagtaactggtgtcctctgtgaggtaagatcttttgtacagaaatcatttgccatccttggggcagttttcagttagatgtttttttcactaaaaattgcccgttctgtctcaaggttcacatatactacatctgtatttttttattctttttacatgtgaactctggagatgttgagctgcacatgtgaaaaattctccgagtgcttttatactttttcgcgctcttctagttctgacacaatactcccttttgctgcagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataattctgtaacgtccgtattgtttcgactgtgatgcttgccgtatgggcaatggcatgtgttctagagggggcattcaatatttaggtatctcaagaatgtaccaaatactcccttcgttcaattcagaaacacctttttttaatgagtgaattgcacttaggactaggttttattaccttagtttcatattagactaggtatttgcaaatgttttcagattggactaggttttaataccttagtttcatattagactaggtatttgcaaatgttttcagattggaccaggttttggaagctaacttcatttactgcattgatgattggagtaattcagttagatgttcttttttttttctcttctactggaacgctgatctgattagaagtagtttagagtactgatcaaatgtgatgtgaattgggtatgtatgcaatctgaatttgagtactgtcagtgtgacaaataagaattgtgtatgtgatgtcaatccgataatgcccatactaatgtcgattgaagtaaatgtctgtttgggtaatcctacgttttctttgttctgaagaagaaaaaaaactatgaaaaatgttatatggttacaagtatgtttggggagttgtctgaatgacacaggtttacacatacaggtcctgaatgtcaattggagtacaggttaaaaggaatggcgtcttttcttaattcacttaatttacaggttaaaacatataggttctgaagtacaggtctgtaagacatcttggcaaactggttgtaatggctgtcgatatcctgaaacaacgaaattactagagatctcacattttttcttgtgcgatcatggcatgatgatgatgttaatttgctgaacaaaacgtctcattgtctgcatgttatgaacaccatctgctcttgacattagttcatctcattttctctagctgagataagcgaaacaaaaaactgaaagagcctgacccaaaagctctgtaagttttattttgaatctccgattcttggttgccatctctaactttgcaagcacatattattgtgtggagtacaatactgagaagcattcagcaatgttctctcacatactactccatcctgctagtctcctgaagtggctaaattttctact

SEQ ID NO: 466 - DNA, 4731 bp, Oryza sativa; identical to SEQ ID NO: 391

SEQ ID NO: 467 - DNA, 4285 bp, Oryza sativa; identical to SEQ ID NO: 392

SEQ ID NO: 468 - DNA, 2504 bp, Oryza sativa
tattacttataccaattaactaatgcagagggcggggagggcggggagggcagggagcatggctacatgcatgtgtcctagtcttccctcaaagctttttcacctactgctagtctactacaaagataggtgaagtttgtccttgtttttttttttcaaactaagaaattttttcaatattttgtttgaaaatttctacgattttgagtgccccaaatcagcatttctccttcccatatatagttggaaaagtcagccagccttccaacggcacagagcacaacatatttgtagcagtgtgagaatcttgatcggtgtaggagtacataggattattgcctgctgagagtgctgacagtacgttgctgtggccgcacatttgtgttttgtacgaatcacatgtgtcattttgcagccattactctctccgttctaaaataataacttatagattgttcgttttgaatgaaaacgaagaatttggattcccaatgattaattcatataagtacacgtcatttgattcgtagaatatatatataggaaaaccaaaggatatttttctttcatacaagttgtggagagaaaatataggaaattccatccactcaaatttcttgaaaaaaaatcctataaattgaaatgtgcatgttttactattcctccaattttcctattcttatgggttgaaattcctctaaaccgaataagcctttagtactagatattagtccagattcatggtattgtatgctttaaattctaataagtactagatcgctatattttgagacagagccggtgtagctagcagccacatactatagacgatgtagtagtacaccttttttttcctcatataattggtccctttgatacatttaggggagaaaagtctatatgaggaataacggggaagcacctgatctagcaatccaaaataaactcggattcggaaataactagcttttcccaatatagcttgtcccattttcctttcatggatccctcatcggcttcttggccggctccggcttctccgccggtggagctgtccctgtccctgccggcggcggcggcgaggaaccgcgacgaggcggcgccgacggcgatcgtcgacggcaagcaagtgaggctgttcccgtgcctcttctgcgccaagacgttccgcaagtcgcaggcgctcggcggccaccagaacgcgcaccggaaggagcgcgtcgccggcggcagctggaaccccaacgtctacggcgacggcggcggatcagcgtccatgcccatcgcctcccatggcgtcacggcggcggggagtagtacggcagccgacggccggtggtgcggcggcgctgccagcgacgacgacacaacggcggcgcccatgccttccctcggctcaggctcggcggcgctcggcgccggcgccggtttcgcttcgaccgaaaggggctcttccggcggcggcgtcgccggcgaggagcttgtcctcgagctcggcctctagatcatctctgtagctagcgtctactactacttcgccatatgcacgcaataatccatctctatctccacgatcaccatgatcggatgatccgcactagtacgtcttattactcgatcgatctctcgtttgcgcctccaattaattgcaagctgcgaatcatgattcatggatgataagtaatatccactacactgtatgttaatgtttccagtactgtttgttagtaatttgtgtttgtgacttgtggcacagttgaattgttatatggtttaaaattttcccgtaaacacagtagaaacgtgcgcgtcgtgcatgagaaacgcatgtgcttaattacatacttgcacgcagatttacccctatgaataatagacaccctaccctgatcagctcctcagtatgaatgaacacactcaccctattatctcctttgagagactcagctggatgggtgtgtcgcctataactagaagaaaaattaaccgtaaattggagcacatatctcccaaaagccggatcaaatcatatttggtctgatctcaaaaaaaaaatattggagcacatatactaagtctagaacttaaatccgaacgggccagttccaccataagaatcctaactagtaaagacctacgctcatttcactgaattatgctcccaccggtttttagtaaataatattgttgacttttgacatgacatttgaccatcgttttattaaaaactaatgcacaaatgtaagtcatgcttaactaaaaccagtcacaacaaaataaattatatttacatactgttttaacaagacgaatggtcgtcaaacataatgttaaaaattaaccgcatcatctattaaaaaaatgttggtagtatataagaaatacaggtttcaaaattttcaaatctggaacaaaaataaaagacattcacgtccaactcctatctagtttgctctattctccacataaactttgctgagattgaaaacaaaagcagcagaaat

SEQ ID NO: 469 - DNA, 6114 bp, Oryza sativa
cacctcactccgatggagccaccaccagcaacagctgcagttagccatggatgatatgatccattggaagagtagctagctagctgctgctgctgctactcctagctgaggtgatgaggtcctccgttctgtacgtacctgtccatgagatcacatctcatgaatgggaaccgtccggcccggccggcgcccccggcgtcacggagcgtacgctccatcggcgcaagcgccatgtacgtacaccacacaacaccccccccccccccctactagctacaaccttcttcagttctccatcccccacatgctacaagctactacatgccactagttgcacatacctgcactgcatttgcgcgcgtgcgatcatatttatgatgtacatatgcgtcagatattttgtttaggttcgtactaataagatatgttatattcatattatgttgttttattttggaataaagcgagtatgctactaaggccttgtttaagttcccaaaacaaaaaatttttcacccatcacatcaaatgtttggatacatacatggagtactaaatgtggggaaaaaaccaattacacagtttgcgtgtaaattgcgagacgaatcttttaaatctaattgcgccatgatttgataatatggtgctacagtaaattttgctagtgacggattaattaggcttaataaattcatctcctagttttctggcagaatctataatttactttgttattagactgcgtttaatacttcaaatatgtatccgtatatccgatgtgataaccaaacccaaaaattttcccccaactaagcaaggcctaaccctggccggtcgatatccatatatcatggatcgatcagcctgttgcattgttcaaggcgcacacatgctatagtgacgtaccatacgttgaaacaaccactactactaccactacgcctaatatacggatggaagcaatggaaaaacggtggccaagcataaagcgggagcagcagaggccgcagcagcagcagcagctatcaccccctcaccaactccaattaagatagctcccggccaccccaacccaagcccttctcttctctctccctcttctggtttggtttgttgctggccctagcatcagcgagagaggccagaggcagacaggcagctgctgctagatatagctagccggcaacgcactccacatccagccgccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccatacctagaactttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaacaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggacgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcaggtcagtgttcatcgtcgtgtttagtttgctgctcgaattcactattctccgatccactgttcatcgatttcccagaagaggatgctggcccgatttaatttgctttgtccgattgattggtttaattaatgagacacacatcttgttgcggcgtgtttaatttgattggagaatatgatttgtaggatcagagagttgcattaattaagtgatctggaagttccattctgctcactattgagatcatatcgaagggtgaaactttaataataaatctcctaatttaactacctaggatttaagcttttctttttttttcatacaagtaatttcagctcatcattagccgcctgtttgccctcaaagtaattacgttagttggaacagtcagatgaaattgaagacggcaattgctttgaactttaattggatgtgtggtaccatctttggcctcttttcctgagttcttccggttccttgcctcatgaacccatgagcagttcaatgcttgctctacatttgcccagatttccttgcctttacatttctttgaaagagagatttcttcctatacaattatctgattcttaactgcttaaactgatatttctagtattttttgatgaacaattccctaatctgttctcagaaatttgagctaaattggatgcatttagcaagctattgctgcatatttgatatatacgtttagccgatttcgcaattagctatggtgaggagaaaattttgcacccattttatattattgcctacactgcaggctaattaagataattcgtgtactatagttattaatctgttcggacacaatatataaattttgaattatcgctgttctgaacacataaacgttcattcgctttgcaaaacaaaattacaaatagtatgcgtgcatgtttctaggtttacccaggtgatgagctagagattcatatgccatctttttctttctttgtgtttcaaattaaagatctttctttggagaaaattgtgtttcaaaatattgatttctgtttaattaaattgaatcctgatcactatctatcacatgctgggacttgggggggaataaccaatatctgtacaaatacatattgatcttgtcctagatagagttgcttattttctcctcctttggttattgttccttgaaactagcccttcccatttatttttcttgacttctccttcgcatgtttgagtggttacttccaacagtattcgagacgtctgtacatgtattttggcctcacaaagtcagaaacaatgcgactttctttgcaagtatagcaaagactttgtacagcccgctcacgtacatatgtacgtaccagcacaagttgcatttgcaagcaacgtgttctttctctctctctcattctttttttaccctgaatgtgtggccggccgtcagtaacatttacctcactgagatgaacggctcggattgattgagaaactgaagaagaaactaccttcgatgcctcctaagcatgcacgtgttaagctcagcaatgcatttaagggaaaacaggaaccttttgcagtatggcacaccatatggaaacactccatatgagtcagctgcaaaactccaagctgtctctgggatggaacagtttaggtgtatgtgcttctcgtgctcaggatcatcattagcttacatattggtccccagaatgttcttttcatcagtagtttcttctgaactgaagtttgatctggcctgagcaacctgtcattttgtcttcgctaatgtgcacgtttatgtaggaaatatgcatgcaggatcatgcaacaagcttctcaatcgtagaagtagtacttcatcttccatatcctttatcgttgtaccgtagtatttcatgtgtattcgtcttcagctcttcgtagttgcatgcatccctctcatttctgtatgttaaccttttctaacctgttcaattattcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacagtgcgtgatatctctctctctctctctctctctctctctctctctctttattcagtattttcattcatgatctcaaccacctgaaaatgcatgaatataacatattctacaccatttcctagatagtcctaagatatgatgcatgaatgggttcttaatctgttcaattcctagataattaaccgatattctacaccatttccttcataattgacagaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactagtataattaatatttatcaatcatctcgatctctccttctctctctctctctctctctctctctctctctctctctctctctctctctctctctctctccctcgtacgtgtgtgtacgtccagacatctcttttcatcttgtctctattaattactgtaatttggatataataatgatagcttatgcgttattgtcatgtgtactggcagttttcctcgttggagaagctggttaattagccggtacatcaaatttagtgtaatttatagtttggtgccacaagaggctagttggtcaattaatttcatctaggaagaatgcaccacatgaaagttgtacgaatttctacataactacctgaatttttcgtgcaattgcacatggctagatattgtagttctttgactatatatatatagttttaatttattttctattgtttttgtatttatttccaaaataaaattgtatgtcttatacaattgaattacgcatcactctaacatatatatgtacaaaatgatctacatatctttgtaatatatggatataccctgatcaggaaataaatagacatttatatttttaatattatagtcgacatataactagatagggcgctctaaaacaactatccactaccttttttttcatcagcgagaaaattttagtatagtctaaatacatgacgaattgttaattttttgtttaccggaaaaacagtgggggaagcctccacggttaaatttcatatatattaaaaggaaagaaagctgtacatgtaagaatttgacaacttaatttgttaactttgcaaggttaacgcacaatttgcttaactttgctattttccgcgacatgattctctttgttatcttgaacatataatcgcattgtccatcatggtccataaaaattgtcttatatacccatatatctaatgtcaataattgaacgtagggcgcacatcaaggcacatacacatgtacgcaggggatgcgataaccgaaaggttcatggtcgtatataataaacaagttaggccagaagagatatttactatacatcatccatgatctgatgacgacaaatatcccattgtattttaattatattatcatttatcaaaagcattcactgaatttagttggacgcatggttacagtggaagccaaacatgatcaaatcac

SEQ ID NO: 470 - DNA, 5623 bp, Oryza sativa; identical to SEQ ID NO: 401

SEQ ID NO: 471 - DNA, 8090 bp, Oryza sativa
cacgtcgtcccctcgggttacaccaccacatcgttgcgtggcagctcgccgcgcatctgcgccgcgtccgcatcatggttgcatatcagccacaccgtcgggattggcgggaggatctccaagagttgggagatggagtacgttgcgacgcctgagcatactcgcgagcaccactgactgcatgagtgcccgtgcatgcaagcgaagaggacgccagacgctgaatcgcgggagaggtgtgtggtggccggtgaccagcagggagaatggtggtggttgttgggcggcggcggtagatagaagcccgacgacggcgcttggcgatgggtggggagaaggctagcaacgaacaaaaagcttggcgatggcgagcgttggggaaaagggcgcatgcatcgaggacgatgctaccgcaacgtggagtagatggagttgacatcgaagacgatgcggcggagccgcgtgtttgcctctgcggaggagaggcgaagctcggggacacgtgaacacatcggcttttgagcagctcgatgggggcgactatgagcttgggggataggagcttggccagcgtgacaaggcggaagccccagccctcacgcgtgcccgtgaagacgacattgcagttgtagttgggacccgtgccacaccccgcacgtgcgcaagtccatgacgtgagcgctcctggtcattgggagccacgtcagctggcggcctccgccgtcgagcttttccccgccgaccgacacccttctccccacccatcgacgaatgccctggaggtttgggttgagatgggagtagaggggagtgaggtggaataagattgctggttggcttgtagggtccacgtggggccctacactgactcagccaccacgtcaacaaaaccggaaagcaattctaccttgggattaaaagtgatccgttttgcaagattaggggttcaaggccgtttaaaattcaacgacaagaaaagggaccttagatgaacttttttgggagatgaaaaaactccagcctcatgggcctgtgcatatgacccataggcaggcgacaccgcggcagcagagcgctgcacgacctccgcctcccccaatccgtcccgtctcctcgcccgccgccctcgactcccgtctcctcgcctgccgctggcgccgatctccatcctgctagcagaggtggcgccggcgtcctcctgctcccgccgcattcgctcaccggtgagcatcctaatccatcccatccggtctcggtctcggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcagttattctgcgttatccctcaaaaagtttgggggttcaaccgaaacagggttagatctccctctgcctagctccacctactttcaagttgttaattttgatttccgtttttagcagatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcattaatctaatttaactttttttctttatcaggttataaattttctaagacatttgtgccacttggcatgaatctaatttaacattctttctttatcaggttataaattgaaaccattgaatgtactttgtcttcccgtctctaaaacattgtgatatatctataatattttaatatttttaagtttaaaaataatttagactaataatatagatatttaaattaggtaattaataaattcaaatcaactatagtttagaataaaaaaacaaaataatatatgccaagtacaatctaataacaatagaatgttagaaacaatatgaattcaatatttttataaattttaagtacgattcatacataaaattaaagaaaaatataaatttatatataagtgagaacataataaaatgcaagttaaaattattaaaggaaaaatattattaataaacaatgatgttgatgtatttctaaatattttcacgtattatttattaagtgtcaatgattgaaatggatgatttaccatgtaacagattaattattaaaattatattgttttcatccgttacaatgcacgggcattttactagtctatataattgatcgctctatcaataaaccttaatatcgacaagtaaccacaacgttaagccattgatcgacaacctaaaagctacaactgaccataaatttcactggcttagatgagatgtaaacacataaataaaccataaaaaacgagaattcggagatgatggcaccccaagtccccaactccaaaccattttccggacaaaaaaaaaacattcaactctaaaccacagactcatgagaccatgtaactcaagcaaatctgactaacaaagataactcgaaatcaaatcgagaaataaatgcagatttgctaaaaagacgtgtgtgaaccggtcccaaattctcacaaatctgatccatgaaaatctgcagccgttatgaacttccaaatttggttccaaactctgaacttttgctcgccctactaacccccctcacaaatcgcccaaaatccgaacgacgccgccgccggaatccgccaccgccgccgacggaagcaagggcaggtcaggccgtcgtcgggagggggggagaggagaggcgcatggcgaagctggggccggggcaggggctggggtgcgaggcggcggtggggttgctggcgccaagcaggaagagggagtacaaggcgtgcaacaagctcaccgaggggaagcggccgctctacgccatcggattcaacttcctcgacttccactactacgaggtcttcgccaccgtcggcggcaaccgcgtaagcatccccttcttgttttgtttttcttttcttttccccgtttagagttgttcttattagtgatgaataatgatatatatagagagagagaggaaatagggttttgatttagcaggctgtggattttgggggaacaacggattttggtttgaaatttggtggaaaccgcgctaagcatcccatcttgtttttagggtggtctttgccatttggagttgttcttgtgaatgaatgatagtaaatgataagtgtagtaaatgataagagagagagaaactagggttttgttttagaagattgtggatttggggaagattacgcagattttggttcgacatttgatggaaatcaaaagctagtaaaatttccttggaatttgaggtttctaccattttccttttgcatcgaacaatctgcgatttggcatacatttcggcagatttgatgaaaattgtggtttttctgggatcaatcatatactagacaaactcttttaatggcaaatatgatgaaagatggttgtctttagtgggctcgtgtgaccaattgtgttttcttgatcttgcaggtgacaacctacagctgcctcaaggatggtaattttgctatcctgcaagcatatattgatgaggatgtaagctccgcaacaatctccagtgtgtgcagttactttttttttaaaaaaaaaaaaactttgattgtgacattgtgtgacacttctaactctttttaaaaaaaactttgattgtgacattgtgtgacacttctaactcttgaggtctgcattcttttctcagaaggatgaatcgttctacacactgagttgggcttgtgatcttgatggcacaccgctgttagtggctgcaggaagcaatgggatcattcgggtcatcaactgtgccactgagaagttactcaaggttcgatagtgccatattctcatatgcttctatagttcttggcaaacttcaatgaaaattcatttttgagaatctatgctcttttgttatccgacatacccatgattgaagctatgcttcagataatagttgcttctttggtaaatgttgatctgtctatcttatccatttaagaaggtcacttgatatttgcgttgattaagagttgcattgctatagaattgtttttctttttgggtctacaaaagtgtaatttttgggtacactcctgcttgctacgtggctgatatgacactatctgttgattatgcattatacgtggaaagttttgataatactatgatacatatttagaacaccacaaaatagggcacatcaacaatttactcttaggcataaaattactatagttcagatctattttgtgctcattgactcttgtgcgtgtattttatggcctttcatttggctatgaatgagattaatctgctgaattggcttttgtccacaaggtttgctttgtagtcttatataggagagaagaatggtggaagatgtagaacctagtggatcttttccagtgggacagtcagaaaattgggcatatcaattatttactgtcatatactggtgtgagggatttagggtgaatgtcttatttctgtatatttgttcagacttttgttggccatggcgattcaataaacgagataagaactcaagcattaaagccttcgctcatcatttctgcaagcaaggtttgaagatagccttttctggagctggatctttctatgtttaattatttctgattctgtttcacatggcattgcataggatgaatctgttaggctgtggaatgttcacacagggatctgcattttgatttttgctggagcaggaggtcaccggaatgaagtattgagtgttgtaagttgattctatttcccagtatgatgttatttagaataatactcactacaaaccacacttccagcttctgatatcatctttttcattgagctgaacatgttttagttgattccatcagtaataaaataaaaattaggttccacaatgacagtcattttatttgtagtccgattacattaggagaaatgttgatcaactatgctttgctgcaggacttccacccatctgatatctaccgcatagcaagttgtggcatggataacactgttaaaatatggtcaatgaagggttagcaagccatctcaacatagcttttttatttgcattcactttatgcttatcattgacactgttagttaatattatcatagaattctggccatatgttgagcaatcctttacatggactgaccttccatcaaaatttccaacaaaatatgtgcaatttccggtatgctaaatatcttttgatcatctttgaactattattttgcaagattttgttatttcatccatgtggcatcataccaatctttctctgcttccaggtcttggttgctgtagtacattctaactatgttgattgtactagatggcttggtgacttcattctgtcaaaggtcaaacttcatcttctttgaatggatttatggattggtagagatacagtgctcataatgcatccatactactgatgcaaaacttcagtaggattctcatcaatgctaacttcaatttgcagagtgttgacaatgaaattgtgctgtgggagccaaaaacaaaagaacaaagtcccggggaggtgttataattcaacttctctagaactacagaccttaattcattttacttgtcttctgatctgatcatctcaacagttttctgtcatgttactttagttttcactatccctttccatacgtctccctctcaagtaaaattactttttttttttcaaatgtagggtagcattgatattcttcagaagtatcctgtgccagaatgtgatatctggtttatcaaattctcatgcgattttcacttcaatcaattggcaataggtaatatctcccaaattgtgttgttactttggaaaatttgtgacaatattgaaaatgttttgtttgtgggaaacggtcatactcagtactcacaagtcaaaagattacattcaataaaaagaattgtggaatgttgcccagcacccttaatgttgtgacaaaaaagaaactaattcacatatttaaactcattgggtttagattattatttttaaacaaatactacactgaatactcaaagataaccatgtgcttatttaaacaggcaaccgtgaaggaaaagtctttgtctgggaagtacagtccagtcctcctgttttaactgctcggtaagttccaagaacttcagttgtttcccatcctttatatgcacttggttttggacgccactaaatcttgtatttctgcatgccaacacattatttttacaggctgactaatccgcaatgcaaatctgcgataaggcagactgccgtgtcatttgatggaaggtgcttcactaaattctaatatccaatcctcataaagtgcatattccagcttttacttgcccacaattcattttggtgaagatcctgtgcattaagtggatgcatcgttttctgcttgtgtccttgtttggtcttcaatgccccgacatgtgtgacattttttctctcttgttcagcacaatccttgcctgcagcgaggatggcagcatatggcgatgggatgaagtggaccatccaaaagcatgaaaagtacccttatagacagaccatggcaatgccagattaagattgacttgggaattcctgcatgtgtactttgttgtgggggttatagtaatcagtcttactgttgaaaaaaagtgcaatctgatactctgaaattagaaggattgacagctgaatgctggggttaccaacttgaatgttgcaaataggatactgcttctgttatatgctgaatgtttcaagttagggcctttttgtaaatgggaagattcggctatgccagatttttggaaaagttgccatttgctttgttaccaaagttgcatggcaaagattggcccagctcaaatttctatagttataaatgagttgccaaatattttggcttcaaacaaatgggtgccactttttattttttggtattgccaagtgccaactactagaatggtttctatcaaaaaaaaaaaaaaaacctactagaatggttcagtttggctgtaaaccaaacaaaccctatatgccctatgcctctatgtatttgcttgtattgaccattattgttctaattttgaccatcggtaacattttaatgattagattacgagtaaattgcacccacagtgcatcagcttggcaggtgggtgtaatttagtgtaagaacttgagaaatgagcgttctagtataacaacttggcatgtaggtgcaatttagtataagaactttataagtgatcgtataaatgcaacaacttgcaagatatgtacgattttaataaaataaattaagaagttatgtggcagtttaattattgagagcatttttttatacatacaatttttaagtacttatgttgacaatatactagcgtggatttggatataaagaaaacaaaaattcttaaaggtaattggatgtgcagtataattcttaaaagattaaattcaatattataaggtgatatccataggattgctatgtaatgacatattaacatcgtgagaaaaacttacctagcatatgcctagctattcttgtactaaaacgcaaccacttgtcaaattgttgcactcgagcgttcaattctcgagttcttgcactatattgcacctacccgctaagttgttgtatcgtgtgtaatttacttttagattacgataaataaaaaagagctaaattgtacttgtttttatgcagaagttgatttttgttaggacggtggagactgtagtttagtgaaaatctagaatgaacgtagctcaactggttaagttccttgtgatgaaaccagcacactcgggttcaaatcctaaatgtgacatgtgtgttcgtatttacgcctaatcattcttttagtggtaagcgacataccagttgatagcgaggcacctgtg

SEQ ID NO: 472 - DNA, 5787 bp, Oryza sativa
tccgcgcgcacacttcccgaactactaaacaatatgtttttttgcaaaatttttctataggaaagttgttttaaaaaatcatattgacccatttttgaaattaaaaatagttagtattcatttaatcatgcgttaatggctcaccttgttttgtgtatcttctcgatactcttctcctcgaactcagtctcctctaaatttaaattggagaacactcgcccctcctctttctatatcatgactcgatcaatccatcttgtttaaccactagtgggacgctactatatctaagttttacgttaccgttggtaaccgcgccgttaccggccttaccgcgggggtacggtaatagaaataccgcggtaacctccttaaattcaaataaaattaaaaaataatttgaatttttgataaattttatacgggtttgtacggtttttcacggttaccacgcggtaaccccggccccggcggttttggaaaccctgactatatctcatagagcttatcggaggtcgccaatgcgcaaaatctatttaaaaaacatctaatagtgtatcggaaacatatacaagtgaatggacaaaaattaatcacatataataaaaaccaacaattattcatatataagaagatttcaacgtgtacttaaaaagttaggtgagaatttatctggttgaaacaacaaagtgcttgacaactaagagttgaagcctcaattattgcaccaacgataagttcacctacttttttttctctctcctcccaccttccatggaaaaatgtgctgcgcacaaaaggaatctatggccactttggtgtgcagccaaaaacatccagaaaaacctcttgtaggagggcggaaatgcgttcccacagctcacctctccgcagaagatccttgtgtctgtatcgtccacagagccaagcccttacaccgccctgtgaacagtcactgacaatcctggcccacgcacgggtgggtcccacccgtcagtgaagtggctcaggcgacatggtcgcaggcgcgcctgtgggtttcgtctacactagtcgtcgtcgagaggcgcggaggcaacgccgtgtggtcgccatcgccatcgccttcctcctcctcctcctccgccgccgcgcgcttcctcgccaccgcgcgcccagggccatcggcggcggacgccctcgcccacgcgcgcgagagaggggggcgagagattatcggacgagtcgctttgcggagctttctagaatggtggtaagggctcccgctccccccctccgaagcctcctcttcctctctcctccaatctccatcctgctgctgctgcatgatgttagtttggccgtgccgcggcggacgaccctcctcgtcgttgttcgtggattgctccgtgcacgattaggttgtgggtttccgtttgggattgggatggaggggctcctctggtctgtttagtcgcgaaagaatgatactttcttgtatgttttgctgcattttggatcctaaaattatctgatactgtattgatgtcgcgcttgagaattcgattttgcgatgtcgcgtgaacagttcgggcttgcggagcgtggaggagcagaatatttccccccttttgatttggatttagggtttaactgtttggctatccccttgaaatttgatgagggctacgtgatataggggtggcagtatgcctcatacaagatgctacattcaacccgattcagtacttgcgttaatttttctcctctgaatcgccttgttttcactgttagtcgggatatttcagacgtgttgcttaatttatgtcacaggactgggcttcagatagcgacaatgataagttcgagtgggacacagacggtgaggctgagacctcatctgccccggccctaaggaacatagatgctcctggtccgtccacgaggctgccgcaggtaggagatagaggtctatctttgaacacacgtgctagtcatttgttcaaaccatgttgttactttactgtaattataatcaaaatgtggtgtttgtttgtggaactgtctgaaggatgcaaatgggaaggccaacgggtcaggtgctttggttgctgaatttatgggaatgggattcccaaaagaaatgatcttgaaagcgattaaggagattggtaacgataacaataatctagttctcttatttgcttctggttgcattttgaatcttctgtttcaactgctgtcttttctttcaggggatacagatacagagcaattgcttgagttacttctgacttatcaggtatttgcccacatggttgcatcactctgtttattattatctaatgctctactgtacaagtgatgccgtgtaatgcaggcaataggcggtgacgcttcagtgggtaactgctctgcttcggcctgtgccccccagactcttgaagtcgacgaggaggaggatgatactaattgggatgaatatgatactgctggcaattgtgacaggactcctcactctgatggttctggtgacgaggtatttacatgaccccctccttggtcattatatatttatatgcacttgctgtgtctatttcttgaccagtttccctgatcatggctgcaccattttttgcacttgcttcatgctaagaacacattcccttattaatacctatgtaagtgaactactggtcgtataataaattagaaaatttcatacctgtgttctatttcactcttagtaaacaagtatagatatggttagctatactgcagtgctgtagtcttttgtatctataaaaccatacatgtccctgtagggttgttaaaggagctttgttgatccagcccttccttccatcattctatgcatctccagttagcattttctttatggtgcctttgtagtgagagttagcagaactactgtagaaccatcagagagaggatcatatatttggtagcagtaaattgtaggctttgcaaatggtatatgtgtataactgtatatgtgatgcctgcattagttgctttattaataggttattctggactgcaagtcattagagagatgtaacaagtgttttcaatttgcctttaatgtgcttttatgcaggatttctttcaagaaatgtcagagaaggatgaaaaaatgaagtccttagtcaacatgggttttcctgaagatgaagcaaagatggctatcgatagatgtggtatgcctctattgaatttgatgctttgacaggaaggaaccttattctgctgcctttgttggcttaaatttcccaggtctcgatgcgcctgtagcagtgttggttgattcaatctatgcatcacaggaagcaggaaatggttactctgcaaacttatctgactatgaggtaccttgtgattataatgcatctgaatcaataggttgtttcatttcattaaatataacggcattggcatcatctttataattgtgcaggatacagagttcagttcctttggaggaagaaagaaaacaagatttgtggatggaagcaagaagagaaagcggtatggaagtgggccatctgggaatcaagtgccgtttgatggcagccacgaagagcccatgcctcttccaaatccaatggtgggattcagcttgcccaatgagaggttaaggtcagtccacagaaatcttcctgaccaagctcttgggccaccattcttttactatgaaaacgtggccctagctccaaaaggtgtatggacaaccatctcaaggtttttatatgacattcagcctgagtttgtggactccaagtacttttgtgctgctgccaggaagaggggttatattcataacctgccgattgagaacaggtcacctgttctcccaatgcctcccaaaacaatatctgaagcctttcctaataccaagaggtggtggccttcctgggatccaaggaggcagttcaactgcttgcaaacttgtatggcaagcgcaaagcttacagagcgaattcgttgtgctttgggtagattcagtgatgtaccaactccacaagttcagaagtatgtcttggacgaatgtaggaaatggaacctagtttgggtcggaaagaataaggtcgctcctctagagcctgatgagatggagttcctgttagggtaccctagaaaccacactaggggagttagcaggacggagaggtacagggctctcgggaattcattccaagttgatacagtagcataccatctctctgtgctgagggacctgtttcccaatggaatgaatgtcttatccctgttttctggtattggaggagcagaggtagctctccacagactggggatacatatgaaaacagtgatctctgttgagaaatcagaagtgaacagaacgattctgaagagctggtgggatcagacacaaactggaacgctgattgaaatcgccgacgtgcggcatcttactactgaaagaattgaaacattcatcagaaggtttggcggttttgacctggtgattggtggcagcccgtgcaacaaccttgctggcagcaaccgccatcaccgagatggtctggagggcgagcactccgcgctcttctacgattacattagaatattagaacatgtaaaggctaccatgtcagcagtctagtttaagctatcacattaactaactctgtgatttattgttgttaacgaagttagaacctgttgattgatattgctgaacctgatgtgatgttattgcactcaaacaggagtgttttttccccttcatgtcatgattatatgtttcggtttttgcggcggtacgtgatgctttgcaatgttcccccaattttagtagtacttgcagttctggtgctaaagatatgaagattgttgattgctgaagtttatgaaagtatttatgattcgatggtgcaatctgccgtgatattattgccctcaaataagggtatttctttcttcatttcatgattgtatattctggtgtttttgtggcaaccctgttgtaaattggtttgtgcacaaaaacagagttcaaaaacaactgttggccccaacaaatatcagaatctgggaagcagaacagaaaaggacagtgctgtacgcttcagccactcccttccggtgaagagttgctcaccacattatgttcacctaacaaaaatatcccacttcaactggcagatatcccaccacagctcttccaaggctccaaccccaaatccaagccataaaacctttgcaacaaccatgagagctaagcttccaagctctgaattttcaggatgttgatgccagcttctgctcagatccctcatcacacaatacgtcctgttgcaagttacttagttctgcatcgacggcgccggcacaagtctgaccggcgtgagttcttgatctcatcttggggttcaatcctaatgcattttcagtttagcatatggccaaagttgagttaaccatattcctcatgcaggttttagattgcagggtcctacgaggagggtggtcttttgcactcgcagtgtgctaggttccagcaatggcgcgccatctggtggccttgtcaagaaaaggtgtgcgactccgtattttgcactgctaggtcagcatgagatcatgaaaagagaaatgtccatccttaaatttacattgtgaaagaacaatactttcatccaattaacctctaaagttctgcatactatcattttacttttcctgattcctgaatatatatatatagcacctacttcagaagaccttagtataatagtacatgatagtctggagtatatagatgga

SEQ ID NO: 473 - DNA, 3013 bp, Oryza sativa
gaccacttagtaaaaccagatcatttagtatatagaggatatctatatgttagaaggatatccgtgtaggatcaccgttcattccgcatccaatggcagcactggttcctagcttctcttcagtcgttcggcctagctcagagccaaccagggggaaacgtacgccgctacaagaaaccccgtcgttttgccgcaggattctgggccaaattacgacggaggagagggtaggaaactatgaattgatgctgtcgttgaatgctgggtaaacaacgatccggcacagatatcccctttgatgtagaaatcctcttcatcagaagacctggttccgattgagtaaaaatgggctctcacggttaacctttgcatagaccatagaaacatagcccttgttaaagtgcccgttaaacctttgcacagaccatagaacgcaggcacgcagcccatgattcaaacaaaaaaagtagattaagtagagtaattaagtatatccttttgttctagtacatcggagacggtgttcagtttggtgactacaaattaattaaagtagagtaacgaaatatccactgaatgtgcgcctgtgcgagtgcgacgaatgtacctaacagtcaatgctgttcctctatagttcgtctgaaaccagcgaattaatccgactaggcaacattgaactagtgctatcaaagatcagcgcagctgccgtgcgtggttctctcattggctggatcgatgttgaaatcagaaccaacggttttgaccggtttcttaaacagttaaacccgtacataaaatcggcgccaattcagcttgttttgtggaactgtgtgtttagttatcggcaaatagcacacgccaaattgccaactagctagctatctcgacaaattagagcctcatccaaaacgataggttggcgatgcgtgtcgtccaaaactaccttagtacgttaccgtacctataaatatgcatgcaatgctcgacgctttgctgcacacacatcgatcgctaatccatcaacctatagcttaacgatcactgccattgcaatggcgcggtgcactttgctcgttctcctcgtggcggcggcggtggcggtcgtcccgctcgccgccggccagccgtgggctacctgcggcgacggcacgtacgagcaggggagcgcctacgagaacaacctcctgaacctggccctcaccctccgcgacggcgcctcctcccaggagatcctcttctccacgggctccaacggcgccgccccgaacaccgtctacggcctcctcctctgccgcggcgacatctcccgcgccgcctgctacgactgcggcaccagcgtgtggagggacgccgggagcgcgtgccgccgcgccaaggacgtcgccctcgtctacaacgagtgctacgcccgcctctccgacaaggacgacttcctcgccgacaaggtggggccggggcagctgacgaccctcatgagcagcaccaacatcagcagcggcgccgacgtcgccgcctacgaccgcgcggtgacgcggctgctggcggccaccgcggagtacgcggcgggggacatcgcgaggaagctgttcgcgacggggcagcgggtgggcgccgacccggggttccccaacctgtacgcgacggcgcagtgcgcgttcgacatcacgctggaggcgtgccgcggctgcctcgagggcctcgtcgccaggtggtgggacacgttcccggcgaacgtcgacggcgccaggatcgccgggccgaggtgcctcctcaggtcggaggtgtacccgttctacaccggcgccccgatggtggtgctgcgtgagtaggcgctggccatgcgtgaagctagaataaaatggcacaaattaagagtgttccaccagaataaatgtattgtatactgaataaacctgcatgcaggatatctatctaagctgtaaccggattatactattgtactatcaaataaaaaaaagtgtctatatgattatatatcatcgttaaaaattatagcatattcttacgctcatggagtcaggatcgatcgatatatatatatatatatatatatatatatatatatacacacacacacacacacacacacacacacacgcttgaccaagacgtaaatctcgagctattaatatcaactaggtatcataagtaataagtaattggatcccgattgttcaagccttttataaccaaggttcgttaaagagaaatgaccacaatgagtcagactaaatagaattggatccataaatggatccaagttcaatccttttataactaaggtttgttaaaagagaaatgaccacaatgagtcagactcaacagaattggatccattcctaattgcgataattaggatactcttgatccctctcacaccctctttgaaggagagatgtttagtttccgacttacttcatgtattttataaactagtaatatatctgtctaacattatagcgatatttgttaatgccaataaaaaaaatcaaaagaaccaaaatttctttcttttgaggtcaagctgaggtgcctgctgatacatccctgaatgtgtacaagcatgggctgaacaggcggcctggtaaaaagaaaaaaagagcccgattcagcacgggtgaatgaattggaccggcctgctaaataatgaagccaataaaaaaaatggaacaagtctattttacctccctcatctcttgcccctgatcaaatcgtcccccttaactgcaaaaccagttataccacctcatctatcaaaattggtgcaaaactgggtataacatctccggtttttaatgtttgacacacttgattttaggtgtcttggatatacattggaccatttgtcttatttaattttattgtaaaaatataattcatagtaagaatatgtttaataataaaaatcatagtaaaacaaaaaagcacgagatttttgaaggagtaaaatgtatgggcggcccctaaacttgtaaggctatgtcatctaggt

SEQ ID NO: 474 - DNA, 7753 bp, Oryza sativa; identical to SEQ ID NO: 292

SEQ ID NO: 475 - DNA, 7506 bp, Oryza sativa
tgtacctagtgatgtacccgccgaatacgtacgcgtgtatgcatgggtagagaggctaacatataacaacatccttttagttttaattagtttatttttctgaaaaaaagaagataaatgagaaatatatgacacgcaagcacacaggtcatgcagagagatgctgaaatcatcacgtcgcctagaccgtcacctggagtatgtgctgtaatgatattaactacagtagatgccatatatgcagagatatacttatatgtcttaaaaaacccaattctaatgatgtatttggataacgtatatgtctatatacatcattagaattggactttttctttaacggcggaagtacacaccaaattagtcatcatacatatcttttcagactgaaaaatgggtgtagagacaacagggttggtgactgcagatattatagtatgtgctgaaatcattttaattgacgtatacatatagatagatatacgaccgaccgtattaatactccacctaagtacacccaccgtatgtggatacagttgtcagtatagtgtactctacggcgctggatacatacacacgtgtacggctccagccagaaggcacgaatcttcacatcacaattcacagcaacggaggaggagaaaagatatactccctcaaacatttttagtaaaagtttaaaaaatatcaatcaatttaaaattgatgttaccaataaactatcaaaatatgtaattatttttatttaaaatatcttatttttatatatattattgatcaaaataacatgtaaagattacatctaagtctaaaaatatttatattttggaacggaagaagtaaagaaagaaaaaaaatgaaagaaaaggaaaatgaaaaaggaagagaagacaaggaagtagtggggggaggaaagaaagagacaaggaaacgcatagagaaatggagttggaggccgatgcgaggcgaggtcacctgcgccctacaaaagcggggggcacaccccgcaaccccgcacacccgctctctcctctcatctcctcctcctgtgttcgtgttcttcttcttcttgtagcagcgcttaaccaacccatcattagcgaccaaacctctctccctctccccctctgactaatcaaaattaaacaatttcgatctccaccttcctcttcttgattccagttccaccagagagagacagggtcttctctaatccatgtggtgcttgttggtctcgcttgcttcgtcttcgtcttcgtcttcctcttctcgcacctagtcccgcctcgtcgcctcctccggagaccggagccggacgggacggttgccggcgagcggcggtcgctttcttctctcggccctactcacggtcagtgattggctcccttccttcctggtgttctattgatcctttgtgggggaaaaaaggcttcgatttggggggcatgttcttgcctttttcctgttttgggggagacgagacggatttcaatatatttttttaatctggggggattatgtgtggaaaagattgttcctcgtttatctgggtagtatttggagggtcctatggggatattctttgtaaagctgggatttttaggtggtaaaataatgttgatatactttcagaaagaatatactgcagaaagtttttcagagataacagataagattaggccgtccttaatctcctttctttgcgtctgttccctccaactaggatggaaaagaatggcggattgattagtcagaaactggctgctgaatactctgagatttcatttcatttcagcctctgttgattcctcatggctgtctctaacttctttgcttgtgcttccgatttctttggcggtaaatagcctccacgaatctctggtcaacgaggtattaaaacttaaaagggcttttgtctcaggttgacccgagccatgattcgcccccctcccatgctttgcaaacaagatatgatacgcagtgctggtacaattcagagcatatgttctttcctcttttgctttgtttcagacagcaacttttagcagccacgcctctcacaagttgataaaaaaaaattttgtgttgctctcctactactcatcactttctagtgcgatatagtagtagtagtagtaggagtatatgctagcactatccacagtttagcacacagattggtggcacctgggcagatataaaagcttcacatttttatcaatgtctgcgcagttatattgtcgatttgattccttttatagatattactaggtcaagtcgtgtcgcaattactccccccctttcctccattgtagggtgttcctgtttagtccgcgggggatgctgctccctgagcctgtgtgtgtctcttgatttttctttctttgctcgcacgcagcagcagcagcatgttttgtgtcggtgttaaggaccctacataaataattcatcaaatcaagtatcttttgtctgttttggggaatctcctttgcggttcgtccaaaatttcgcgaaagaaacaattctatatgactgcttttgtcgagaggttagacatcactgctagagtagtagagcaatgctacacgtactaaatttttcttactaaacttttactaataatcatctcaaccgtttgatttaagtagatggaatttacaaaaaatctagatgcactcgtagcatgacacatcagtgttagtaagaatttagtaagaaaaagttagtacgtatagccttttccagagtagtactagcagagtgttagattgtatcacctgctcgggcagttgtaaatggtatggtgagttggtgactggtttttacagttttttcatacttgggtttatggaggatttactgttatggagacctgtaaaaaatgttacatatattgctactttctcatttggatttcggatggctgttttttttatcattatgttggtaaagttttgcatcaagaatctgaaccagcttagcaatactaatagtagatggttcagtaagctgcttccatgtccttgcaactttgcaatgctggcaattttttttcgaaaaagagcaaggctggcaatatgtgtatagcttttgtttggcaatatatgttgcgattctagcgctggtggtatctcaagatcagaaaaagtgagcatcaatgtcttactttattggttttctgactgattacattagtaaacgctgtgtccaaaagtatagagtaatactagttatattttcttaattgtcagtgactcagtatccgcagatggtttgtaaagtgcccttatttttcatggtcgttagctttagtaggtatatagtgtactcttgatggtttatcctttttttcgcccctttctcctttgtcatctgggcgcacgttgctatgcagtttcatgagatggttagtgcgtatccaactattctgtcggcaataaagttccacaatcttcaaaattttctaccattctgatgccaactcctactgcactatcagctcttggtttccagctcagttagtggttagaaattgcagcctacatgaaaaagtaactaatagattttctcgtctccaccttttatagttattttcagtgactcttcttccaaaccaagtggtaaagccaggattctaccattacaatgacgatctgcagctgtgaggagacgatcaatgagtttgagatgttaacgcgtgatgctgcgcgtgtgcagaaggatacactgaaaaagatccttgagataaatgctagtgctgagtacctgcagaactttgggcttggggggaggactgatgccgagagctacaaatcctgcatcccattgtgtgtgcacaatgatattgagccctatatccagcggattgttgatggcgatacctcaccagtggtcactggagaacccatcaccaacctctctctcaggtactgtacccattgcttgaaatttgtcaccttattatgcttatcgtttactagtttatgataataaatgttcatagtctggcttcttctgtggctttcatacagttccggtacaacacacggaaagcccaagttcattccattcaatgatgaattacttgagaccacacttcaaatataccgtacatcttacgcgtttaggaaccggtaaggatctctgatttattattatttatgctcaagtaatgctgctttttctgaatgttcaacaaactttgatgatcaggttcaacatgagttattgtttttatacactgttttgcatgctattaacttgttgcttctttgtgtattttttactctgcatcccagaatattagaataaccttctgttttgtgtttacagtgaataccctattggccaaggaaaagcactgcagtttgtttatggtagcaagcaagtcataacgaaaggtggcattcttgcaacaactgcgacaacaaacttgtataggagacagcgctataaggaaggcatgaaggatatccagtcgcagtgttgcagtcctgatgaagttatctttggccctgatttccaccaatccttgtactgtcacttgctgtgtgggttaatatactcagaggaggtccattcagtgttctcaacatttgctcacagcctagtccatgcattccaaacattcgaggaggtttgggaagatctatgcactgatataagagacggtgttctctcaaagaaagttacagcaccatcaattcgtgaggctgtttcaaaaatcctgaagcccaatcctgaacttgctgactcaatatacaagaagtgtattggtttgagcaattggtatggagtgatcccagcactgtggccaaatgcaaagtatgtgtatggtatcatgacaggatccatggagccatatctgaaaaaattaaggcattacgcagggaacttgccacttataagtgctgactatggcgcatcggaaggatgggttggctctaacatagaccctactgtgccaccagagcaggtgacatatgctgttctcccacaagttggttattttgagttcattcctttggagaaaccaataggggaggagacagaaaactccgcctccattcattacatagaatcagatccagttggcttgactgaagttgaggtcggcaaaatctatgaagttgtaataactaactttgcaggtatattctctcttttctatctattctgaatcttaaattgggttaaatctccattatctagaagtatagcaatgaaaattctacaaaaagcaaggggcagccatccctagttctgcttctggtgctgttatctggtcagacatgataccaacgggatttatcagaaataactagataagtttgtgtgacatattatttcaaaaaagaaatatttattagtcttgccccttcaatcttaaacctctttttgacaagagctccttattatgtaaaaaacataaaaatcacacggttgcaatgtatacatcaatattattaagcacatgggggagtaattattgtgaatgtttgtggtccactccttgaactctttgctgcttactcattatgattatcttaaaactctatcagatgatatatgtttctttttgtgtatgccaaccatgccagactcaccaataacatttttattctttaatatctctggctaacatacaattattttgttttaggacacagaaagtttacttattacggtgatgtttaagaaacactaaaatctttttcttttttctattttgttctaggtctatatcggtacaggctaggagatgtcgtgaagatagcacgcttccacaactccacacctgagctccaattcatctgtcgcagaagcctagtgctgagcatcaacatcgacaagaacaccgagaaagacctccagttggctgttgaggaggcatcaaagttcctggaaggagagaagctcgaagtcatggatttcacgagcttcgtggaacgatcaagcgatccagggcgctacgtgatcttctgggagctgagtggcgatgcgagtgatgaggtcttgagcagctgcgcaaatgccttggatctagccttcattgacgcaggctacacgggctcgaggaagatcaagacgatcggcccccttgagctccggatcctcagaaagggaaccttcaaggagatcctagatcatttcctaagccttggtggtgcggtgagccagttcaagacaccaaggtttgtgaacccatcaaacagcaaggtgttgcagatactgagtagaaatgtcacccaaagttatttcagtactgcctatggattttgatacaaagaaacatattagatgctagcagctgcatgtaattacctttttacctcttgtttttcagctttactgtagtctccaccggaagaaaacgtttggtttagtctcttgaataatctattttcttatcctgtttgtgactatctagaatctatgtaaatggcccagctctagtgaaagttatggtgatgttatcaggaaagaaaatgtggtgtttcccgtaacaagtgctgcaaagtattattcagactctcatctaaacatcatatggttcagttcttttgtatgttagatacggaagaattcagtgatatcaatctctaatcattcagctaacaagtgtgtgaaagatgacatacggacataggaaaagtgaatcatcagaaacattgatggatcgctcttaagatcatataattgcagtcttttgtttctttttttaaaataatggaagctttattaagactcaatcaattacatcaagatgatataattcaaccgaggccatccttggcctctgcatgaagtcttttgtttctggcttgaccataaataacacaaggaaaaagatatgtctgcacctttgagatgcttctgacgcagggtctcaccaacatcttgcttactgcaacagattaacaacttgatctgagatccagacccagattaaagattttaaaatccaacgatcgaaaacaatttgataccgtgatgtatcggtatcccaaggtatttttttagaccagagcaaatctccaaattaaaaggccctgattatttcaaacaagctaggaagataagctcggtaactaactacgcatgaaaataggcaattagttcaaataggtaatcgagattacttagtgaatattatacttatatattattaatcttacatggacttcgtaaaataaactaaaacttttatccaagtaattatgtacaccaaatacaaaattaaaaaaatattatgcaactcctcatagttcgtattggtgaaatatcttgtaagggtatatgattgaattctacatgtccttgtctttgtggattgaatgaagataataacagagtatgctctaataaaaaactatcatgaagacatagcgattagtgtcagggagggaagaaaagatttagttttaggatttttttacgccggaacatctatcaatgagacatagcgattataagcggcagatcgacatgaagtaatcaaatggg

SEQ ID NO: 476 - DNA, 7988 bp, Oryza sativa
tcccatgtatcatatgtatatatataaggataaaagactttccgtgggattagagagaccagggtaaaacacatgacacatttacacaacccatgtgcttggttgtaacatcttctcattccccacaatacaatccaacatgagtatagctgttatccacaagaagaaccagattatttgcgagactagagtggtcacagctcttcaaccccccacagccccactaccaaaaccccagttcatcaccaaataattctgccaactacaaaccatcgaacaaatggtaaatcataaaaacacatttctaatgtggcacacaattatcattcccagcaggtaaaaccaacctggagcattgatcatttagagcgccccttatgatcaggaaaggtatttgctagctccatctgtcattacacggtggattttcaaaaccatttacttcattcccattttgcacgtatagacagttaatcaagatcatttactctccccttcccattttaagtgcaatcgtaagtttccacgcctaactttaatcatccgtcttatttaatttttttttataattattaatttttattattataagatgataaaacatgaacattactttatacgtgacttatgctttttattttttttaaatttatttttaaataagacgaacggttaaaattgtgcacgaaaaattatacctgtacttaaaatgggacgaagtgagtacttcattctctcttttttttttacacgtaagacggtaaaataatcccaattttactggagaatcagcagagcggaggacagcagcgcagcaccgaacggtgcactgcatcagcgactacggcaacagcttttgtctcgtcctctttgccctcctcttcgacttcgagagaaaaacaaaaaaaaaaaaaagaagcgttttttcgagaaaaaggaagcgtttttttctttaatctcacaggagctcgcggattttggctgccgcgtgtataaatgctcccggacgcctcctccctcctcctcctcctcgccgtgctcctcacaccgcaccacaccacgtctcctcctccattgctgcgccgcgccggcgacgacgcgacgacggtcacgacgcgctgagaggtcaggccggcgtgcctttgtctgttccgccgtcgtctcttgctctgttcttgggctgcccgtgatctctctctctctctctctctgttcttctctctgaattctttgtgattggttttgtgtctcctctgcctctccctgtgctccgaacaatctcctgaaaattaatctcagcgctagctgttgctgttaatctcgctgctgctgttgttgttgtttttttttcttttttggcttcagttcacgggctgttttctggtgtcctgttcctctttctcttcttcttcttcttcttccctttgccgctcttcggtgtactttgtttctccccccaagaaaaaaaaacaaaaaaaagtttgtttcgttcttgtatttgtctccattactgccgcttctgaattcaattttgtttttgttttatgttggtcgatcgtgcaggtttgttggtggtggcggcgagatgttggagaagaaggcgacgaggagtactagggtggatggggtgagcggcgaggcggtgatcgaggagttcgagcgggtgacgcgcgacgcggccaatgtgcagcgggagacgctgcggcggatcctcgccgagaacggcggcgtcgagtacctccgggggctgggcctcgccggcgccaccgacccggccaccttccgcgcgcgcgtcccgctcgccacccacgccgacctcgagccctacattgaccgcatcgccgacggcgacgcctcccccgtcctcaccgccaagcccgccacctccatctccctcaggtcagtgtccccgcccgccgccgcttgctgctctttgacctcgatcgagaacgtcgctgaccatggcggggatcacctcaccgccggtgcatgcagctccggcacgacgcaggggaagcgcaagtacctgctattcaacgaggagctcgtcaagtccacgatgcagatataccggatctcctacgcgttccggaacaggtacgccatcgccgccggcgagctcgatcgctgtctctttcgccatcctccccggcgtcgctgtccgccatggacagcctgcctctctctctctctctctccctttttctttcatacgtacgacacgtactaacaacacagtgctcgatctcgatcgatcgatcagtgacagtgaggtctcaattcttggaaattaatggcggtgaaattgatcagggagtttccggtggagaacgggaaggcgctgcagttcatctacagcagcagggagacgaggacgaagggggggcttacggcgacgacggcgacgacgaacgtgtaccggagcgaggagttcaaggcgacgatgagggacatccagtcgcagtgctgcagccccgacgaggtgatcttcggcccggacttcgcgcagtcgctctactgccacctcctcgccggcctcctcgccgccggcgacgtgcagatcgtgtccgccaccttcgcccacagcgtcgtcctcgcgttccagacgttcgagcgcgcctgggaggacctctgcgccgacatccgccgcggcgaggtgtcgccgtcgcgggtcacctcgccggccgtccgccgcgccatggcggcgctcctcgccgcgcccaacccgggcctcgccgacgaggtcgcccgcaagtgcgccgccctgagcaactggtacggcgtcatcccggcgctgtggcccaacgccaggtacgtgtacggcatcatgacggggtccatggagcactacgtcaagaagctccgccactacgccggcggcctgccgctcgtcgccgccgagtacggcgcctccgaggggtgggtcggcgccaacgtcgagcccgggacgccgccggagcgcgccaccttcaccgtgctccccgacatcgcctacttcgagttcatccccctcaagcccgtcgccggcgacggcggctacgccgaggcggagcccgtcggcctcacggaggtcgccgccggcgagctctacgaggtcgtcatgaccaccttcgcaggtaacacacgttcgtcctcatcatgcatgacgttggttgcttattactacttgcagtccaaaaaatggatgaatatctgtcgcttttgcatatctgttcatgaaaccagtcgaaatttggtcacttgcacatttgcagctactggccatataatgtttgcccaaaaataattgtccttctttttatgacactacaaacattagcatttttgggaccacatgtgtaccgaacatgtttgggaaaatcctagggtggcaatttgtttttttggtaaatattgcaacagatatgcatgaaacgaggactaagaatggttttattaattatccgagtaaatataagcaacaatggagcagttccatttgctttgcagtataaattaaaaaggcaaaaaaaataaatcagtgacagatcaaagttgttctgtacaaatgctagaaacaactaaaagttgtatacaatttcttcagataaacagctttacattctgtagacagagacatgcttcaccacatcatttagtgtaatataattagcttatgacagtttacctgcacctgttgcatgcccgttgctttcttatccgtaactggagaggcaggtttgcaaacacacagtcattagcagcctctgctttgtcctgacagcaatgcatatcggtggtcacagtgacagcacagagaactttcgcctcattgctttttttcccctttgttgacttgttttttcccctttgttgacttgagctctgacagtctgattgtccaaaggtggggcattgacttcatttggccttccaaacccttgggctaaatggtcactctggtcttgaaaacttggatctttttttattttttgttgtcaaagaattgtattgtagatgtgcctttctgtttggtagatttaaaggaccatgaccaatgggaaaacttcaggagatctgaagttgccattgccttttctgtttggttgtctgtagattagttttagacttttagtctttggttcggaagatgattaggtcatcaaacaactattaaagataagattttgaccctggctcaggcactggttggttgaggacttttgagttgcttggagacaagggtatgaacataccttggagatgtagggatttggatgaattaattaattaacccaagtggcccttcacttgcataattttctcaaacatattatgtgtgtgcacacctgactgaagatcaatgaaaactagccaatggaatggacaaaacattgaaaaaaagaagctaatttgctatgataggttaattcttttatacatgtagatcaataattgctgtgttgctttcacaaggtaacttgtactgaacacttatctgaaacttacagagttactcctacaccatcagccttagttccgactctgttgaatgcttcaaatcaagtccaaggacgactcattcaattcatcctgataaaacaaaacatcttaattattcatatgactttgagaactaatagtacttgtacgactcctaccacctcttctagtagctttaatttacaaatgggagcaatgatgatagttgtagaccatggatcaggtgtgaaactgacagaccaaaattaaacaatcccttcgaaacagaaaaagacctcctaatgacgatctgtcctatgacctttggtacgtttgctcttgtctcttatcagcagctcggaatccgtactcaactctccccagccttaaccgtagttaaccttgaccattagccaagtctcatgcattcacatccaaatgcaacagctgcaactatcaaacgaacgaatgaacaaacaaacaaacactaacactggccaggccatctctttctggtagtacattccagtatctgaatattcaggcttaattttcttacctcttcaccaacaaggtaattgatcagctcagcgttttcaccccattaatttttcattattcaaattgatagcttattagctagggtttgtcgtcgcgtttagactcatgacttccatggatggctgtatgggcgccacaaacgaaagaggagacgacgacgaagaattcttctgtggtcatgtcaggtaatcggataagaatcggtgacaggctacccggcacagcccaagtgggaagcaggtacatatgcaagaacatgtacaagctcagctcagctacctagctagagcagagatgggggccaatctattatgtctagtatacttttcttcttccttggcatgattgatttaattatgtttatatatatgcatgctaccctacgtaccatcttaatcatatgatgtttgaagcttagctaccttaatttgtccctgtttacgtactttgttgagtgtatccttgatctgttcaggattattcaggaatctgaacaaataataatgatgtcttaatctgtgaaagttggtcttaaactcttaattagcgaatgcaatggtacgcattattggattattcatgatatgattttaagtggattctcggttaagattatactcccttcagtcagaaacattttgatgttttgggagtactagaattagtactctgaacttcaagtattattgactagagggagtatgcataattaacacgcacacaacctctttgaaaggggaatgctggaatactataggacggtatctcgttcggaagggatgataccctatcaaatgatacgtaccaggtatcagatgaaacctttaaggtatcattatgttcgaacggaataccgtcctgtagcgcatttcatcgatgatatcaccgaggaacgtcttttttaccatagttctgacatttttgtatgtatgtatgtatatgcagggctttaccggtatcggctgggggacgtggtgaaggtggcagggttctacaacgcgacgcccaagctcaagttcgtgtgcaggaggaacctgatgctgtcgatcaacatcgacaagaacagcgagcaggacctgcagctggcggtggacgcggcggcgagggcggtgctcgccggcgagaagctggaggtggtggactacaccagccacgccgacgtgtcgtcggacccgggccactacgtcgtcttcctggagctcaacgccgccgaccccgccgccgtcgacggcgacgtgatgcaggcctgctgcgacgagctggacagggcgttcgccgacgccggctacgtcgggtcgaggaagtccggcgccatcgccccgctcgagctccgcgtgctgcagcgtggaaccttccagaaggttctccgccactacctctccctcggcgcccccgtcagccagttcaagtccccccgctgcgtctcccgctccaactccggcgtcctccagatcctcgccggctgcaccgtcaacgtcttcttcagctccgcctacgactgatcatccaatcaaattaactatcgatcgacgatcgatcgacagtagtagttcatgcagaaggggatcgaattgcaaaccaaagacgcaaagtgtgattgatgatgatgaactgggcatgcaatgtgcaagctagctgtagtgacagagatgaggttgtagctagagcatgcaagatgcagtggtcaccatgtttcgccagaaaggggataaggaattaattcagcatcagattactgccgtagcctgtagtaatctgcatgcagaatttgcaggtgccgagtgaattaattaggattggtacgtagtgttgcacctgtgaccagttgagttgatcaagtggccaccggccaaaagtatgtgtcatatagtattagtgtttacctatctaccatgaatgcatgtggcctcctgttgatgatgtcccagcatcaaataaacccttggctgataatgtctgcaagttagctgcgtctgcgtgcatgtgctgtgtgtttcttttgtacatgtactatagtaatagcccagtggttgcagcgttatgttaggagcgagttttctaggttctagaggtacgatttttctagcctagtgaatagcatctatcaattttttagattcaattccccttaggagcaatttttcaaggttagttttattaaaaaaattaaacgcttgctaattaagaaacgatgtatggacacacagactccttatagtaaaaaaaatgacttataataaacaaaccctcgtgtatatagagagagacctcaaagcatgggtcagtctctaaaccatatataagagacggatcacgtgttaaggggttaggattcgtgttttttctcgactggttttggctaagattcttctgctccttctcccgctggacgagttcttgtttgtatactatggctgtgttcttaccccaacccatctcccttgttttccacgcgcacgtttttcaaactgctaaacagtgtgttttttgtaaaaagtttttatacgaaagttgcttaaaaaacatattgatctatttttgaaaaaaaatagctaatatttaattaatcatgcgctaatgaatcgttctgtttttcgtgaacactgttccagatgagaaccagaaccagcgaacacaccctatatatacatacggcctgttcggttgcagggtatagcagctacaacacaatgctgctgccacagttgcttatacaaagcactgttccgtgcggctgcatcgcagccgtatgagcaggggcggatctacccattaggtagagtgggtcgatcgactcaactacgattcgtatcgccccacaccctccagacctccttaccttcttatagttgtcatgggccattaatattaggtataacaaggtgtgaacacccagcaaattgaggcaattatgcgaatgaactattaatacaatatgtgttgtattcgattgctcttatcgagtg

SEQ ID NO: 477 - DNA, 4041 bp, Oryza sativa; identical to SEQ ID NO: 210

SEQ ID NO: 478 - DNA, 3486 bp, Oryza sativa
agggcaagctaaccactccatttgaaagcttcttaagtgcttatgcaatgaggcaaatataagtatagctttaaggtttttttttgtttgatctttttaacttgcatgcatgcatgtattgcgcaagcaagcacatggatacgaaggaaagcaaagccatatggcctgtaaaaaatgggcattattgtgtgtagtagcattttgacatgtatcataatatatagctatagaagtagtatcttggagcaaagatttcattttttaaaatttattggagcacacaaattacaattgttaaaaaggtggatgactaggttacatatgttctcttctttccctgatccttttcctaacccagtggcaggcatcttttcattatctgattagtttgtaatactgtctaactcaggagtgaatcatgactccatgcaagcttaaggcagaaattattagaactagcttaattaaaccacaattagaatatatgtaggaccagcaaaatttaaagagttgctttggcaggggcttcttggtcactagcttgattaatgtggcactttcagatgctgcctggtgttggactgtatatgttgtatgccatacccccatattatacctataggatgataactttgcatacatgtgtggtagagagctagcatgcattgtcatcataaatgaagtgtatgaaaactaaggggagaacattccaaccattcttaattttgaagcaacacactcacacacaaacattagtagcacacaacattcccctctactggtcctaaggttaaattagggcacacaaatccaaacctcacattggaaaacaagatgaatacttacaaactaaccttgatatgatgcagctataggtctagctaacacaagtgcagtgcatgcatgccacccctctctgccatctcatccacagtgacctctctctccaagacccatttaaataccacccttgaatccctcccatttgagcactacacacaagctaagcttagctcgagctcattcatataccttagcttagctaaagcctagctcactctcactctcactcttgcattgcattgcaatattgcaatattgcattggtcatgaacactcgaggcagcggcagtagcagcagcagcagcagcagccaggccagcctgatggcgttctcggagccgccgaagccggcgagccagccgtcgccgccgtcgtcgccgatgagcgagcggccgccgtcggggcgcagcaggcggcgcgcgcaggagccagggaggttcctcggcgtgcggcggcggccgtgggggaggtacgctgccgagatacgcgacccgaccaccaaggagcggcactggctgggcacgttcgacacggcgcaggaggcggcgctggcgtacgaccgcgccgcgctgtccatgaagggcgcccaggcgcgcaccaacttcgtctacacccacgccgcctacaactacccgccgttcctcgcgccgttccacgcgccgcagtacgccgctgccgccgccgcgccgtcctcggtgcagtacggcggcggcgtgggcgcggcgccgcacattggctcgtacggtcaccaccaccaccaccaccaccaccacggacatggcgcggcgtcgggcgcgtcgtcggtgggcgagtgctcgacgatgccggtgatggtcccggttgatccccaccgctccagcatgtcgtcgtcgctgctggacatggacaggaacggccacgacttcctcttctccggcgccgacgacaactccgggtacctgagcagcgtggtgccggagagctgcctccggccgaggggcggcggcgccgcggccgatcatcaggacatgcggcgctactccgacgccgacgcctacggcatgatggggctccgggaggacgtcgacgacctcgcgcagatggtcgccggcttctggggcggcggcgacgcggcggaccagctcggcgcctgcgggttcccggcgagcggcggcgccgccgacatggtcgcctcgtcgcagggctccgactcctactctccattcagcttcctctcccattgatcgagttgcaccgggcattgcatggctaatcacgcactttgcctctgagcgatcatgcatatatcatttcctgtctaccatgatcagatcgagttgatcttgatcaatctgcgtttgatcgatcgagcaagagatcgagtagtatagcagcagcagcagcagcagctagcagtagatcgaacaagaagagtggcttggcgccatttctagttaattaagtagagcttcttcaaatatgtacttaggcagatgatctctctctctctctctctctctctctctctctctctctctcttctatattagcattagtacctacttagccatcatattcatgcatgcatgcatgatatattgcatggcacagcttgttaatttcttctagcatcttaatcaattaatccatgacctggttcaaaatgtccaattcgattttacattttacaactaacctgcaattagatgacaagaatggcgccgcgagaagtacacacatatgtagtactgacaatggattgagaaatggagaagaaaattgaagaagatgaggaactgaacgacatgggcaacaagtacagaaaagctgggaaaaaggagggaagcaattgacagttcaacggaaagctcacactggacaagtgtcagccaagcaaccatttcgtcaggtacttgatgctgattcttgcgtacgtcaggttcagaatttcagaaattcagatgatgactgacagtgtccgaaatgctctctacgcaagtgcaggggttgatcaaatccctgtagcttgttttgatgttggatcgatccatcactagtacacttcactactgtttataacttcttttttttaatatggataaaatcactatactagcgtaagtacacaagtacgtataacagtaccgtagtagtactggattgacattcgtataagcaagtacgtaatctagggatgcaagtgcaacaggtaatctgttttatttcccgcttatcatcacaattctagttttttccttctaaattttgtactcttaagtaggaaacgaaccattaaagtcttgtttttttaatttaatccctcactcaagagaatcgagatttaatttgaggggattaattccgtacctaatcccctataatctttttctcatgggaatataatcaaacgaataagacctaagcagattttcatattgatagcgggattgctcatttgcactatagtacaagtacatataacacgcaggtggtggataggagcctacgatacatacctgtggataagatcgttaaatacgtactccctcaatttcaaattataagttgtctattttttttaagtctaatcaagttttaaaaaatatataaatttttgaacacaaactaaacatattattaaaacatattctatgtcacatttaa

SEQ ID NO: 479 - DNA, 2979 bp, Oryza sativa
atgttcttggttatgtggcattagttaatgatcttaccggacgagcgtggaaagtgataatatggcttagagaggtttgagctaaaggcgcccccatccctaccgatgaggcaggctgatcaagggcatgaagtaaaagacgaagtgtagctccgtcacccttctataaggatcctggaatggagggttgggtcactaaagatctttccctccatgttgctctaacggaagagactcaaacccctctgatgtgaatttgggggttccgattcatttaggagttagcctccatattcatgtggtatatcttaacatcttttcttttgggtggccttgcatgttttggttcttctatcaggaatacactatgactctctttagggaattaagattttgttaaacatttggttggtagccaacttccgagaatttagaaaagttaagtctttcgatttctagcttctagttttattttaagattttatagctataaattcttagaatctggatgagaatctaaactgttaggaagcggagatttggaaaaagctatggctagaaactccttcaaacaagacctaaagctctgtccatcgaggtgatgccggagggagtttcctcttatcgcaaatcacacctttcaattccaaatcatgcctttgtacgatgggtaaagggcttaagaaaaaagccaaaaaatttattacataaataaatattgatagaaaatgtatactcttcccattgtactatttcacatattgtggtgtgtactcctatctttaattctcctgtgcaatgcactactaccacattttcaaggagtaatgtgatggaaaaattgaaaatttgaagaaaaaatttagaactaaacttggaatttagataaatacattttcaggtagcccctacctagctatagtactactcatatactagctcgtccaatgcactactaccaccttggttggctctattaaaggccaagcccactagacgcattctgtcacgtctctctagtgttactgcgtaacgtaggtggccgctgccggccatgtcgtcgtcgtccgctgccgcgctgggctccgacgacggctgctcgccggcggagctgcggccgagccggtacgagtcgcagaagcgccgggactggcagaccttcacgcagtacctcgccgcgcaccgcccgccgctcgagctccgccgctgcagcggcgcccacgtcctcgagttcctccgctacctcgaccgcttcggcaagacgcgcgtccacgagccgccgtgcccgtcgtacggcggccgctcgccgtccgccgccggcccggtcgccgccgccgccgccgcatgccagtgcccgctgcgccaggcgtggggcagcctcgacgcgctcgtcggccgcctccgcgccgcctacgacgagcgtcacggccgcgccggggagcccgacgccgtcgcgggcgccggcgcggtcgccaccgacagtacctcctcctcctccgccgccgccgccaaccccttcgccgcgcgcgccgtgaggctgtacctgcgcgacgtccgcgacgcgcaggccatggcgcgcggcatctcctatcacaagaagaagaagcgcaggggcggcaacatgaacggcgcccgcggcggcggcggcggcggcgcgcgcgcgggcgtgaacgacggcgatgcgacggcgccgccggtggcggtgaccccggggctacctctgccgccgctgccaccgtgcctcaacggtgtgccgttcgagtactgcgacttcgggagcgtcctcgggggagcacatggcgcccatggcggccatggcggcggcggcggcggcttctacggcgccggcgtctacttgccatttctgtacaacaccttcagttagttagctagctagctagttcgtcgtgtatttgtctgtgcttctcactgtggttgcttcagtgtactagctagctacatgtgtgatgtgtctgcatcttgtgatcatcttgatctgtgctttgatgctgatcgatccagcatatccgtacgtgttcgttccgttgcttcggatcttaattaactaatttaattgtgctaattaattttgttagttttggtgatggatgtcgattgcgttatgttcgtgcatgatctgattaataacatgcatgtgttacggtatttaaaccaggctgaaatcgctaaatgagggtgaacctcccaagaactaaggaatatgttgagaaatataaggtctataagcctcggacacaaatagaagatccacggttttgatttatttcacaaaatatcatattgtccaattcttcatcttattctgggtgtccggagagaagcaatatatttcccaactttttttaaaaaaacttttttctttgcactcttgcgaaaaaaaacttactacaaatgaatgaacatttaggtttcttactatacaaaattactgtgtaatggcaaagatggcatgaatctccttaattaaggcttttcccgctgtcccgctcccgtaggccgcaacaactctccggaagcgattttttagtttttttttctgaactttttaaatttttaattttaaaaataaacccttttaaaacttatttccactatctgaacaatttggctaaaacaatactagcattattttgtcacaccggtttgattggcgtgataacgttatttagtcacaccaccatagctgcatggctggattaaacatccacacccgctatttgtaacgcgtcagtattgttttgctacatggcaaaaaaaatttagattctgaaaataaactagttttgtaagggtctattattaaaattaaaaaatttaaaagttaaaaaaaatcgtcagaagcttccggcaaaaagaaccttctccttcgttttcgcaagtaaaatgggcctgtttctccatttacgccggcccaaaagcccattcgtattcagaaaacaaaaacatttgcggcgcgcg

SEQ ID NO: 480 - DNA, 3619 bp, Oryza sativa
gggctagaagagtaatcgacaaacattagatctggtgattagccaagccgcgtgcactggtgagagaggggtggaaagagagaactactccgcttttatagtattagaaaaatctttactaaaccgtgagcttagtaacaaagatctcaactgttggacataactagtggacagttatgaaaacaaaatcaaaattcaatgcacagtgtggcacatcagtttttgaagatgtcgatggataacaaaattgtgtacgtgtatcattttccaaacaccatatacgaaacatcatgctacagtaagataccaaacaaccaccccaaaaccgaattgagatccagtcggccagatgctattgagaacgaacttcgtcgctgctattatgttcacaatatacaacaacttctgcacaaccacagccatgcgtttttgtgatctaatgactgattttcttctacagtattctgctacagtacgccataatcttatccatatcactgttactaagtagtgtttagattatagccgaaataataaaccttattaccaaatattagtaatatctaaattttgataagttgacattaatattgcgaagttttggtaagattccttatgtatttataaaagtttggtaaataactaaatgtatatatctttgacaatcttgcttaaaaaatagtatgttttgaaatgataccaatctgaacaacaccttaattaacatgtatgcactagatccgaattcgacgaaattcagcgagtttgaaaaacactcgtaccccaaaactccccaccccaccacctccggctccgtcgccgaaccgatcgaatcccatcaaaaaagggagcaaactcgcatgaaatccatcaaaaacggagcaaaactcgcatgaaatctcaatcgatccccggcgccgcccgcccaccaccgccgtgtaattttttttaaaaccctcgtcgtaccgagatatttacccttctcctcgctctcgctctcgctatcggctccttctcgcccagcttttgctcacgtcacatcaccttccacctccacccctccactcgctcgctcgcttgcttgctccaattaatacctcttctccttctcccccagcaactagcttccttctccgcttttgcagctcgccgccgccgccgccgccgccgccgcgacacggcgcgcatatggtcgtcgtcgtcgtcgtcgtcgtcgctggagaagacgaagaaagatagtagacctgagctgggggggcggtgaattcgccggagagctagctaaggtgagtttcgttttcggtttcggtttcgatcgatttgttggtgcagatgcatctgggagctagagaactatttatagtggctgcggtgcggtgcggcgtcgccacgccgcgcacgcgctcgcccacgtcgcgcgcgcgcgggcgcgcgtccactctctctctctcttggaccactgcgcgcgcgggcgcgcgtcggcgtcgccacggcttctcaagaacgcgcgcgcgcgcactgattcccagatagatagatctatatctgttcgtcttcctcagctatggtgtggtggtggtggtggtgtttgtggtgttgtgcagatcgacgatggagttcgtggcgcacgcggcggcgccggacagcccgcactcggacagcggcggaggaggagggggaatggcgacgggggcgacgtcggcgtcggcggcgggggcgtcgccgagcaggtacgagtcgcagaagcggcgggactggaacacgttcgggcagtacctccgcaaccaccggccgccgctgtcgctggcgcggtgcagcggcgcgcacgtcctggagttcctccgctacctggaccagttcggcaagaccaaggtgcacgcgccggcgtgccccttcttcggccacccggcgccgccggcgccgtgcccgtgcccgcttcgccaggcgtggggcagcctcgacgccctcgtcggccgcctccgcgccgcctacgaggagaacggcggccgccccgagaacaaccccttcggcgcccgcgccgtccgcctctacctccgcgaggtccgcgagcaccaggcgcgcgcacgcggcgtcagctacgagaagaagaagcgcaagaagccaccccacccctcctccgccgccgccgcgcacgacgacgccgccaacggcgccctccaccaccaccaccacatgccgccgcctcctcccggcgccgccgcctgagccgagccgagcttgctccaagatcgccggaaaacgagctgctagcctcctacgcatgcactagttactccactccactccactccactatgatccctagctaggctgctcttgctactagcaaaactacggattaatctccatgcttgctactgctgctgctgctgctactgcatctaattaattaggttgattatttcctgatcgtttcttcccaactgggtcgctctcgcacgtcgtctcgtctactactatttgctggtaattttctcctctcctcatctcttcggccttctcctccctacttcatgtgtaatcaactactgctgtttgtgatgatgatatgatagctagctagcttctcaaatcaagaactcgatcgttttgattttagctggtcgtacttgagtagtactactcctgatcaaaattaattgctgttctttgctctgctgatctagccattacagtcttcaaaaaatctcatcttctctctctctgctgctgcaacaagatcgaacaagtagaggtaccctgcgaacagtgtctccaacagtgcgatctgttctcccgggcctgcttggtcgtcgtcctcgtcgtcttcttcctcttttcatgttcttgcaagcagagagagtcagtcagtcaggcagtacagtacacagtgtgatcgatcgatcgatttcgatttcgatcgagaggagagagagagagtcgagtcatgtcagcactgtggctgtctcgtccttcttggggaatcgacgtactgtttcttcttggggagagtcacggatggctacctatagcaattgctgctactgctactagtagtagtagtagtacagctcgagctaagctaggagcagcagcgttaagagagtgatgctagctagctgtggctgtgtgcctgcttccgccctttcaggggcgcttttgctttgctttttatggtacctgtactgctcataccataagtagctaggcttgcttggccacctctgcctctctcctctcatcatctgcaatcacacagattgcctcctgaaaaattcaattttttttcccacagaaaccactgaaaaattcaatctttctcacagtaactagtagtactacgaattaaacttcacccttagctagatctcacagttacaccaaactacactggtactcggaatgcccatatgggatcatatcatatttgaaggcagttagtgctgctgttctttggattttttgtttgatcttacaaccaagcttagctgctttaatttcttactgatgtgggagtttttcaaatgcagttacgtgtttctcagtgtttctgtccagtgttatgcttagataccctctcttgctcctctttcatatgcatggtcttgcatgcctttaa

SEQ ID NO: 481 - DNA, 6399 bp, Oryza sativa
acgaaagtttaataaagtttgattaaaattgaaagcttatgtgtgtaggaaagttttgatgtgatgaaaaatttgaaagtctgaagaaaaagttggaaactagaccctatttagatgggactaaaacttttaagtccctataacatcggatgtttggacactaattataaatattaaacgtagactattaataaaaaccatccataatcttagactaattcacgagacgaatctattgagcctaattaatccatagttagcctatgtgatgctacagtaaacattctctaattatagattaattaagcttaaaaaatttgtctcgcaaattatctttcattttatgtaattagttttgtaaatagtctatatttaacactatgaattagtgtctaaatacatagactgaagttaaatccctagatccaaacaccacctaaccaagggcgaagatgatctccgtgctagactaatactaagccaagtttagatccaaagtttttcttcaaactttcaacttttccatcacataaaaacttacctatatacataaactttcaaatttttcatcacattgttttaatttcaactaaacttttaattttggtatgaactatacacccctactagttcaaacgtactcctggtaaacagcagaaaggctagtagccgcccctggtggcagcagcccagcagcccgcgatcaatcaatggaggaagggaagaagggaaggctctgtgtgtgtgtgtgtctgccacacacgtctccggccatctcgtcccgtcccatcgtctccgcgcccggtctgtcagtctccgcctcgtcgtcgtcgtcctctggtatctgtacatgccgcattgaccacgccaacctaacgccgtcagtgactcccacagcttctgcttctgcttctgcttctgctccattccttgcagcctgcaggccgcgcgcccgccttccttttattcccgccaccaccccgcctcctccccctccccctctcaccatcgcatttcacaatgcctcctactctcctcctcctcctcctcctcctcccaccctccctcgcctcccccgaccgcgacatctacgcgctcgccaagctcaaggcggcgctcgtcccatccccctccgccaccgccccaccgccgctcgccgactgggacccggccgcgacctcccccgcgcactgcaccttctccggcgtcacctgcgacggccgctcccgcgtcgtcgccatcaacctcaccgccctcccgctccactccggctacctcccgcccgagatcgccctccttgactccctcgccaacctcaccatcgccgcctgctgcctccccggccacgtccccctcgagctccccaccctcccctctctccgccacctcaacctctccaacaacaacctttccggccacttccccgtccccgactccggcggtggcgcctccccctacttcccctcgctcgagctcatcgacgcttacaacaacaacctctcagggttgcttcctcccttctccgcttcacacgctcgcctccgctacctccacctcggcggcaactacttcaccggcgcaatcccggacagctatggcgacctcgccgcgctcgagtaccttggactcaacggcaacacgctctccggccatgtccccgtctccctctcccgcctcacccgcctccgcgagatgtacatcggatactacaaccagtacgacggcggcgtcccgccggagttcggcgacctcggcgcgctcctccgcctcgacatgagcagctgcaacctcaccggccccgtcccgccggagctcggccgactccagcgcctcgacacgctcttcctgcagtggaaccgcctctccggcgagataccgccgcagctcggcgatctcagcagcctcgcgtcgctcgacctctccgtcaacgacctcgccggcgagatccctcccagcctcgccaacctctccaacctcaagctcctcaacctcttccggaaccacctccgcggcagcataccggacttcgtcgccggcttcgcgcagctcgaggtgctgcagctgtgggacaacaacctcaccggcaacatccccgccgggctcgggaagaacggccgcctcaagacgctcgacctggccaccaaccacctcaccggccccatcccggcggacctctgcgccggccggcggctggagatgctcgtgctcatggagaacggcctgttcggccccatcccggactcgctcggcgactgcaagacgctcacgcgcgtccgcctcgccaagaacttcttgaccggcccggttcccgccgggctcttcaacctcccgcaggccaacatggtggagctcaccgacaacctgctcaccggcgagctcccggacgtgatcggcggcgacaagatcggcatgctgctgctggggaacaatgggatcggtggccgcatccctccggccatcggcaacctcccggcgctgcagacgctgtcgctggagtccaacaacttctccggagcgctgccaccggagatcggcaatctcaagaacctgtccaggctcaacgtcagcggcaacgcgctcaccggcgccattccagacgagctcatccgctgcgcctccctcgccgccgtcgacctcagccgtaacggcttctccggcgagataccggagagcatcacgtcgctcaagatactgtgcacgctgaacgtgtccaggaacaggctcaccggcgagctcccgccggagatgtccaacatgacgagcctcacgacgctcgacgtgtcgtacaacagcctctcgggccccgtgccgatgcaggggcagttcttggtgttcaacgagagctcgttcgtcggcaacccggggctgtgcggcggccccgtggccgacgcgtgccctccgtccatggccggcggcggcggcggcgcggggtcccagctgcggctgcggtgggactcgaagaagatgctggtggcgctggtggcggcgttcgcggcggtggcggtggcgttcctgggcgcgaggaaggggtgctcggcgtggcggtcggcggcgcggcggcggtcgggggcgtggaagatgacggcgttccagaagctggagttctcggcggaggacgtggtggagtgcgtgaaggaggacaacatcatcgggaagggcggcgcggggatcgtgtaccacggcgtgacgcgcggggcggagctggcgatcaagcggttggtggggcgcggcggcggcgagcacgaccgggggttctcggcggaggtgacgacgctggggaggatcaggcaccggaacatcgtgaggctgctggggttcgtgtcgaacagggagacgaacctgctgctgtacgagtacatgccgaatgggtcgctgggggagatgctccatggcgggaagggggggcacctcgggtgggaggcgagggcgcgggtggcggcggaggcggcgtgcggcctctgctacctccaccatgactgcgccccgaggatcatccaccgcgacgtcaagtccaacaacatcctcctcgactccgccttcgaggcgcacgtcgccgacttcggcctcgccaagttcctcggcggcgccacctccgagtgcatgtccgccattgctggctcctacggctacatcgcgccaggtaaccacccaaaataatttctccatattatttttagcctatttcttattactattctttttcaatgcgaaccactacagtactgtagtactaaatttaccgaaatgaatctgtttgaaaaatattgaattccaagacccaacaagtttatcctgatccatgtgttgaaagaacaaactttttttttctgatccatgtgttgaatgaacaaaccttttctgtttaaccatgacaaggaacaaactttatatctggaccatgacaaagaacaaacttttaatgtgcttaaaataaataatggttctaactataactaatataattgaaatgatctgatacgattatacgaagtgtcattgaaaaattgtaaactttacgtagaggcaataatagagggggcccctgcatggagatgcagccacgttccatccactggaactgcactagtactgtactgcagcttgtgctttcctctgagcacaatccttgttgccttgtgcacggtcaactggggagaggacaaatgttacctttgggccaaagtgtgaacttttttttttctgcagacagcaaacaaaagttacagctacagttcttgccgttgcatggctgtagcagtgattgtgattaatggtcagttcagttttctgctctgtttctttggattctacagaagcagatcttgcagccatatgtatggtcaatggcaggcaaggcaatttggctacctttggattaatggatagtctcctgcctttggagtactagcattcatattgtgtcgtcttgttgcctcgtgtgtggcacactggcactctcttggataattggaggagatactgttctactgtagctgtatcacgttcgtatcttggctgtatctccatggtagatctgctccttattgacttgtcagtccactcttaaatggtgttgttggtgaagtacgtagcttcaggataacctgtctttcaaacgattcgagtgtgatgcactaccctgaaaaatgaaaattctgtctagtggctgtggttacattcagttatgcaaatgtgcagctctaatggctgtagttacattcagttatgcgcgttgggaaaggatcggtacactaatatctttttgattgataatctaaaaatggtatgttaggtatcatctaactgattcatcaatcctatgtactatttgtgtttgcagagtacgcatacacgctgcgagtggacgagaagagcgacgtgtatagcttcggtgtggtgctattggagctcatcaccggacgccgccccgtgggcgggttcggtgacggcgtggacatcgtgcactgggtccgcaaggtgaccgccgagctgccggacaactccgacacggcggccgtcctcgccgtggccgaccgccgcctgacgccggagccggtggcgctgatggtgaacctgtacaaggtggccatggcgtgcgtggaggaggcgagcacggcccggcccaccatgcgcgaggtcgtccacatgctctccaacccaaactcggcccagcccaatagtggtgacctcctcgtcaccttctgaaccccaaacttaacggtattgtttgctgttaatgtgtgcgcttaattagcggctaattaattttggcttagctggtacttttgccgcgtgtggttgacgtgtacaataacaggcggattactactgcttttctgctatgcgtaatagctaaatgaatatgtgcatattagtaaagttgaagttgaaatgtcttatctccggggctaatgatctgaactagcagttctattcgttatttcattgtcatgttttttttttctgtctatttttccatatctaggatcgaagaatttgacgctaaatatgagatgggaatcctaaaaggggaacgaatttaggtatgatagtgcgatatgtgtaaatcagtatacgtatccgtcagtgcagaatcgaatccaaagcatgcgaaagaaagaacacacaacacctaacctgcctttgagcctttattcttcttttcattactcatcttggatttgactcaggaggatatattcctgagtcactgcattttgtttgttgctcatgcaagtagatggcacatattccttgcatgcagatgcaggatagatatggtagaccctgctttgagcattgcattgctgaaaggcctttgttttctcagatagttgcttgtgaaagttgattagtggatgtagatatatgtaaagctgcaggaatcagaatattagagagtgtgaataggtgatgatgatgtgaagttgggctgggcatcaactacatcagggcaagtaaaagtcctagtggatatcgggctgcgccttgttcatttcccagacaaaaaaatgggcttgagccctaagggcatgtacaatggttatcaatagtggactcttagtgttgttaattaggaatacttgttgacatggaggaaagcgaaagaggatagacaaaacatcgttattatgcataacaacggcttaacaacgactcttaatcactataatatggaaatatggttgcatgggggtaaaaaaaaaaggaaagaatattaatgaacggaatatttttgagttaatgattagagcctttatcgtcttaattattgtaaagacatggtctctaaataatcatgtattgttcaagagaccatactcgtctctaccattgaatatgccctaagcttatctccttaatcccttataaatccatctaagaattcatggaaagtct

SEQ ID NO: 482 - DNA, 3085 bp, Oryza sativa
caacggcagcggcgacaatggacgagggcagcggcggcggtagtgacaaacgagggcaatgactcagtgaagtgcgacagcggtggcaacggatgagggtggccgcggtggcaacaacgaacaagggccgtgacccgttggagcgtgcgacgacgatgacaatggagagcgatggcaatggtggtggacaacgcgcgtcgatggagaacctgtctctcctggtgggccctgtgacctcgggccgagcgtgtagccagacggctaattagtcatctgcttctcctctctctctcttcccctctctcctccagctcataaaaaaaaatcttatgtggaccatttaccgtctactattgtacctgctataaggttaatgcatgtacgagtatgaaaaatgggtaagaattagagtaccaaacaaaacaagatgttccaagtttcaaggagcaattatgttgcatgcaaagccagagaggcgaagagatccgtgaaccaggtaacacgattctccccttaattttgtttgcagatgagctcactgcacgcactgcgcacacaggcacacagccaatgcaaacttgcaccgaaacggtgacccatatgtgacccggccggtgcgcgtcacccgtcaagagaccgagccaacgacgcaatcaattccccccggttttgtactggatccggcggatctccacttctccgctccccaacacaatctttggctcccttttcccagaaaagttttcgacaagatggcgtgcatcatgtcaagccttaactgtaaacctgtactcaactactgctactactactctgcttggcagcaggagaactgctagtgctgctagtgttactggtaccattaccactgtaactatcccaagatttactcagcctcatcttcttcttcctctacaaactcctcatgagctataagtatcctcctacctgtgctgtgtgtgtatcttccacatctcaaagacacaacggtttctttgagaggttgttatcctctggtttttgtactgcggtaatttgtaagtagagtacagtagctaagctacactactagtagtagttttgtgtgtttgcttgacatgggccggctcttcttgtgtttggtggttgcatggtgttgggttgctctgctgcttgttgctccggtgcatggacgtgttggtacgtcgtaggagcttcagttctgagcctttccttttttctcacttgaatctcttttctttctttttttttcttgtttttcatacatgcatttggttaatgcattgctgacattttctttggactgatcactttcaggcttgcccggtgagtttagtggtgaccagaggccagtcccggcgacatcttttgatctcgtgacagaggtacatgttttattttcacttcaatctcaattatttgcacctctgtttaccggatcgagttagattttgtttcattagagaagtagtttgcatgcattgctgacattttgcttgtataacgtgtgcaaactggttagccgaagacgaagcagccgcgcggcgtgaagggcacccgcaggccgtcgtggtcttcttggtcgtcgacggcgtcgagatcgtcgccgccgccggggagaggggcgccctcggccgccgcggcggcggagctccggtcagtgccggccggcccggacccgatgcaccaccacggcagcccgaggcggccggagcacgcgcgcagcaccggccggccatgacacccccgcgcgccgccgcgtgtgcaatattgctctggatgaggcggcggccggcgagctagccgccggcgaacggacggacggtgcaaatcaataagcccccacggcggcgttttggtctccccttctgcgtcatgctgctgctcctgcatagtggaagtagtagtacactctattactaggagcactcctctagctagccttgctcaagtgtgccgtactgttttggcctcacctgctttgcttccgtacatcttggctgcaagctagaaaggcatgtgcagcttgccagcgccgcattgttttggtcgagctctggtggagggtgtacaaaaccaattatcacggttattttagttttagaaaccatattatatctcgcgataatcatacggttgccgtgatactcgctaaattgtgagatagagttaatggtttttaaaccatattggtaagtgtcttttgggatggttggtaaatagattatgagaggtgggattgaaaagggaaaatagacgaatggctagtattaaataagatcctatcccatttagggcccctttgaatcgcagggtagaaaaaacgaaggaataggaaaaacacaggattcagacaggaattgaagtgtaaaacagaggattgcaaaacacaggaaaaacataggaatggtcgtttgattggagcgcaggaaaaacgtaggaatcggatgagagagatagactcaaaggaaattttccaagaggttggagctcttactaaatttcctccaaaatccacatacaatgtgccattctataggaatttcataggatttggaaagcttcaatcatttaaatcaaatggacaaataggaaaatttcctataggatttgaatcctatgaaatttttatataaatactttgattcaaaagggcccttactaaacaaagcttttgtgtaatgtacttacaaattaaatgcggtactttttggtgtgatcgtgtcgaggtaggagcacacgcttgattgataaggcgaacgctaaattaaccgaggacgaattgttgttcttatgttcttcgaggtaacgtgcacatacatggtcgtcctgtaatttcgtgcgcgtgtcatgtgcgctgagaatttttcttattttttgatttttttaattttcatatttcaaaaataaacccttcttaaacttctggccgcatcgacttgtctgatatgataaaataacactatcatgtaaccagtaacgtgttaaaataagccttgcaaaaaatattatgtttgaaactaaaaatttaaaaaagttcaaaataaatcgtggggtgaccagccggtgcaagcccaaattgatg

SEQ ID NO: 483 - DNA, 3459 bp, Oryza sativa
cagctactcagtttgcattcatgcatgcaccaccgcctgcgacagtgcgagcgacgtgacgacgtctccttgattgtctctcgtgggcctgtgctatatgtgatcgatctaatccctgcgacacgataatgcaatgcatatctctacgaaatcgaacagtagaacatgcacttcgaccttttctcatccgaaataattagtgcgggatactcattatatgcgaattcaatcagagggggctgcaatttgcaaactgcgtataattgtttcatgtggatttaaataacctcctcattgctagtactcctatcatgttgacttacacggaaaacgagctgtcttcccgtccatttgcggccctttgccgatcataaccgagacaagcgtatccagaacaggtgctagcttagctacgcgacgcccccgtcttgaggctccgggagatccgagcgcacatgtccgcgagttaatacgagtgcgtgccgtgccgcccggccggccgggcgggcggagcgagcggcttctgctttctgcttctgcacccagcaatgtgggcgctggccggagcacggagcgggcgaaagccccagttcgttcccatcccacatgccattgctaatcatgcacgcaccaatcacgcgccggccgtggccgaacccacggcgatgcttcccggttatcaccaccacggcaccacctatctctgtgcctgtgcgtgtgtgtgcgtttggcatgttgcggtgtcagggattgattcgttttcactcatcattcaccgcgaatccttctcgtgtccgctcgtagtaccaccgcaccgctggccgtctcggtgtccgaggccccgagcccaagcatgtcccggttcgatgggtggtcaaaaaaaggatatgagagggagagagaaaaaaaatgggaggaaaatgtatcgtttatcccatcatgcatgcacactgatcctgacgcctccacgcgcggctctttttataccaccctcgagagctcatcactcccgcactcactcacacacactcaagccagctccagccacacgagcctagttcaggtagatacaatggcgtccaccgcctctttcatgctcgccgtcttgctggcggtggccgtcgcggcggcgccggcgagggcggtgcgatgcccgccgagcgacaagcaggcgctgatgagagtgaagcagtcgctgggaaacccggcgacgctgtcgacgtggtccctggcgtcggcggactgctgcgagtgggaccacgtccggtgcgacgaggccgggcgcgtgaacaacgtcttcatcgacggcgccaacgacgtccgcggccagatcccgtccgccgtggcggggctgacggcgctcatgtcgctgtcgctgttccgcctcccgggcctctccggccccatcccggcgtgcctcaccgcgctctccaacctccagttcctcaccatctcccacaccaacgtctccggcgtcatcccggactcgctcgcgcggatccgcagcctcgactccgtcgacctctcccacaacagcctgaccggccccatcccgaactccttctccgacctcccgaacctccggtcgcttgacctccgcagcaacaagctgacgggttgcatcccggcggggctcgtgcaggggcagttcaggtcgctgatcctctcctacaaccagctcaccggcccgatcccgcgcgacgacgcgcaggacgagatcaacaccgtcgacctctcgcacaaccgcctcaccggcgacgcctccttcctcttcgccgccggccggcccatcggcaaggtggacctctcgtggaacgacctcgacttcgacctcagcaagctcgtcttcccgccggagctcacctacctggacctcagccacaaccgcatcaggggcaccgtgccacgctccctcgccgcgctctccacgctgcagacgctggacctcagctacaaccgcctctgcggcccgctcccgaggctgcacggcgtcatccgccacggctgcaagccgtacgagcacaaccagtgcgccggcggcgccccgctcggcgggtgccaccaatcgtgagcatccatccatccatcaccgccggcgagctgatgctgccacgtaaggtggagcccggggtgcgtaacggtatacgtgtttggtgttttttcgcgtacggggacgtggccgtgtagtacacggtacgacgggtgcagccgtgcagggtactgggcgggtttacgttagtacaaattgtaaccaaggtagagtgcctgcacgcgtgcgtggtcgactctccttcagattgtacgaaacgagggagccgtgtgtacgtgtgcgtacgtgtaccgtgtatggagtacgatgatgatgatgatgcaagtgtgtgtattgtgaatgtacgttatggatcgccctaatgtatcatcgaaatgataagtgtttgatataatttgcctttcgttcttgtactcgtacttgcgagcgctaactgggtacacctcctttttgaactcaactcagtataccgtgtactgtggatctactgtaaagtggtaggataccccactttctgcatgatgctgcctgtctgggataataagaactagctgggtggcccgcgcaattgcgcggctagcatccatataaaattatctatttttaatatgattttacttaaattttattgaataaatagttatctcattattttaaaacttttaaaaatcaaaccatatcatcctcgtgtttaattttatagtttttaaaagttaccctattttttatttgcttgctcgatctatcactattcctattcattctccttggaaactttaaaattttgatcttataatttttagagtttattgtctcttagggtttcgtttttataatttttagaaatcccatcaaacactgccactctactcctatattgcccatccgttgcctcatttctttattgttattgggatttttaaaatcgaacataattattgtttgggtttattttttactttatagaactcccgccaaaccgttagcggctttgccactgtactcttctacggcccgtccgctgcctcccctctttattgtcgttgagattttaaaatcgaacattattatcattttttttactttttagaagttccgaatctttaaaaataggacctggtaatttttagagtttattttcgttgagtttcatttttatatttttagaagtctcatcaaacactaccactatactcttctataacccgtctgctgcctcctctctttattgtcattgggattctaaaaatcaaacataattattgtttgagttcatttttttactttctaaaagtcccaccaaacaattatcggctttgccattgtactattctatggctcgcatgctccctcctctctttatttcattgagattttaaattggaacattattttcattgttcttttta

SEQ ID NO: 484 - DNA, 2688 bp, Oryza sativa
ccctctcaaatttaattacgcaagaacacacagtccatcgatatccatcatccatttatataactgttgctttgcttagattgcgattctcaaatttaatcatgaattctcatatatgcatacctttagctttggcatggctagcctcacatgaattaatcccttggcatctcgagtacaagctagtaccacagtttcactatcatttgatcgcagctgccgcttcacagctgcctcactccactccacttcacccttgaaaattttcagctcacgcagctgcagctgacgacgccgcgcgccgacgacgacgaccatgatgaaccctcgccggctgccgcctctgccgtcgtcgacgtcgtccgcctcggcagcggacgacatggacccgcgcgtgtggcgccggctgccgcagccgctggtggaccgcatcctggcgtgcctcccgacgccgtcgttcctccgcctccgcgccgcctgccgccgcttctaccacctcctcttctcctccccgttcctccactcccacctcctcctctcccctcacctccccttcttcgccttcgtcgtccccgccgccggccacctcctcctcctcgaccccaccgccaccgcctcctggtcccgcctcccgctcccgctcccgcccgtcgccggcggccccgccgcgttctcgcccgcggccgcgtccgccggcctgctcgcgttcctgtccgacgcgtcggggcacaagacgctgctgctcgccaacccgatcacccgcctcctcgccgcgctccccatctccccgaccccgcgcctctcccccaccgtcggcctcgccgccggcccgacctccatcatcgccgtcgtggccggggacgacctcgtgtcccccttcgccgtcaagaacatctccgccgacacgttcgtcgccgacgccgcctccgtcccgccctccggcttctgggctcccagctccctgctccctcgcctctcctccctcgatccccgcgccggcatggccttcgcctccggcaggtaagcgcgccgcgccattgatgacgcatgggtaaatactcttgcacagatttgctgatcttgccttggttgttgttcttaggttctactgcatgagctcgtcgccgtttgcggttctggtgttcgacgtggcggagaacgtatggagcaaggtgcagccgccgatgaggcggttcctgaggtcgccggcgctggtggagctcggcggcgggagggagggagcggcgagggtggcgctggtgtcggccgtcgagaagagccgtctcagcgtgccccgcagcgtgcgcctgtggacgctgcgcggcggcggcggcggcggcggcggtggcgcgtggacggaggtggcgcggatgccgccggaggtgcacgcgcagttcgccgcggcggagggcgggcgcgggttcgagtgcgcggcgcacggcgactacgtcgtgctcgcgccgcgcgggcccgtggcgcaggcgcccacgagcgcgctcgtgttcgactcccgccgcgacgagtggcggtgggcgccgccgtgcccgtacgtcgtcgtcgcgcaccacggcggcgccggcgcggcgggtttccgggtgttcgcgtacgagccccggctggcgacgccggccattggcctcctcgacgccacggcgcccgtcgccttgcatggcatgcatgatggttaggagcatactatgtgcttttttgtgcatgctgcctgcatcaactaatcaatttgttatggcctagggcatgcatacacatgttcatgagcaagctaggtttgtggtgtattaaagttgtttcagcaatggggatcatatgttaatttcttatgagcaattaagtgtgttatatgataggttaggtatgagaattagcatgattctagctagtagtatgtgcaagttagtagtatgtactaggtagcttaattaattaattaggttgtatttgtcatctgagttggtagtgtgctagattgacagtggtctgaactctgaagtggtttcatctctgttaattcagaaaacactaataattcagaaaacctactgaagggtttctactcaacaactactactactttgatcttgccatgagatctgttgaagaatattcatgcatgtgattttctgaagagtgttgatttagatggtttatcatgatcacatgaagcctacaacagtatgtgatcatttgagtatgatcttctggccagcatgactttgtctgttgaatccacctcagatcggtatatagtttctcagtttggatatgcatttcttccatatatttgcttaatattcacacatacttatgtgtgtagttgcatctttcttgtgagtgaaattagtacgacctctattaaataaagctagatactctgaaaaagtaagatgcccaaacttagtttatgtagcgcccttggtcgatcaaattttatggccaatcttttttttttcttttgcaagcttactctagctagaattgtactcctaacatagacattgtatatatgtaaacatagttttcccgatcgatcgagttgttgattcagtatatcatgcatctctggggaagcagtaacaagcaccagagatatggtggttcagatctttagccacccccaaccaggttctaatcacatccatttaattttaaaaatcatgtgtaagtaatata

SEQ ID NO: 485 - DNA, 3393 bp, Oryza sativa; identical to SEQ ID NO: 224

SEQ ID NO: 486 - DNA, 11175 bp, Oryza sativa
aaaaatcacgatgcgcgaatcgcccccccaatttcgacaggtaagggtagatcttcatcgatcggccagttgaaaacaacaacggcggtacaacgatcggccatcatcgtgcaccgcaccgcggcggtggcccagagccggtgatggggatgtatggacggtggagtgagtggagagagggttggcagcaagcatgatgcatcacattatgtgaggaagagataggggccccatgagagcaactgaaaggactgtgctgaattaataggaggctgctgctggtgagtacttagccattatctctgcatcctatgtgacaaacagaaactggacagtgtatgtggagtgtcacatggttgtatatacatcatacattaaatcatctctatgctgtatatatagatttgctttgtttttactctctgatgatctgatcggtagaataaagcaactagttatcagttattatatatcacacaaattaaataggaaagtaatttgatttgctgaattggaaactacagtaaaacttgttaggtgagttctgaaaaaaaaagtgcatctgctgaacttcattggcaaaacaatgtaaagcccttggcattaacatctgtaacattgtctcagatatatcagcttacaaggttcctgaactgtgaaaagtgaaacaaaaaggaggaaagcaataaccggtcttgctgttcccacaactgtttttttgtgtctaacatgcagtttaccagtccaaacaaagcaagtttcagacttacagcaacaagaagcaaagctttgcaagcagagttacatcagagttacttgcattacatattctgaggtaaaatggatatggagacatatgtatctgacagcacagcactgcctgccaggacaagagatcaaagagtaaagactgatggaaagagagctagctagtagtaaatcagaaaggttgtggattgcagtcagaagaaacaacaagctagagatagatagctatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatggtaaattctggctttcttgcttttggataaattttgcttcctttcttaacttgagcacaagcttgtgttatatgtggtgtggaatcttggttgccatgttgtgaggatttagctagagagtcaagaaagaggaatatatgctttatgtagataggagtaggatctctgggtctttaaacatcaccatgacaagcaaagataagaacaggagagcagttcttgattattatttttcttctcatcaagaaattaagccggagatagacatggcagctgcacgcagtgattcacttcttgatttcttgatttgggttgttgcgtttgtgtccagaccgatctgagctgcgggccatcgtcgatgacggagctgaccgcggcagcggcgccggctgggtcaggatcgtcggcggcggtggcggcggggagcagcgagaagatggggagggggaagatcgagataaagcggatcgagaacacgacgaaccggcaggtgaccttctgcaagcgccgcaatggcctcctgaagaaggcgtacgagctgtccgtcctctgcgacgccgaggttgccctcatcgtcttctccagccgcggccgcctctacgagtacgccaacaacaggtgattcacaaaatactatctcatctcatcctacttatgcttatataatccataaaattaaccaagaggtctaaaaaggctatggaaatatgcatacacaatagaagctacacatatgtttcttttttttaaaaaaaaagaagaaaatgtttgttggttgagttcatggttgtccaaattggagcaagtatggagatagctttcatgggggcaaagagaggggagggtcaaatgggagatgcatcttttgttacttctgttattaactgtctcgtgttatttggtgtttctggggggaaagaaagaaaatcgcaacagtttctctcttgcttgcttgtgtgtgtgtgctagctagcttcttttgctgctttcctttgtgcttctggtgaggtgagctagatgtttgagatagatctaggacagtgcttgctgtgtgtagtatgctgctgcttcctttctttctctctctctctctctctctctcttgtgtgtgtgagatgagagagagagagagatgttcttctttggcttggtggtcctgctcttttcttgctgtatttatgttttttcctttctctctccactgtggcaagctgtgtgcttgtatgtctgtgtggcagagctagctgtagagatagatgaagagagagagagaggtgagctttaagatctctctcacacctcatgatgtgtatgatcacacacatatttgcacaaaaaatatagagcatcctggggctccattcatcatctttcccttttgtgtagctttgcttgtgtagaagcagatctctagatagcaaggagagtgtgtatggttggccatggcattgatgtactagtagttagtttgtacatgaatgtgccaagtgttagtgtatgtatgtttgatcaggtaataagggtagagggataaacaagcagctgatgatataacactctctctctctcttgtgttccagtttcttttgcatcatctcctgtttccaaccaatgagctgctagggttagggcttcatccccatgtgcatctctctctctctctctcatgagtgtgtgtggctgtgtggtgcaaattttagtcccgagcaacttcacgagggcaggtgatgcctgacagcaccactgtacttttgaacaggaaccaaacacaaagaagggatccaacaaagaaacagcagtaaagatgaaaaaaatacagtaaagtatataggggagtacatatgcatgcgtttgatttactgaaagaatttacacaaagatgattgttccatattttttgcatgtctccctttcctcataagctatacatactgaataatgtgattatataaaaatattagctagtctttttttacaaatgattttgttatgactattagttctagttatgtgtcgtatgcatgtaaataaaaaagtggcaggataagcttatttgttttttcatcaaataaagaaaactaaaatttgtgtaccaaaatatcagtttcaatgttatgtgaaaacatgtcatgcaggcataaaaaaaattacacacatggccactgttgtctagttatgttgaagaaaaaactgaaaaactgtggtctgcatgaagtatttgaaatcaattaataaaacatattgactttttcttttttgcttcgcgactaatcaatcctccttgaaaaacgaaattagaagcacatatatacgttttgttgcactgcttaaacatggggatcagaaacctctcatgtatcctcaccaaaaaaaaaaaaagagaaagaaaaagaagcctctcttgtacggatgacacgtgtccatgcagccactgtcgcagtagaaatggcgtccaatggcgtggcagcaatggtacaactactgggcctgcatttgtattgggagactacaagaggagtgaagaaaagctggtggctttggtcagaatgggaatgggtaaaagcctacagttgtgtagtgtagtctctgtgtgtgcgttgctgccttgttgccctcgtttgtccattgggttaaaaccagtctcactgttgctgcccaatcatgtgaaatcctgtgcccagcttcacattgggcagccaaatagcgttctcgagaatcctaaggtttcatttctttcttgccaggaagatagtaggattgatgtctgtacttcagtactaccattactccaatttctttggtcctcgaacaatatgtttactggtacattaccactgtaatgtgacatcttttttgcatttttttagataatggacatcttttttgctacccaaaatataagaaattctaaggaatgacagaaagtaggtgaaataaaataggaaataattgtggtaggttgatattgaggagcaggtgaaaaaagtttttatatttaggatggagggattaagtaatttcttgcctgaaaatcttcatttgggttggaggggattgatagtgctcgctgcttgatatgattgtttgttagttattttatgcagcaattgcacgctttatgtttggacaaaggaaaatttcaaaggttgtagtgaaaagacatgagctagctagcagtcacttcacagtagcatgcatgaacagaagatctttgaagaatatttttggagaaccttttggggatatctttggtatacagtgatctctagctaggttttttttagggtagtactccgtatactatttccacatatttgtcggtccttggaaattaaaatgatttattctcatggatttatcatcataagcagtttctgctcaagtattgtcagcagtttgtgttattgacttgtttggtagttttttttttttttgaagaacttatttgctagttggctgactaggtagcaagtacaccattttggaaggtggccttccacaattttctgtctaaatatgcttaattatatggacataacaatatctcctttgtgacaataaaaactgtggaactacgtagttccacgtatacgttacgtggttacattagtaagtacaaccttgtaaaacattagcatgtcatatgcattgatctgcctaagaaacgagaataaaatctctgcgatgagaagtactgttggagagtttatagattgcttaaggtaataggatattttttgttttcttgttatatactattcatcgtaagctctgctcctattgccgcatgccctgttttcttcaagctattcaagctagatatgatgctttgcttgataactatgcaagaaaaaacaagatttataaggtcaaaataagtttgcttcctacatgcttgggtttttcatatgttaaggttgaaaatcataattaacaaacacaccaaaactaaaatagaatacataatgtgatcgtgaggtgaacacgggataagtgttgtttgggctgtcaaacgtacgttctatacaactgaactccaaatatatattatcatccataccatcatttttgagttttcttatttttcaaaaaagagaaaatactagtgtatccccagtccatagtatatctaagccttgatttttttaccttttatttatagtattattagagttcacttaagaacttagctctggtactactcatttttttatactaaatttatgaatgcactttgtaagtcatcacatatttgtacatctaattgtttagcaatgtgcacaaaattaactatttgttatctagttaaggtgtatattaatatgattccgtgatttcgttaacttgtactgaaaacggagtagcatgttagggccactattctatagctttatctgttaattcgaacctgcaatttcagaagtgtctttatatcggtttcaaagagtgataaagcgcacatacactgatccttagtccattatatgtagtcttgtatgctctttttcggatgaaaatagttttatacgcttggtgccattattctcttgacatagtgtctcaaaattttgtaacttaatgctgatctttagttcattatatgtagtcttatatgctctttttcggatgaaaatagttttatacgcttgctaccattattctctcttgacgtagtctctcaaaattccgaacttcacagtctcagtttgcatactttttgttttctcttctttgatttagggagccttgagttattttcgttgaatagtacgtattactagtatataagaagcacatagcagcgacttttgatttgcagtcattttataatatgaaaaataccccacaaaaaataatatgaaaaatagaataagtgaaactagtaataatcggcaagtgctaactaatggggataaatataactcatgaaatattgccaaataagatgatgtctgaatacactggagtcgcacaattgtttttttccttgtctggtggcgtcagctagcgtttgtgttcacttgtcccttcgacacaccggtatatcacgatttcttgtgccgtacccaaaaacaaaatcatggataagaaacacacatcacaccaatggagtcgtctagtctcattttgtgcatcaaaacccccagatcgatgacaggaaaagctctctatctcctcggtaaagagaaacagtactccactgtgctactctgcagtagttcatgaatgagcgagtgacttgtgatagcgcacgattcggaccaatgtgctatgttgtgttttaactatggtcatttgcccttgaacgccacattctaaatgtgaagtattccctcctgttcatatgataaatcgtttgatttttttttctaatcaaacttctttaagtttattaaattatagaaaaatatattagtatgttcaacataaaacaaaaatattatcaaaataattaatgtttaatttaatgaaactaatttgatattttagatgttaaatttttttataaacttgatcaaactaacaaagtttgactagaaaagaaaatcaaatgacttataatatgaaatggagggaatactagatattaatgtcagtttcaactttctactgcacttatttatactgtattctctgtattactaattgatgttggttattttcgtccttttagtagtacatgaagatgctgacaagctatgctcagttgcctcttgtgtaaacttttaaaaccaatacttatacgataatttcgggatagtaaattcaattaattatcatacttttctccctcatagctagcttgccgaaaattatatgttctagaaaaaaaaacttttttggaattgcctagcgagtaagttttttttttcgcagtcgtcttggctatactgttctgaaactggtaatttcttgtgtaggagtgattaaacataacccttgactaatcatggtcatattgcagtgtgaaatccaccgttgagaggtacaagaaggcaaacagtgacacctccaactctggcacagttgcagaagtcaatgcccaggtaacatcatgtcatttctttcagtctacattcttcaactagtactaaattttccgaattgactccgagatgtggacatatatagatatcagaataacagtaagagcaatctttaaatgctatagaactttcaacattcttactagttactgttgtgcaaacgcaaacatgcatgacctctctgagcaaaatcttcagacaagaaatcctgagcagaaagttatgggcattacacagcggttattgcagccaaccaatgctctgaggagtcaggatcctctgtatgatccagtggatcacatgcaattgttcattagaccaatatcgtaatttcatggcggtagagatgcctaggggttcacaaatcttagacaaacattgaaaatttgtggattaatgtagagaacaattaaaaccatcaattgtttatgcttagtcatgtccaccagccatgaattaatcttgcaatttatgagtatcataaaccagctagtagtcaaaaactgcagtatgtatccccttgaaggcttgaacagaactatttggtgtgctcagtatattataggttgaaggaaactataggggtgtgaagtagtatttctaataagaattaatttcctggcaccacatgaaatattactccataaacaaatgtactacgtaagtagttagtagtagtaaaaacagactatctgaatttatacactaactccatcctatttcttaacttatataacttaatttgatgattctatcccagcacagtaagctactatagtatgaaccttcagactgcactgatgtttttctgctagagtggtgtattgcatacagtagatttttattgaaaaaaaaacttggcctgtaaaatttcttatagctaaatctgagagatcatgtagttttttgtgaagaatatgacgtacgtaacataaaacttttaaacaaagacatgtttaatacataagtgaaaattgaaatagactaattataacccaaacaggagtttttctctgcgaatgttcggttgaacatcatttcagctagaatatgttttcaacataaactttatgtactgatgaatgctatcatatatgctgcaaactgcagcactaccagcaggagtcctccaaactgcgccaacaaatcagtagcttacagaacgcaaacaggtaaagattccagatacgtatgacttacttttgcaccaatataaaccaaaatgttctgtattgcagtctaactcggcttgcctaaatatctctagtaggaccatagtgggggattctatcaacaccatgagcctcagggaccttaaacaggtagagaacaggctggagaaaggcatagctaagataagggctagaaaggtatatagtgcaactcaatttaaagcattatataacttatagtatacatcagctatttcttcatgacttttgactaagtgcaaattctatgttctttaattccatgcatgagctatcgatgtcctttgtatatctcaatttcattttgatcgtcctaatcaacccagtggacatttctttatcgcagaatgagctgttatatgctgaagttgagtacatgcagaaaagggtaagtaagatcatagcacgagaactcgttttatgccaaccgtacgtagtttcctttcttttgcatgtcttagttccatttttcagaccaaattacatgtcacatatatattattcttcaggaagttgagctgcagaatgacaacatgtacctgaggagcaaggtaaatacattcctatgaggataagttattgcagttccaatatagttaattaccaactgaattctttctgagagctgtggcctctgattatataaataattgattatgtaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggtaaattgagatcaattaactgaatatatatgcttacagaatttcatgctccagagatcgagattatattattcagtctttttgtgtttcttacaaatccagctacatatgttaatatacagttcttgtttaacttttgtttctattctgcaggcagcagccggccttcaattagttttggtgtagacaccgtacgtacacacgtacgttaggtaaataaaacactcagtactgtagatttatacctacacaaaagtatatatttgcagagtataatccagttaggcaagttgatatttaccctctgctatttttacataactgccagcggatactatttactttcgaactttggcaactcgtctttggaaatgataaaatgttattaaagtgtgctatatcttaaatacaagcatcggacttttgttcactttggtctaacaatttgagagaaaacaatgttcaatattcaaatggaaagtaaatgttgtcagttatttagaaacgaagggagtatatgtattactggcattcatcttaataattaactcagtaactgtttcttacatctcttgtagttgaaatctgaaagtgtgttgtatctgttgcagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatatatatatatatatatatatatatatatatatatatatatatatatatatatatatatataaacagcacgtttgtgctctgattcgtgtaactgatcagcagatcaaactctaccactgccgatatatatgtgaggaccatggattgatgcattgtcgttgatcttcatgttgtgtcttcatccgtttcatattataaaacgtttgactcttttcctagtcaaactttattaagtttatagaaaaatttaacatctaaaatatgaaattaatatcattaaatctaacattgaatatgttttcataatatgtttgttttgtgttgaaaacattgttatattttctataaatttgattaaatttaaagatgtttaactaagaaaataatcaaacgaacttataatatgaaacgagggagtattatatatctacggtctttgctagaattttgattttacacgtactggttctgttgaaaattactatatatttgcaaatcaacctggcgtgcatgtgtcaaccattcagatcatgcatggaactatgcaagacaggaggtactgtgatgaatatgtcccaaaattatatattcatatatatatgtgtacccactcacgaaaatttgttattcggtgttgcttttaaaacatatatgttattcgacaagttggcgtttcaaaattttaagcacaaatacaaggctaaaatgtagctttcataactgcaattcgtctccaaaggtaaaaatatcatgattgtggtgggtaaaacgttaggcggtgggttttgcaaatttcatgtcaattctaacagcggtaccggtggccacgaagagcccaaacccagctgaggtacaggcccaacaagacagcacggcccagtaccagcagtgggccatctcgtgggctcgtggcctggtttactttctctcatgtggcccaagttgatggcgtta

SEQ ID NO: 487 - DNA, 10115 bp, Oryza sativa
tgcatgacttaattaattcacaggttttgttgattacattattagtaagcttgagagcacaagctcaatggatttttctataaatggggatcattttgcaattttctttgtcgtgcaaagttagccttctttattactacttctgtttttaaatatacgatcctattgacttttggtcatatatttaaccatgtatcttatttagatagtttgcgcaaatatatataccttcaatgataaaattagttacaatgaaacaaatgatatttacgcaattctttttactaaacaagtcacaagaagtacctgcagcaatatatgttggaaccgtgcagtagatcgagcctagctacgcaaaaaaacaaaaagagaaaaaaagggaaaggaaaaacattaatcatgcatgagcagtatgcccggcaactggaatttgtcaaagatatggggagaggagaataatacaagtactactactacctagctctaccatgcatatgcacccaaaggcaaactggattattggataaagcacagatgctggcaaaacaatccttaagcctcccctccctgcttctttatttttgggcagcctctaccggacggtgccgtggtccattggaccagtaggtggcgacatacatggtttgggttaagtctaggagagcagtgtgtgtgcgcgcgcaagagagagagactgtgagtctgggagtagccctctcccctcctttggccatcttcctcgtgtatatgcatatatgcatcatcgcaacggtgtatatttgtggtgtggcgggtgtggcattggattgcccccattttggctcgtgcttcccagttagggtaaaacctgtggtaaacttgctagccccacgccaaagttacccttctttattgttgaaagggagaggaggtgtgtgaattgtgatggagggagagagagagagatagaaagagagatgtgtgtcaaagcaagcaagaaaccagtttcacaaagagctactactagtactagtgtactactgtggtacagtgcccaatgtcctttctccggactcgactccactaatattctcctcttctcgcgcggctcgttatattctcgtcatcattggaggctttagcaagcaagaagagaggcagtggtggtggtggtggaggaggagctagctagcctgtgcttgctgatcggtgctgagctgaggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccatcaggggagccccttctggtattaagatctttccggcacattgattttcatactttgtgatgaccctggaagaatcggcgtagcagcgtagcaccgctccattttggtcttaccctcacctccccatgctatgaactgatcaatttcattgttcttcatcacccttctcctagctttccacttccttcggatctcatgccatgtttctcagcatgaatcaaatttaattcgtgttttctacttccatatatactggaagaaatttaattagatctatttttgctcgggaggtcttcatactttgagttctgatgccatcaccttatttcccccccccccttctcttgttctatcttcttcctcatcttggcttgatcattttgatctgtcagttatagcatgatgcattctcaatttgactgtatgtaagttcaaccggaaatatgttgaatggattttctatatatcaacacttgatgtcaggcctgcatctgtttcgcttgtggtggtgtggccaaaattgtctatatttgatctttgctcttctttctcctcatttcatgacgattcctactacggcttaaaccattctttattctttactaatcatggatgttgcttgactcctagttgtttcgtactagctcaacttggagatcttttcattatttgcctagttggtgggtacgtttgtgacagatctaaaatggtgcacgaaaagttttacttattatgaaaaaagggagcttaacagggtaatttctctatttattcgtgatgacattttttccttgataagggggattttttataatctgcactcacatgtttatatgtaaaatctagctcttttgttttgtttttggcatatttcccgctaagtatagagtttatgtggataacattataacttttcaagatccaatccacatctttgattgtgaaaatcatacaatagggaaaatcaactgaagggttaattagatgctatatgcatatatatatatatgtgcgcgcgcgcgcgcctgaatttaactatgtatgcatccaactgtttcattgaaaaagatttgatatttttcagtctattctttttcgagtatatatttaatatgtttcaatctgttttgaccattataagataaagcctatattcaccaggcatttgagatgatcttttcatgcatgaaaaagctgttgttatcacttcaactaaccagacgatctaacatgtatttgtataagaaacagaccttgatttccttctgtaaaatcatgcatgtgttcgttttgaattggagtcggcgcgcctgtgttttgaccgtcaggaaagtcttttttttccctgaatagtcaagggtctatacttcttgaagcaattgggacactaatcaattattgtttatacctcggaccatcttttccttcttcacaccactaatcagtttatgccttggaccattaattgtgttgttcacaagcttcttgtttatggtttacaaagcattcgcctagatttgtgtgtgtctctacacatcgatcacttttaaatacttgtcgctttcagttattcttttaacgtttggttatttatcttatttaaaaaaattatcgtattattatttattttgtttgtgatttactttattatcaaaagtatttcaaatatgacttatctttttttataagtgcactaatttttcaaataagatgaatggtcaaatgttacaagaaaaagttaaagcaaccactaatttagggcggaggtagtaaaacctagttattgtaaccaataattttatcaatctataaatgcaacacaaagtcacttcgtgatatctcacacaaagccacttcaacgatgaaagctgactgcatgttttatcaaaacacatgtgatcagtttgttggatgaaaaaaattatctatgtcataaatcaagagttataatataagcttctggctctacaagtaacatttctatgttttttttttacgttcttacatactatgttttgccaaaaaaaacatgatcattttgttggacgaaaagaaatagtaaatatagagtgacctttgatatcattataatataagcttctgcctctataaataacatctatgcactttttacgtcgtagtaatttgatatatgagaaatttacatataacatttttgtgcagcataacaaagactttagaaaggtaccaacattgttgctacaatgctcaagattccaacaatgcactttctgaaacccaggtatatatatctgcatgaactggtcatgaatttctgctgttggttttggtttcaaaatgggtcttgtttttttactatatatatttttgtatgaatatgcaattatcaatgtcctgacattgaaattagctacagtataaacctagctaggtattttcatcgtattgtgagattacattcaataaaaagtacacagattagcataactgtgttaatttgatgatgtatcccaaagctaatttgcagtgacttaaaatattttacttgacacagctactaaatcggatgttcttttcgtaaaagcattctaaagaatggcaaagtttagaagaattaaactagtagaatttcaacaccggcatgcattaaccatattttatgtaataaatgaagtttttattgacatgtcaaaggaggacaacaaagacaatcccttcttcctatatagttggtacccactacaagcattaacactataaagaagcatccaggttaagccacatcatcgataatcaatagccgtcggatcaaatgcatctttgtttgtttaactgtgcatgccttaagtaaggaaactgccatgggtaattaggcacatcaatggatgacccacttaagtgctcctggtcatgcattacatgcatcccccatattaagccactgctatatcccttaaccatctaccactcaaatgccaactttacactttattattttagaatgtttacttttgatatttcaattcttcaattctgtttgtaagcacatatttacaaagttgtttatcatcaccataaaatcccgtagcaacgcgcggggtatcaaactagttgtttgttataattataccatattacaatgcaagatcgtgctgtttacggcgtatatgtattcagaaatgttgcacctagtataggtttttaccagcatagaatatacaaatagctagtctaaatgactttttgtgcccctagctccctagtgtaaccttacatgaagtattccctgcatcgaatatgaagtatatattccctgcatcgacgaatatacaaatatactcctagctaggctaaaatacagccaccagtatgaagtaaattagtcgatgtagttcaatatttaaatatagatggtgattgaatgtacaacaatagtgcacatcccaaaaaaataagggtgtacctctgtgaccagatagtactccctcagtcagggtacgtccagattcattggactaggatatgtcacatccagtactagggccctgtttagattccaatttttttttcaaacttttaacttttccgtcacatcgaactttcctacatacaaacttccaacttttccgtcacatcgttccaatatcttcaaacttccaattttggcgtggaactaaacacagcctaggttggtttttcgtgggacggagggagtactctttatggtgattctaaatttcagtcaatcaattagagtacgtcctcataacatttcaaacaaaaacatagatgcccttgtgcataatttcaaaagtcatgagatcaaattgaaattcttgagaacttaccaaccgcaaaatatctaaggagttatgtcacttggttatatttatatcattgacatcctgcaacttatttgcccaataatcagtatatatagtttgctagctgtatcattaatagcatgtttcacaaaattttaaaaaaagaataagcccaacgtatatgtacaaggaggccatgtgacatatttagttaaaattcacaaacgacttttatcaagtgtttaaagaaaccgcagaaagttaatttgctctgtgtaacactaatattcagtgtatgattcgccaaacacacagttccttagtcgttagaactagctgataaatatttttgtgaactgaactaatggtttttcttttcctctgatcctgaagagttggtaccatgaaatgtcaaagttgaaagcaaaatttgaagctttgcagcgcactcaaaggtatttcactatgatctctccaagaagcataactcctgcaaatacacaatatatttttctataacatgcatgcaagtgataatgttgtgttaagggaaagagggaagaagcagcccataacgtgcatttacacacattattctgtaatatagctgctgcgaaactttatgtgtcatgcaatttaccttaatatttacattatgctctttgggttttgcttgattcttaaaggcacttgcttggggaggatcttggaccactcagcgtcaaagaattgcagcagctggagaaacagcttgaatgtgcactatcacaggcgagacagagaaaggtttatggcattctgcagtcctttgtttggaaccaaaatacttctgtttctagcctaccctggttcgcttgttatttgtccactgatttggatataggtgcaatacgtgagaagcaataaaatatacagtatgtctttagtttgtaggtaaagttatatatatttataaatagacaggaggtgtacgctagctatggaatatccccttgctaaagtttatataaagagcacctaactaatttgtttttgttcatggaagtgaacataataactgggaatgcttatcctacattatctaaagagaattgcataaaattgtttcaatctctagctaatgcatggtggtggtttggtagaaagccaagacatatttcacttagaatattgataccttattttatggtaaaggtcaactgatgatatttttaaagaagtgtgaaagctactatgcagcataagtaatccctttgtttcataaatttgccctaagtcattatctttaaccatcaatttctggaaatttgtgtagtttaacaaaatgtgaactgtacattctgtaaggatttttcatgttgtgtatctaacaacataacccttgtggtgttaaactatagtatcatttttttagaaactaatggtcaaaaatatatataagtgtttgaattaggacaaacgtagaatgacaagtaatttgaagcaactgggcgtagcatgtatcttgataaattcaccctattctaggcacgaaggtgatgcatacagtggcactaaatttcatataaaagactatctaagtatagaatagaaatatagaatggctagcacgcatgccctttttctttatatggatacatgtgtagtgacagggccgagcaactgcaacattaatctaaactgtcaatttcagatatactactacttatggctgcttgtttaggctaattaataattatatgtttactcttttcaaaataaaacacttcaaagctgcatgacaatcccgtcaacaaggatagtaatgacaatgagtagctgatgaaataatatggcttcaattctggagtttcaggaaaatttagctgctaaaaaaagaataagtgaataacccaaagaaaatagaactttgaaggatagaggtagagagattaaatatacactagtattcattttgtggtgcgtcgtacatgcttcaaaatctcccaaggaccataaaagatcccaagaaatagctaggtagaacacatgaaagttcagaaactggatataatctacacttcattatattactgtcaactcaatatgactgtgcttgaatggtttttgtgcagacgcaactgatgatggaacaagtggaggaacttcgcagaaaggtacattatcaatccaaagtttctcaagcatacatacagtatcagcattgccatgggcgggtgacttcaggagtgctagctactagtgataatctaaattaaaccacgaaatgacttggctagctttgacaatgcatctatattgccagcaaggctgctagggtataccgcatgcaagttaattagggtagatcgtgtagcctttgactgtataactaaagaaatggtagcttcgttcttgcgagagatttctttcatgagagttgttacatattatactatctccaatatatttttcttgtgccacaggagcgtcagctgggtgaaattaataggcaactcaagcacaaggttcttattcactcggaaatctgttatgccaatgcggtgcacatataattatttattgataattttcattcatatattctcatatccaatgctgcagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtaagattaatcaagaaaagccaagaccagaaatgcatatacttataacttctagctcaaatgcatacagctcgatcacagcatccgaactagtagaactaatgaaagattctcatcaaactgactgtgtatatcttgcttccattatattatctgaaaaacgattatgttactaggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggtaaactgtttattacgtactctatatagcatatgtgaccgacgacaacggtttcattttagatgatgtgtatggatgatttctttccaaaatcacatctttagtataagagcaattttaccatccaataccaaattttatactagaaaatattttgggatatcaaaatttatggtacctccagtaccaaatgttgaatggtaaactttcataatatacaagtcactctaggatatttaagacaatttttagttttttcttattgttgcccttgttaaatacatgagaaattttacatcacttaaaatgtatcaagaggtatcaaatttttttaatacaaaatttagtactttctccgtttatatatgaatgtggacaatgcttgaaagtcttataacctgaaactgaggtagtgtatcgagaagtacaaaattttacactaaaatcccagtacttactcaataactgtaaaattactctaaatatgtactccctctatttcagattataagttgttttaactttagtcaaagttaaactgtttcaagtttaaccaagtttgtagataaaagtagtaacatattcaacacaagacaaatatattataaaaacatattgaattatagatttaattaaattaatttggtattgcaagtattactaaatttgtttataaatttggtcgaatttaaaatagtttgactttaaccaaagtcaaaacaaattataatctaaaacaaaggtaatacattgtatcactctcatgaatggattgtaacatacattaatttaattactattttagttcttgtgcaaaagttgaaaacgatttatgtttggaatctttttgtggtgtatatatatgaaaccattcctctaccatccttccccaaccataatcctcacaaccgttagccccattgtgatctcacccagttgctagcctcttttgtcaccttgtcacagctctcctccattcattacacaatggcatcagccttctaatcctcgttgtgtagcaatctttcacatgcttgacacacatgaaggtatgat

SEQ ID NO: 488 - DNA, 5258 bp, Oryza sativa
cattatgccttattatatgtttatccttcttagactaatgtttacatagagtttaaatcaaccacagaatcaacaagattaaccttgcagtgcgattttgacattattcgcacgcatcaaacaagctcgtgcacagaaacgagcgttttagaagttcatgtactagattgcaccaacctgacaagttcgtgtaccgctgatgcaatttactcttttgtttatctcaaaatacacagtatctaaaagtattaagttttatattaaaaaaatacggtgtctctcgatacattaattatccagaatggtaaaataattcttaaaaagtatattttcgccctcggaatcaaaaacatttttgagttgccctagcgtggggaaaatctgcagaatgacacgctaatcttctgcccccaccgctcacacgattacatggacaaccgccacgtacgataattaagggcacaaggctacggcctcacccgtgttcaccgtgtacgcaacaacagtacgcatgcaggagtatcttttttcttcggaagaggaacagtgacgccgttgctacctccaaggagagacgggacgaaaagatcgaaggacacttgagacgtgcgccacattacaaatgcacgtacgccgtgacaggacaacacaatgtgtgggtgtattactcctataaggcttactgtgcctactttttatgtaccggcacgtaatagggcttactagaatctagactatcaaatcgtgtgtgctctagcgacgcatgcagctttctacaggacaggtcgttttcacgtagtatcgatcggtagctcgctcccttcctccaagtattggacaaaaaccaaaagctagcgtgaatgcagatacatcgatccggaccaatgcaacgagctatggagatttgtcaagtcaaccgcgtgcagcaactatagcccaacactacagtggccgctatataacgagcccaacgcgacgcacagaggtgtgtgggcgaaacacaagaaacaaccggagaaaccgagcccggccgaccgcaaggacagcaagctagtagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaaggtatcttacgcatcgatcataccactatctttctcctcttgtttcatgtgattaccgaacacgctcgtgcgtattaagtgcgtactgtgtgttcttgcgtgtgaattgcgacgatgtcatcatgcatgcatgcaaaagctgatcggttaaattcttaaccatgttcctgtgcttgttctgtacacgatgctgtgatgcatgcatgcacgcgaacagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtacgcgtgatttacgagcattacgtatcttacgtactctatatcttacgtactcctaccctactatgctcgcgttcttgcataagcatgcagacgtaagacgatctgaataagggaacgttcgttcctgggcaatctgggggattgagagacaaaagcatctcgttttccgtgcgcacgcttcccaaactgctaaacggtgcgttttttacaaaaaatttctataggaaagttgctttaaaaaatcatattaatccatttttgaagtttaaaatagttaatactcaattaatcatgtgctaatggctcacctcgttttgcgtatcttcccaatctccccaatctccccaatccccttctcctcaaacacaccctaagactactgtcatcccaacggctcgacttgtttattgtttattactcattcacagttactcctataagtactactagtaggagcaaatacatcgtgctgccgtcagatatggagtaggagtattctgttggccagtcttgagttaaaaaggtgcgaaagattcattatcattgcatggtaacaaacagttgattactaaagcatctagtaaataacttgagtattttcaatgcttaagttttccgcctattcaaaacttttagcattggctctttgacttaaaagggcgacagtgtttaaaatttctagaaaatcaactgtacaacgggcaaaaccttttgaaaaacattcgtaaaacagcaggaatgctcactttccttctgtaagacttgctagggtgttaatctattctaccaattcatgctcacagacgaggaacacacatcacatggtaacaggatgctccctgtttctgtcataccggtatttctgccatgcactcgtgctctccctgtttcattagtcccatgcatagccgtccgttcgctttgttacaagcaaacagtgattacgtagtggatgcttcacgtacgcgggtagtagaagaattcaggaagagctggacacgagcgcgtacgccgatgcgcagtagtaccaagtaccaacctgaaaaagagtgccgacgtgtcagttgcaggtaggctggcaaagcctgcgttccatgtgttgtcttgtcgggccctagccatcagcgtaggcatgcatggcaatggagccacaccccacagccatggagccatatggaggtagggggaggaggacggccacttcctcggattccgtggcggcaatccctcgcacgtacggccatgtgagctcacctgccgccgtggatcagggcgctcagctcggagacggtgcaatgaaatgaatgcacgcacggcctggtcggggttccagggtgattggatggctttgcatcccgtccactcacagcccggacggaccggctgctgcatcgatgcgctcctgcgcccccaagcagccgatcagatccgtgatctcactgtgcgacgcatgagtcatgtgcacgagctagctgcacgcacacgcgaacgtctcggtggtgaaacgcaatgaaatggccttcatgcatcatgcatgtatgggtggatgcaggtgacgaaccaggtgttccggtacgcgaagaaggtcggggcgagctacatcaacaagcccaagatgcggcactacgtgcactgctacgcgctgcactgcctggacgaggaggcgtcggacgcgctgcggcgcgcctacaaggcccgcggcgagaacgtgggggcgtggaggcaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatgctaaatcctaaatgtcgtgaattttgcatcgtctgacgaaatgttatgacatccttggttcaagcagctctatttatgaaatgctaaatcctaaatgtcgtgaattttgcatcgtctgacgaaatgttatgacatccttggttcaagcagctcgaatatgtgataatcgtgacatatcctcatggccaaatagatattggggttaaatttgaagaggactcgacgggtaaatggccaatagaccaccctcatggccacatatcgtttaattccatgctaaacaccttctacctcctcattttgaatctcccttatttattttaatgcttgtaacagcaggcaccttcttcttttctcttaaagaaatccacctgaccaattagtatgggcagaattggcgactgtcaatagagaaaaaatcccattgctaaatagcaagttcgtgagtaatcagaattggctagatgtgcttttatcatggtaaaagaactgagaaaatcatacaggttcataatgtcccatttgcagaaacgggtgcaagcaagagtgacagattcctgaaaatattactagtaggcattttgatcagatcaagcacacagaaaataaaactgaatcagacatctcatcagacaggactatagattaaattatgcaagtacttgaaactccattccagaggaccaaatggtaccaagttgcaatagtaacattgaggtctcaacaagatcactactaaagcatgacaaaaataggtcgaatcacatcgtctcgtaaggtacataagcagcattttggaacaaatgatcacttcagtagcacgagatggtaatgtcctcaaatatcaagcctgaaaaggtaataaaacataaagatggttatacatacatgatttcaggacaggctacagtgaatagtttattttcatcaattacatttagatacccattaaaacatttaatcagatataaattcaattacagacatactccgcactaagctatttgagcttactatat

SEQ ID NO: 489 - DNA, 6977 bp, Oryza sativa
ccactgatttgaactggtacaaagttaatggttgacttaactccaggcgggcgaaggcggcgtggggaggagccgcgcgcgtgcggcgggcgatggagcggcgcgcgggcggacgtgggcggcgggcggcagccaacgggggagcagcggggcgcggccggcgtcgggtgcagccgcaacgtctccttcgccacggcctgcaggtcaccgaccaccgcgtcgagctccgcctgtcgtccccgccgcgaagatgtcctggtacacgagatcgccggtgagctccgccgtctcggcgaccacgctccgcatctcctccatgtcgttgtcgtcgccggtccaccgccggcccatcaccatgcgagggacgatgttgctggtgacacccatcagcgcggcgtcgacgtcgacgtgctcggcgtcggtggcactccagctgagcgagccgacgaggcgcgccacctcctcgcggcggacatggcggagccggtctagcgttagtccggcgaggagctcgtgcacctccgcccagctcctcctcggccgctcgccgcctgcgcgcggcctctacccacgccgcctgcgcccgccggccgccgcccgtcacgtgcagctgctcccccgcgcgccgcccggaaattggagaaaagaggagagaggaagagaggtggagagaggaaggaagaagaggctgacgcgtgggggcccacgtgggtcccacgctgagtcagctgccacataggataaaaccgagtcaaaaccgcctagaaccgccgagagatctaatttgcactggttttgtaagtttggagatgcgtcatccggttttacagttgaaggacgattttgtaattcgatgacaagttgagggacctttggtatactttttccttttgccatttatagatgagattatttgctccgtttgcaaaacggaagaggcaatccagccaggttgcttccggcccggcccaacacgacggcggcacgaggacccggtgatctctccctcccatcctggccgtccacgtgtgcagcccgctacgcttccaagcgctagcgccgccgatccgacccagccgaatccgtctttcctctcctcctcctcctcctcctccgaccaccggccagccggcgaagtcctccgccgcggagctcacctcctccggcgccggcgacgcccccctcggtagccccggggaggacgcctttcctccggcgaccacttccccagtcgccgcctccgccgctcctcgaaccactcacgcgccgcgcgggctcctgtcccaggctatcagccgcgatttccctacccctctcgccggatacctcgccgccgtccaagagctagcgtctctgatggtaacttctctgtgagctcgctcgctcgctcgtagagattcctgattctgtatgattgagctccccgggctgttcggttttgcaggaggaagagcgcatggagccgccgccgccgccgccgtacatccacatcgagaccaacgatttcttgcacaggaggtgagtgagtttcacggcgatgtgggacaacggctgcgtcctgtgcttttggatgtaatgcgaatctttatactttggtgcgcgatgctaggcacaagaggcagaaagaggaggacatagctgtgtgtgagtgccagtataatctgctggatccggacagcgcgtgcggggatcggtgcttgaacgtcttgactagcacggagtgtacgcctggatactgcctctgcggtgtatactgcaagaaccaggttggtgtttctcttgttcaagtagtagcgcaaccgttccaaatcttgattgaatgaatatccatacatttgttcttacatgattactttagttcactcgagcctagttactaggcaggaggggaaaaaaatggtgtaacacggttattttgctttcttgtcttcttgattgaatataatccagtttattatagatgtacagcaattttcaatatagtcgtgctggctcttagctgtaaggattttttttcaagtgagattgaatataatctggtttcttatacatgatgtaccattatttctaatatatagttttactaattttctatagataccgaacactatcattttcaatatatagttttaccaatttgctagggaggccgaatgtcatctggagtgctttacagtttcactggtagttatgtttgtattttaatcaatttctctgttggcagcgatttcaaaaaagccaatatgctgcgacaaggctggtaaaaactgaagggcgtggatggggccttttggctgatgagaatattatggtgactgaatttaccttgattttatggtctgctaatgttgttaaatatattcaagtgagtatgctttagtgagtcattgttttcttaatggtttttaggctggacaatttgttatggaatattgtggagaagtaatatcatggaaggaagccaagaggagatctcaagcatatgaaaaccagggtctgttgattttatcttccctcaatgttagcatggtggtacattttggctagggatggcaaccgggccatccccggcggggtgtggtcccccgtccccgtccccgtccccgtgcagttagaaatcacccgcccccgtccccggtgtcggggctgtatttctcccgtccccaagcctcgccgggtgcacggggcacccacggggtcgcacacccgataaactcgtgggcataaatcaacaagaaggttctctagtaggaaggtagaagtagaacagatcggcaaaaatagcacgaggacatacatctatcattttctcagattatgaacatgaccatggtgccagacttgcatgattctgttgccaagaatcagctccaacttccatcaaaatgagaaaaataaacagcgacaaacaggacagagcagaaaataacaagcaaagtatataccggcattcggatgcagcaagtgcccgtcctcttgctttcccgcatgagcaagcgacttggaggcagaacaacagctcgcgcggcatggtcaccttatgcggcggcggggtgctatatcgctgctgtggcctggaggaggtgcgatggctggcgcccttgccgacctcgactggcggctgctgatggatctgagaaggggacaagggaggactggtctagtgtagggtttcttttgctttatataccagcacctctaaattgggcactaagtgggcttttaacttttatggactgtacatatgcctacactactcgagtcacccacggggattcggggccgggtgcctatggaacatccccgtccccgcatcacccaacggtgacagtttctagccgataacagccccatgggtgatgaatttagcctgtttacataccctaatagagtttttacctatcgggtatcggggttcgggtccccattgccatccctaattttggctagctataacatttgttttttgtgccctgttaggtttaacggatgcctatattatctatctgaatgctgatgagtctatcgacgcaacaaagaaggggagcctggcaagattcatcaaccattcgtggtatgtcttgtagcaaatatatgtctgcctatattatgtttctttcatatgcattatttgataattgattatcgagtttttttccatttactagcatttaatgattaaatctgatagcttgttattgaagcatgcagccaaccaaactgtgagacaaggaaatggaatgttcttggggaagtaagagtgggaatttttgcgaaacaagatattccaatcggaacggaactatcctatgactacaactttgagtggtttggtggtgcaatggtgaggtgcctttgtggagctggcagctgttctggatttcttggggctaaatcacgtggtttccaggtaaaaagttgttgtgtgatatgtcttgtaacctgaaaagcaccattttataagtaggattttcccttgcacatgtgctggcataattcttctgcatttctctcttaccatgagtgctgaagtacaggttacatgcacagtcgcttcataaattgttaatttatataggagtagttacaaattggttacattttcagtgtttattttcatttttacattccttttagaatgcccatcgcttatgtaatgaatgctacatttttgccatgttttaggaggctacatacctgtgggaagatgatgatgacaggtaggattgtgcttgtacttacctatccaatctgctgaataaaatattgtctattcaaatggtcccaggaagttatatgtggtaacttctgtaattggatggttttacttagcagtgacctttctctgttattccctcagtcccaaaatataataacttaggatcagatgggacgtttcctagtactacaaatctggacaggaaacgtcccatccgatcctaggttgttatattttaggacggagggagtagttaagacaaataggaaaaaagaagcaattaaacagcatgttaacataactactattatgtcttgctttattatcttctcagatccatattactgtcatgtcttgcattatcatcatagaagaagatcctagttggttaaaaatatgcagatttgtgttgcctgggtcaacctgtcatttcaaacaaagcctgaatttcttgaaatgccgaaatatcgacggatacaacaaatctgagcaccggttaacatatgctttccatcttaaattgcaggttttctgttgagaatgttcccctttatgattctgctgatgatgaacctaccagcattccaaaggacatcttaataaaagatgagccaaatacacaggatggcaacaacaacacaatccaaaatactgggattcctattattgcaagttcaagtgaattcacaccgatgaatgttgaaccatcgattgcgagttcaaatgagttcacaccgatgaatgttgaaccattgaatgtgagctcaaatgaattgacaccaatgactattgaaccattgaatgctattccaatgggagttgattttactcagaatggatcaattgaatatggtgcgcaatgtgctgaagatgctctgcaaaactcaacgcgtggagttgcaaacctccagaatcaaagtgcgccccgggacaacaaccatacagagttggttgcggtgaaacgtagacccacacttcgtggtggaaaagctaaacgtggtatgcgcaagcaactgaatgttgtgggtatctgtgatcggttagcatcagaggtggcacgtgaagaaatattgtattgcgaggtaaagaactactgtaactccctttttattgaacattgctctaggaaagcttaggctttgcaatgaccttttttccaaatcaaatgtcaggaaatgaagaatgaagctgctgctgaaattgacagcctgtacgacgagataaggccggcgatcgaagagcatgagagggatagtcaagacagcgtggccacaagccttgcagagaagtggattgaggctagctgctgcaagtacaaagctgattttgatctgtatgcttccattatcaagaatcttgcttccacacctctaagatcaaaagaagacgcggcccctacagagcaaaatggattgatgtacttggaaaacggtccatgaaccgatttacaaattggacttgtaaaagctagaaaaaggctagagattgattgtcagacatagttgaggtttaggggattatcttccctgatacaatttggttaagaaaattatgcaaggtcatatttttcttattgcaaataccattaacgtgagtatgtttactcatggaaaccctgaaatacctggtgttacaaatttcgaagtctactccatgtctgcgtttcggtacgcctatgtggtccatatgccaccatttgaacttatttttagttcagccattatttgttcactgtaacaagaatttttttggagatcagccattattttttttgggactgtctaggtagcatgtctccttttgtgatcaatcatcacttgttttttctttctgagaggaacgattgtttgttgattgtagcagtaggttatcaattgggctgggtctttccttgcccgcccgaaaattcatgtgtagttgacaaaccaggaactacacgatccgtttggttgtggatcgtgctagtatgactcgtcgccaagccatgcttgggccgctacccggcccggtgtaccaacatgacaagtgcatgtgtcatgacaaactaggaactacacgatccgtttggctgtggatcgtgctagcatgactcgtctatccaagccatttggataatgcgattaaaactaattaatattattttccatttttcaggtttccattgttcaggtagggtgggaataggatgtgctagacgaaattactaattactgttaccattttgtgcgtatcctgataaaggtaatcagtatcgaaataccaggtagaatcgttttctgatttataatgtcataggatccggatagtatcataggatcgagatactaccagattttagaaaatacaaaatttgatataaaatagataatatgttatataaattaaagcatataaattgattccgataaatttaattggtttatgtaaacttaagcatatttgttcatactatttttaatctatcttatactaaatactctctccgtccttaaatatttgacgccgttgacttttttaaacatgcttgatcattcatcttattttttaaaatatgtagagctatatgtatatataaaagtatatttaacaatgaatcaatgatagaaaaataattaataattataatacgatgaaaaaaagtaaacggtgttaaatatttaggaacggagggagtaatattttgtaggattgtagaaacgcgacagtaaaatttcgtaatactgatcggagtcgtagaagggtagggatccgtagaata

SEQ ID NO: 490 - DNA, 5258 bp, Oryza sativa; identical to SEQ ID NO: 488

SEQ ID NO: 491 - DNA, 4403 bp, Oryza sativa
caattgtaaaatgacctttttacaggcattaaacagttaactaacggtacggaaatggtataaaacgggttaaaattaaaattcagaggtatataaaaaatgagcgattagctaaacttttaggagtataaaagaaattctcttactgaaaaccagagggagtactacatataacctcatttttttacgggttgataagttgcggaaaaaccaacaaattagcaacaaatatgagtaaaacttgtatacatgtgtcttcttagcgatttaaaaatcaatgctgaaaataaattacaataaaattaaaaatctcaagataatctctaaaatgtagttttaaaatttaaattttgattgcgactgataagaaaaaaaaacaaatgatgggaggctatatcaactgtcaaactggctaatttagaaagacgacatcgaattcctacagattggaggcagcaaaagagagcccgtctctgccgggtgcgtgcatgatgctcgatcatatcccatctctcctcacttcatcatcaacaagaacaagaggaactatatagctgcaagatctagactgaaactactatagcaactaactgtactgtagctagattacgcttagctatagctgctgctgcatctatctgtaaattccaactacgacgtcgactgctgcaagctagcttggccggctagctagatagctagctagctcaaaagagaaagctttgcgaaataggagtaactagctagctctagctagggcgccatcgatgcgtgaccaccgagctcgcctcgtccacacgtacaggaagacgatgcagaaagcggccggcatgcagtacactgaccgagctaagagagagagagagatgatattattcttctgcagctaaattaaagtgaaagttggacatggacatggacatagtaattttgcatggccatcatcttgccctcctatataaagcggccatctcactctcaaccacagctcgatccagcagccctgcaccacacacagttcagctagcagatcacctagctagatagctgcctctatcacagtatatttgctccctgcaacttgctgctgctgcaatagctagcagctgcagctagtaagcaaaactataaaccttcagggttttttgcaagatcgatggccggaagtggcagggacagggaccctcttgtggttggtagggttgtgggtgatgtgctggacgcgttcgtccggagcaccaacctcaaggtcacctatggctccaagaccgtgtccaatggctgcgagctcaagccgtccatggtcacccaccagcctagggtcgaggtcggcggcaatgacatgaggacattctacacccttgtatgtgagctctaccatgtgtcgtagttggtgcagagaccagaagttatactttctttcattattatattatagaaaaatttgtttggtacttaacccaagatgactttaaaatgcattaatttgatgtttgtcatggttttttgtggtgtgtacctgaaggtgatggtagacccagatgcaccaagcccaagtgaccctaaccttagggagtatctacattggtaagcacactaatgttaagctagcgcacttgttttcatgcaatgatcaaaataatcactgctagctgatttacatacataaccacatcttgactgcatgatgggttgatcatcttaatttgtttgtccacaggttggtcactgatattcctggtactactgcagcgtcatttggtcagtattaaacgatcaaatggtttagattgatttgatttcccacttaaatacattgcagtataaaactaacagaggtaaattgtctttccatactattgtttgggggggggggggcagggggcagtgagttgttgagcattttccctcactcgcgagcccccagtttgccgcattaattccccatcatccttcaccaccacaaaaaaaaaagtgatttggagaaggatacgctcctccaaataatttttaacaagttcaccaccacaacgaggcaccgacaaccgccatgagtccacgcaccctgcagctagtcgtgccaccagcaccacagttagccacaccgcgagcaatccacgccatcacttgccgctgtgagtccacgatcacacgcctcgatcagccagctgccatgatatgtcggcttgggcttggattctgcaacataccatgtccccatcgatggcaccacactctaattcgccaacacaacactgaagggatcggatcgggagggctagctcactcaagatagtgacgggatgattcgatgggaattccatggggaacaaagcacaaaatcattaaaatgtccttttcaattccatggcaaattcctaaagcaatactctctctccattctataatgtaggttgcacactcatttcaagattcaactttcaaaacatttgactaacgatttgtataatataaattgaattttatttgatagaaataatattattggattgatatttcaatatactttcatatggttataattttgttactacaaactttatagtatattagaaattataaataaaaaattagttttgtagaccgtacatgccaagtttgaccataccatattatgaaaaagagggagtagtaaccttgtttatatttgcaatatatactccctccgtttctaaatatctgacgctgttgactttttaaacatgtttgaccgttcgtcttattaaaaaataagtaattattaattcttttcctatcatttgatttattgttaaatatatttttatgcagacatatagttttacatatttcataaaagtttttgaataagaagaatgatcgtcaaatatttagaaacgaggggagtatattgctagtaaattttactgtaaagtcatgtttcttcatgtgtcttttttagaacatttcttcttcatgtgttccaatcaattttttcgatctccaccaccactaccacagttgtatgtgtagtagctagctgttgcacatgctcatgttaatctgaatctgtccatggttttttgcagggcaagaggtgatgtgctacgagagcccaaggccaaccatggggatccaccggctggtgttcgtgctgttccagcagctggggcgtcagacagtgtacgcgcccgggtggcgtcagaacttcaacaccaaggacttcgccgagctctacaacctcggctcgccggtcgccgccgtctacttcaactgccagcgcgaggcaggctccggcggcaggagggtctacccctagctaacgatgatcccgatcgatctgctgcatgctcactatcatcatccagcatgctatacattgcaggttcagacaattgaaatgattctcgacacacaacatatatatgatggtgtaattaattatgcaattaaatagctgagcaaggctaaggtctctcatgaagctagctttgctctatatatatatatatatatatatagtgaagtgtgcaataagctgcaagtatataagactggatttaaggagctaattaactaaaccatgcatcatgtatatgtgagatgcagtcgtgctcttgcatccaaggatacatacagcatatgcatgcaatattggtatcatatgcagcggctgctagctactcctagatcaagctatacagcagaatgtaaacatatatgtgtagcagtacttatacgtagcacatcgatctgcacatgttggatgtagcaagaaattgctatgaaatataagtagagatgtgcttaatatcaaatgtgtatcacatgtgaatctatcagctgggcatatatagtgtctctttcaggcttccatctcactgtctatctcgccccccactgaatatgcccagtttaaggacaggtactacgtgctgatgatatgatatgatggtgaaagggactacagctagggagtatcaatcagaacccatgttttggaaaagctgatacggatcgatattgatcatatgcatgcgtagaagaattcatcgtcagaaaacgcgtacgattggtcgtatgtgaaagaagcatatatatctagatctgtaactttaaaatccactctcctatgatcgatcgagcatccattggtgagttatatgttcaaaagcatcgatcgagatcgtcacgattggtagtgggtgatcgatgcagctatactagctccttttctctcccaatcgtcgaagattcaggcattcagccaatgctgttgcagggatataattgtctctgttattttttattctgacattgtatacatcgatagtagtcgtcaatacacacatgttttatcattatatttcaaaacaatatattttacaaaaatatttaaaatactatagatctatagtctatat

SEQ ID NO: 492 - DNA, 7371 bp, Oryza sativa
agcaatacaaagccacaaggtagttcatttttcttgggctgtggagaccagttaatctattactccctttggttctatattaattaatgttttagacaaggttaaggttaaacttttataactttgaccatcaataactttaaaaatatttagtttaaagaaactagaaaaacatatatagatttgtctttcaaaacactgtaataaaagtaaacatgtatttatttattgtatatattataatagaaaaataagatccaaggtatatcttgtagagcgtgtcattgtccaaagcgtcaattaaaatgaaaccggagggagtatcttaaaaaaaaaaagtctagcctttttctacggtcttgttgtccgctccttctattgttgcaacacgaactctcttaaaaaaaagaaaaaaaaatctttcaacaccaacaaacaaacgctggtactcccagtacgtgtattgtactactaggtagtactcggtgccaaacagtttggcggctatacggagttgagtagtacaaacagaaatactcgtatcgtatcggaatttctaaaaagaaaaaaataaaataaaagaaaaacctgtactggcaggtgggccccacccgcccgcttcgacgaccacacgtgggctcgccacgtgtcatccggcgtctcgtttccttgtacccgacacccccctacgttgtggaaaaagaaaaacccatccctcacgcgagcccaccgcacccgcagtcacagacaagcgggccccatccgacccaccgaccaatcccgagcgcgagcccgcgggtgcacgggttcgcgcgcgccgcgtggcccgtgggccccaccgggccagggccgcggtaacgacctctctcctgatccgacggccgggatccctccacgccgccccgaaaccgcctcggccaatcggaaatcgacaacgaggcactcgaaaccgccctggtatggccacaccgcattccacccccatctaaaaccgccttccctccccctccctctctcttcctccccccatttccatcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccaggtacgcacgcgcttagctcctcctcctcctcctcctcctctccgcgacctcccgcctacctacgtagtacggcccatgcccgtcgcctttcctcgccgcgcgcgcgccatgggcgagctcgcggagctccccgttcctgggcggcttgttgatgcgttcgatttcgtttcgtacgggttcctgccttgtgttcgatcgtttccgctgcggaatgcgagggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtattcctatactctattatttcataatatttggcaattttgaccggtgattgcttcagtttaaccattaatatcttttaaaatttatgattatgatggatgggatttatatctctatatttaccattaccatgtaacatactttaataatatgttacataatctaatactaaaagtttatttataaaattggaatggccaaactaaaacaatgcgaacttaaaatcaccaagtattatgaaatggagggagcataatatcagtagctcgtaagggaaaaaagggacctaaatgatgccttttgtgataaatataatttcaaatttgcaaaatttttggataggcaacaatactctctcattattgtgttagtattaaggtcaagctacttctatgctaccaaatactccttctgttcctttttttatttcttgtctaggatattgacattatccctaacacacatctttctttgtatgatcatctactcataaaatagttaaaatataactacattattcaattatgaatctatgaatgttatttttatacaccgagttgggaactattctaaactctcgaggggacatcccctcattatctgcatgttatccaaacggttgtgaaaaaaattgaaaaaaaataaacaagatagattaatatgtgataaatcactccacaaacatgcaaggacaaattcaaattctacaagttgcaatgaaaaaattaaatttgaccgtgaatatacattaactagccatagtttaatttttttttgttgtaacttgtagaagttgaatttgaacttgcatgtttgtgaagtaatctatcacatattaatctatcttgtcgatttttttttaaaaaaatcataaccatttagatgacatgcaaaaaacgaggggatgttcccttgagagtttagaatccattctccagtgagttgatgttgagatttgattacacatttcaaaacgacttttatttgttaacgaagggagtaatgtggattcaccatatgtactaatgttattaaggccagataatcctttttttaatcattctaattagatataaacttacgacgaagaacatgaatggataaagtttcagccaacaaatacaaatgtttttcaaagtgctatttctgatgcataatttttgtagcagttatgatttaaatttatacatggataatttgaataatggatcctacttttgtagttgtcacctgacaagccttaagaattattgagggtacaaaaattataactgtgcatttgtttgatattgctctaagactatgcttggcatcatcttttgatgcattggtcaaaccaaagcataatcatgtgatacttcttctgtagtatggaagggatccttgaacgctaccagcgttactcgtttgatgaaagagccgtactggagccaaatactgaggaccaggtaaaaaaacatccctgactgttggagaactatctccggctgtttatttaactagctggttagttatctgatcttgatattcattttctcctaggaaaactggggtgatgaatatggaattttgaagtccaaactggatgcacttcagaagagccaaaggtactgcaaactttcttaagaaattttcactttggtaacaagattatgctaacttgagttggtctatctactgctcaaggcaactcttaggtgaacaattggacacactaacaataaaagaactccagcaattggaacatcaactggaatattctctgaagcatataagatcaaaaaaggtgaaatttgtgtccattatgcactgttgactgagggatcaaatttgcttgatttaattatttccaactaatctttgaaaacatcattactttcctttttgtttttcttttgcagaatcagcttctgtttgaatcaatttctgagcttcagaagaaggtaggttaccctcaatgtggctccttaaatagcaatgtagcagtctgtttataccatattgttttggagtattaaagttgcattcaaacaattttcagacaactaactcttcttgccttctaccagaatatattcatgtaaaacatgtcttttggcaattctagaaattccattataagaagaaatcattagtcaatttgaatcacctaaggaactaacgagaagccacttgtcttggtcatattgtgggaaatgcacaatgttgtcaaatgggtataacaggaaagtcgccatcaatgtatatattctaggggagagagaacagactaagtcagactacgttgtaaaattgaacattctacgggaaaataaatcttcgatgcatatggcaaggacttgaccgttagccttttacgcaataatgtatgcataaacatagggaaaaaaaaggacctgcactactgattgttactgtatctgatctggcaagtggcaacagagccatgttaatattgtgctgagaaatggacgaagttgatataggttcgtgctgatgaatattcttacaatctgctatcttcctgtctgcaggaaaagtcacttaaaaaccagaataatgttctgcaaaaggtaaatttcattcttgtttacaacaatgttttatatcagatcactacaaaagctgtattggaggtcaaacccttttgtctacattcttcggagcagctcatggagacagaaaaggagaaaaacaatgctataataaacactaaccgggaggagcaaaatggagcaacaccaagcacatcatcaccaacaccagtgacggctccagatcccatcccgacaacaaataacaggtaccgcttttacttccatatattttgcccctgcactcaccataaataaaacaaaactctgttttgttcttcagcaaatttttattctatattttttcttttatcagacttccattatctatcacagttcagtagtttttgatggtctatgcctaggaaacttaatccggtgaaatttgttcaatcaaatgctgccggtctatttcatatggctattggaagtttggaacaaataagcccaggcctgaaagcgcctgaaccaaacagtgaaaaagcctccaaatggtttggtctcagcttgatatatcatgtctgaacaataacttgacgttaggaatgatctagcatgttactactatttcatcaactccattgtctgttttagttatgctgtttttcctcatcttaattcagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctctgatcgatgagtagtccttggtccgagattgtagagccgtgtatgtttcctctcgtcgttgtgctctgtatgcaatcgacggagatgtggtttaacttgtctcacctgctgtgatttcctttcatctgttcttcagatgtaagaaaacgaacagcgccaccgccttttcaaggattaaaagagtaggattcagaactttttttttagagaggagaatcaaaacgcttcctggttatctgaaatctgatgtcagatgccttaaacccttgactgaaagggaagtggttatctgaaatctgatgtcagatgccttaaacccttaactgaaagggaagaggtttgtcagctctgtttcaaactgtatcactgtcatcttgtccgaatctcaaggaaaaaaaatctcttctcatatactccatcttaaaaaaaactcaatttctgaagtttaaattttgtcaaaaaaaatcaacttctactgtcctgcctattttcagcacgtaaaacgagaagttttatcccttaaataccgtttacatatctatcatcattactatttttttttaaataataagggacattttagttgtctttactcctcactaaatttgcattgggatgctaagaatgctctttttatgggacggagggagtattgttccatagcaggttaatgctaaggctgagttcccgaggtggagttcattaacgcacggaaacaatgttgtttattaacacgtgattgatcaaatattagccaaaaaaacttaaaattttaattaatatgaatttttaaaacaactttgatatagaaactttttttagaaaaatactttttagcaatttaaatagcgtacgtcgcggaaaaagaaggatgtgagtcgggaagagcacagtactagtattcgatcttttctgaatgacagattttacatattttcctctgaacaaatggctttactttgtactccctctgttccattttaagtgcggtcatgattttccgtgcatgattttgaccgttcgtcttatttaatttttttaaaaaataaaaacataagtcacatgtaaagtaatattcatgttttattatctcataacaacaaaatactaattattaaaaaaatttaaataagacggacaattaaag

SEQ ID NO: 493 - DNA, 8383 bp, Oryza sativa
gaaaagttgtaagggtctgtatggggattttctgaccgctgtatcttctctcaaaatcatattaatcctctctacatagtctagtttttcatccaaattctcaaaagctctaattatagaatctaaaaaattaactagaaaacagaagctgagaaatccacattctccatattctcagaagcttgatactaactagctatttcccaaaatcttaggccttatttagttggggaaaatttttgggtttgtttgtcacattggatatacggacacacattagtattaaatgtggtacaataacaaaacaaattacagattccgtcaaaaaactgcaagacaaatttattgagctcaattaatccgtcattagcaaatgtttactgcagcaccacattgtcaaatcaggcgcaattagacttaaaagattcgtctcgtaatttacacgcaaattgtgtaactggttttttttccacatttaatactccatgcatgtatttaaatattcgatgtgatgggtgaaaattgtttattttggaaactaaacaaagccttaagctctcccaacagatcacccaccggctcctagtggacacaagaagggtatttttcccgaaacccgaaaactccgaggtttcaagtgcaaaagcgcccaactctactcacttttccccagcttttccgcgcttaatttctcgacctgtcgaatcctcagtcgccaccgctgcgtcgacgaggagagagagagagagagagagagagagagaaaatccaaagcaatcagtgagagacgcattgaattgggtcggagattagtgcgaaattaacctagatagctttgcctttgcgtacgatggatcgatcgaggccgcctagggttccgcgtcgttccaccaccttgccggaaatggcaatgccgggtagcccccaccgccgctgcccaccctctcccccttccctttttaaacccctcatccccttccccctcctcctcctcctcctcgccttagctttcccctctctttcgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaaggtatatatacatggacgcactgggcgcgcgcctcgatctgctatagctagatcggtagctgcttgcaacgtagctagctagggtttcttgcgcgcgcctgcgcctccagatctggagcgcacgatggttttgtgaacttcttggtggcgattttgcggggatctggggctgcacatggtggatctgcgagtgtgctcgtgttttggtgagttttgggagggtttgggagaaggaagttggtggaattctgtgggaataattagggtttttgttcgttcgatcgggtgctagctagcgtaatagggagtggtgaaatacgtagatctgagggtttctgatcccgtggtagtagtggttttgagatggcgcgcttaatggttttgagtttggtttaattgcgattaatttatgtgcatgcatgggatgggacattcaggatttaagcctggatcagcaagtcgatttttacggagaaaattaatcgttggaagcttcgaatcttaattttatcgatctcctaatggagggtatgcgagtttcgaattcccttgggatctgtttttttcctcaatttttagttttttgaggggcaattttttttagggtatatatgattttttttttttggggggggggggtgtgtgaagggatcatgcatatcattagccatgtaccggatgtgtgtctaaacaaacgttcactgcatgaattccacggtttggaggcagcataccttacaagatttgggggtttcacttaagattttgtctctttgtttttttaagggatggccgcgggggagtattgtttttcaagtgagttatggttgcatcattaaaggcaacatcaataaatataaagtctgtttctcctgagataagtatatgaaaaatcatatactactatatatataattgtctttcagaaacacagagcgtctgattggctaggcataattcacaagccgcatataagctagttgaattgattttgaattagaaaacattttttttcggggggaagaaaacatttggtattgtgtttagagataaacaattagttagggtagataagtcaggcattcatgagcttcatttcatatttgaatcatacattttccaaactttagaaggttaaattttcttgctcattgtattgcactgatcattttaataatatcttctatagtgaatattacatcattatatattttagataatgattacattattatatgctccgttgcagaaaaaaccaacttttttgccaaacctggacatatataggctatgtccagatttatagctagaagttagggcctcatcttttaccctatgaattataagccaatatcaaattttgaatttcgaaacttgatttagaagttgatttttaatgttttgtcaatgtagattgtttttcagcattaacttttaattcgctaaagacacatatacaattttactcacaaattatattttggttgctaataagccgttatggcttataatcagccgtaagtatatggggactttagcattctttttctttttttatggagggagtacatgcttgccaatttttatagttatgtttaaatggtttccattatacctaagttactaaattaaaattaatacgcctataaaattctaacattaaatatattcacaaataagagtacatgatttcattgaccagggaattcaatttggatatggggtgagtgaaacatccctcctctgctcctcggaagaaatcctgcaagggagtacacaatattcctaggactcacttgagtatctgcagggtacagttagtgacagctttcgattgtcattcgattggtctcctcagctctcgtagctgagctgtcagtacagaagattggtcttcatcagatgtctcttctagttctagctagagctagttcagtggagtattttatgccgacaaattgatactcaacgtgtactgtagatccttttcagaaatctgaattcacgacttgtttaaacaaaggctgtgtttggatccaaacttcagtccttttccattacatcaacctgtcatatacacacaacattttagtcatatcatctccaatttcaaccaaaatctaaactttgcgttgaactaaacacagccaaaaggtcactaaattgacgcggtagaggggggggggtgagcattatagctgtagtagtagtctgcgtgaagttatgccatttcattgtgtgtcgtctgaacttgatatctctctttaaagagtgtactccattttctttacaaaaagtggcctctaggttgatatcatggacatatataaaattataaatcaacttgaaactaccgatgcaagaattaagataaaacgttattgtttcttagaaattgtctccaattatgcaagcaccttcatccgtgtcatggagctaatgttcatgttttgtgagaaacaagatttttcatctactaattaatcgatgtggtccccggaaaagaatgtgccctagattgttagtatttagttatgggcgaactatatatgttcctttatttcgtttttccataaacatagccatttgtgtttttgaaacttgcagcatgaccagaactttggaaagataccaaaaattcagttatggtgggccagatactgcaatacagaacaaggaaaatgaggttactagattctattaatatattttaatttttagtgagttatgacaagcttttatggatttaagttgatgcatagactagctttgtgttctgattaatcgatctgtgtctcactggataatacttcaacaattcgattcatgcagtttaattgattgatcctagatatgctgcttttagtattatcattaattaccaactatatacacgtgttgaatagtacaattaaaaatgaagtcttaatttaatatattcgctgtgcttcttaatgtatgtgatgttgctacaagactcaaaatttaatgaaaaatgagagcactgcaaaaggttgcatatgaaagagtgctataactagaatgagtattgttgttgtgtttccacatgtaataacactgatttacaactctaatttgtgctagctgaaatgtctagtatgtagatctgaatataaaacagaaaagctcctagtcactggttattgaccatgatatgatagatggattcatgaattaatatcactgttttctaataaattgttcattcataagcctaattttgcatgtgaaattatattattttgttttcacatagaatctctaaattgtttcctatttctttgtactgaagttaaatttatttttcagttagtgcaaagcagccgcaatgagtacctcaaactgaaggcacgggtggaaaatttacagaggacccaaaggtaatatcaggcttccacttatgagttcaattttatcaaagacgaaatggagcacagttaattggtttcattcatatatatgcaaagtagataaattattgtgtattggggcaagaacaattatgtgtacactagatactttttggccatttgggtgaaaaaaaaaactatattgcatggaaaaaacacatatgactagtgttaacaagagtgaagtaatatatgtgaaccaatgaaggtcctaccgccgtctctattatatagggtttacaagtggtaaaacagtaatctcagggagaactagcttagagaattagatgcgtgcagtagtatatactgaagttgcttagagaattagatgcatgcatcaatcacagtgtaaaatatacagaactaaggccccgtttagattccaacttttttttcaaacttttaactttttcgtcacatcgaattttcctacacacacaaacttccaacttttttgttcacatcgttccaatttcttcaaactttcaattttagtgtggaactaaatacagcctaacttagtagatctttctgttgacaattacaggaatcttcttggtgaagatcttgggacacttggcataaaagagctagagcagcttgagaaacaacttgattcatccttgaggcacattagatccacaagggtaatttgttaactgtttctcacatatgtttcagaaatgttgaaaaaaatttaactctaatcttgttgcagacacagcatatgcttgatcagctcactgatctccagaggagggtacaagcttgacataaaacttaccaactatgtatttcaggcaagaaaatttattatttccaaaactaactttatatacctaaatcattttcaggaacaaatgttgtgtgaagcaaataagtgcctcagaagaaaagtaagtttaattccttgtcccgtttaagtttcatgcatttacttgatcttaagattctgcatgaactaagtatgtggttttaaaagtaatttatacacttcacttttatgtgtgcttgttcaaaatcaaagccccgcatccatgtagtactaaatttaatctgatcaggaattcaatgtgtagatgttaacatcagtgtttagttagcactttatatattccttccacataaacttacaaacatgtgaacatataaaatatggtttgtaagggcgtataacagaaactggacaagtttgtgtacgttgatgcatattagtttgtaggatgaattgtatatattacaaaagaacatttggtattggttatttctacataacgaatacgtacatgaagcttcgtagacagcatattacttcaactgcgcatattaattaacataaggatctctcacacgtaagcaatgcatattaacaattgatcaagacgaggtcacactgttttcggttgcgatttaggcatttaggtccgttttcctggcatctcttcctcggatatatatatatctcctggctaacgcctgcttacgtagctctgtgaaataaccaaaatgatgctgtgaaatgaaaaaaaaaaacacaagtgagaaaagaataacgagcactactaatgtttgattcgtttgcgaggaaaagctggaggagagcaaccagttgcatggacaagtgtgggagcacggcgccaccctactcggctacgagcggcagtcgcctcatgccgtccagcaggtgccaccgcacggtggcaacggattcttccattccctggaagctgccgccgagcccaccttgcagatcgggtataaaatgcatgttactcatttcagcttcatgatcgtttctctgatctcattagttcttgaaaccaattgtgtatccagtttaattttttcattattacgggaaaagcttgcacgtacacatatataccactacacacgcgcgtacacccactcacgcatacatccgtgagtaagcttttttaacacatgcttaagagatatgaatggtgtttttctagccttactagattactaaggaggtccactcaatcgtgcgtatctattttattctgtgctaaaaaaaggtatggaatgctctctacacatgaacttgggccgagtttagttccaaaatttttcttcaaactttcaacttttctatcacattaaaacttttctacacatataaactttcaacttttctgtcacatcgttccaatttcaaccaaacttctaattttggcgtgaactaaacacacccttaacacaatttgattctcttcgtaggtttactccagagcagatgaacaactcatgcgtgactgccttcatgccgacatggctaccctgaactcctgaaggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattaccatgctcatgtgcattctaggttctttatatataggagtattaggttaactgattagttgttgtacatcattgtctaaaaaaatagctgtcgttgtacataaattgagcatgctggtctgcatgaaaattaaggaaaagaaacatgcaagtagcccaggtagttgggctgtcaagcagtcgtacttgtccgagtcgcagatagttagttgacccgaaactgtgattgcgaacgtacgagcgaaaatgtagatgcaggcatttcaacttgagtgatttgctttttattcatatatatggttcattttttttaaagatggcttcgactggatctcgtcttcgttaagcatgcgtccaggaccaggagtacatgcattttgcattcagccctaaccaatactttttaccaattaaagagcagagcaggcacgacacgcatagacaacggacatggatcttcgcagtactacatttgcagtagcagtggctgataggtgaacccgatcctacatgtcagtggctgctactgtagacaatctccactgatagacaacgggtacaactcgtagtattaattcaaacgccaaatgcattaatggtagtttgcttattagtactagtttgcataacgaagcgtgtatatatatttatacttcctccgttttatgttttaatttggacttgtcgttccagaaaatcgtacgaagtcatagcaaattacattgcaattcttcttaattacatattaatcatgttttcaaagtaagaattagaattccttataagagactactactagcatggttgtgttagagaaaggtaagaagaaaaaagcatttaaaaagtgatttggaatatgagaatgacaagtgttttggcataacttttaaatggtagaacgacaagtaatttaaaacatacaaagtactagtcccttcatttcatattataattcgcttcgactttttctaagtcaaacattgttaaatttgactaggttttat

SEQ ID NO: 494 - DNA, 32441 bp, Oryza sativa
aatcccagtgaaaaaagcctaaggaagtgagctatgctcatgctgcttttactactactccatccgtcccataatataagggattttgagtttttgcttgcaacgtttgaccactcgtcttattcaaaaatttttgaaattattatttattttatttgtgacttactttattatctacagtactttaagcacaacttttcgttttttatatttgcaaaaaaaatttaaataagacgagtggtcaaacgttgcaagcaaaaacttaaaatcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatgggggggggggggggggcggaagcggaaccaactttttcgccggatgggaaatttcggcctcgctttccttgtttgttcggcccggatgcattaccacttctgcccctgggtgcggtggccatgatgacgataaaaaacggaaacgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccaggtacgcaccccccctcccccctcctcctcctgcccaatctgctcttcttcttgtccccatcccccaatcttctcttgttttgttgcttagtggtggggaacgggggtctcatattagtttattactagtcttttcctgaaatccctaagaagaaaacctgcgaggaccgatggatcttctcgctgcctgtgccaaactcctgtagcaactgccccccgcccggcttgatggcccttcgtgatgcgtccgcagattttttcttgcaaatttttttgtgggtgtgatgaattactagtataacatctgcactatgcagatgccatgctgccctctctctctcctcccccaagaatctgcttatcttgattatttcttcgagctctttgcctctttcccccaaccgcacgtctccgcccgagagattctcgcctggattttgccgacgagtgcgtttctgatctccttcctccaatcctcatgcttgcttgctgcaatctgggctcaactttaaagtgtccactgccgtctggctataaggacagttgctactacatgtaggggattcactattatacccgataaatttaatgacgacggccaataggaaaattcggcctgaaaagacggcaaaaactatatttccccgtgtggcgattgaggtcagtctagaaatttgtcgagaacgaacgcacttaatgctttgtctgaacgaacgcacttaatgctttgtctgaagaaatatttcagaatccctagagcaagtttaatagcagagctcactgcttattataagtcaatgttggagctaacttgtataacaggttagctataaggttaactttattttttccattctctctctttctcactctatgaatttaatgcaaattttttggagcttgtgtggagctggctcttgtatgagagccaacactacccacttttttttatctctctcttttacataagcatatagcttgcttatagcccattactattcttgctcttactgtattttttgggggtccgggctgcttagacgtacggctagttaatcagtgatttgttttgcaatacatgttctttcttgggctacttgctgttgctatcatttgggctgacatgacgtgcagaaacaaaaccaatgcatgtgatagtgtactgctgctgtatgcacgcactgtggtggattttatttcctggccacgtactgtattaactagatagaattatcggttccacatctaggggtggtctattgcttcattagagagtactactatgttgtattcagtggtacataaccaccggttctttacatctcaccggctaatcttatcaatttccaattacacatgacttaattagtatacgctagttaactagtgtattagaaaagctatgctaagctactgaattgccaaacttcactttgctttgttcagttgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaacaacatgtagcttattgccaaaactgcatacatctaaaataataatggataaaagaaaaccatgaaattctatgtctctgatctttctcgtcgtctgaggtcattacctgaagataatatgtaatgcacccatgtgattgaatacaaggtaataataatatatacatgaacatagggtgggcactgactaatatgaattaaaccaagataatacttggggtggaacctgagaaccacgttattatttagatatggcagccgaccataataatccagaatggtagaatgaaacaaacatatttgcttaccctacgattgtctattagtcaatatggatatttgccataatagacataaataagttaatgtggttcattggtcttcttgaatagttagtacaactagcatgtattcaggtttgtgcagaaattaaaacaggacacacatattttatctgtcagttattgttttgagttaaccttactgaaatatatgtgtaaaattgtgtactgcaagattattttcagctgattttattgatgcatgttttgaattagaaaaggcagcattatctcctaaaatgtgtcgtataaataaatatgcattggatctgttttcaacaaaaacatagactatggcaattgtaggtgttgattgaaagcatgcaataacaaaattttcctgtcccttaggatagaaaaggctcctcttaccttgaatgcaatagagctctttgtcattatggtttctttgagaagaacttttgggttgttggtttcaattctctaatggaattagtaagattattgtgtgatcataatttggagtaacatttcccattacccctatgtacgcaataccctttcgtttgttacatattcccttaacttgcttacttatcataatgccacttgttagtttccctttataacaattgtcatagaatagttctttgtcgcatactccatagagcaacaaataacaattttagttagtttgaataaaaattctgtatttaaatttcaagatttcatacctataggtgtatgtatcttttggcatgtttgcaaccttttattttggatatagacattttagtttttagcatatacatcaaaggatgttatagcttccttatccaaactaatagaataaaccaaagaatctatgatagagaagacattacatttggatcgctagcttatatttcttttatcatgcatagcaaagagaagcaaataaaattatttggatgcaaagtctgctaaatgacgatatgcgtgtgtgagttcgtcattgtttctacgttttcttgctcttgtgggtgtaggcccaatttggttctctaccagcgcaaggtctttgatgtcattattagccttttcttttctagcggagcgagaatcttctagcattaccaaatggcatgcctttcccatcaaggataggatttttcctttctagatatccaagcgtaccctacattatctcacccaatgatacttctctatcattgattattcttacttaaatttcaaaggattgtaataaactttcgttttgtgcatgaaccttcatactaaaagggtaaataacacatagtttgttaatattaattttatagataatatataatgtttggggctttgcataacatttgggtataacatgatatcatctgataaaagttggtaaccaaaagaatatatcagcatgcatgctttcagcataaaaaaggaacgcatgagtttcgtaccaaatttagtgaaccgttacatgtagagaaatgtggtctcaaactcaacttcaagatcataaacagtgcacgtatcacttaaaaaaatgagagacaaaacattaaaaaaattatgaacacaagttacaatatattatcttgaaataccatctcatttagaggatgagttccttaactcaatatccaagtcttcatgatcatttgttgatgaggattgagaccacacttccttctcttttcctaattggatcaggaatatgccccaaatctgaaaaaaaaaatcattgaaaaaaatcaccgatatgccaatacatcattggtaaagtctataaatttatcaacaaattttcaacgccatgatattactaatacacgttgacattgggcctttgttgatgctatgttccacatcaccaatctattgctgatatatacaagcttggaaatgataatgaccaagccatatagtatcctcttcctaagagagtatctaatataagatacgacatcaccttactttttggtacttataatcatacattgatgtgtcaagtatttagatactagtgatatgcacttttggatatattcatttaaactatatccacattttcaccatgaatcatacaagatttagcataaggttcattttggctgaaaattataacttaattctaaagtttttagagaacctaacataattgtggacatcatcatggtcttgtgactttgattcaagttggttgggtgatgcacatcaattgatatctatgatagtcttatagtattagaaaaagtcatgttcatcctagacatttgcatcatgctccaatgtatttttaggtgttcagtcaaagatcatgaaaagatagaacaaacacatatggtggcttccatggatgcccctatgctacttttagtattagaaggaaaaatatttctggggccttttgaggtgtagatgatttggtaattccaatattaaaaaaaaattaaatagttgtatccaagctaattcaacattcataaataagaacatggaaaaactagagttggggcaaatccatcttgtacctcattttgtgccattgccatacaatattcccgcggaaaacgtgtgtagtttcatctagttttatttagattgggagaacgaagtactacaaagacaacatcaagtctgatgtcgatatatctaagctagcgttgctactttgacaaataatgagctaggcactagtttgaaactgccaggcactattgccatatgttggtgattggtcccactagccttgtcacatgcaaagtccacgaatcctcgttttcgctccgtgctacctctggtgaacgacacatcccctaaaagacgagcatttatctctttctagagaaaccaagaatagtgtatcgttgcgttatccagaacctatcgccctattttatccaaatgataatgttggctagtgccattgcaccattactctagcatgatctagcctcctaaacacggagcaagatggtcagtaatcctttaaaaaaatctcggaccacatataaatgtaatagttatagctaccactctttgatgttcgaaaggaaaaattcaacactttataaagttcaatacctactttacgtacataaaataattaacactatcttttgtatggtaggtatttcattctttttcaatgaattgcttttggatttctcatctaaccattactctttaatggccacacaagaaacttgtcacaccctgccctttcaccacctagcagtgacacctgagagggtacgccgtaggaaatcaacgcaagctgactcccctggaaccacgataacggtactagtctcaggatacaattgctggtaccgcggtcaatcgagatgcaccatgtcaactaaacgcggtacatatatattatacctttaagagttcacactttcggagcaacttctggagtgtaataggcaatcagggtagcaacagcgaaaccttgtgtaggtagacccaatccacaaacaacggtttgggatttgtaaggaaaccctaaccatcaagttcacttctcttctcgagaaggaaaaaacggcggttgagtacatacgtactcagtaagtcatgggtaactgagaatgcaggctggaaaggagggttgggtttgtttcgcaaattttgaaaacatttttccaaaacactaagtgtggcattgtttaccaagtggtcggaaagaagcatatgccttgatcttgtccgcgaattgctttgcaacaactcaagcggacaaaacaaatattagttggttaaaattattctgccggttgaccttatcatgacattggtggaacaccatcagccctcaggcagcttccaactccttatcatgacattagacaaatattagttccttttcactttcaaaccatcaaacgttagcccatctcatcaactcatctctttgggtcctaaagccttccatagtctccaacacacaatgctttccttcgggaaacctaatatatgacgctaattgacatcctgatctacacaagattgtttcagaccacgtaatggtcctccatcagtcaccacgactgattctggtaatgatttccaaacccacaaaccactttcgcaaagcataggcaaacaaatctacgtgagaggaatcgccacacattcgcccattaccatttgtaagactcttcgaattagtagacctttacagaggttgtaaacttcacccacaagatgcgatcttactccttcactggccaagctgggaaggtttgtgacaaggcctttccaaatccaactaggggtacctcatgtcacatagaaggattctctttgaactgagcatcagggaaacttcggccctcgtctactaaagaatacgggatgccgctactcaatcgtgcataacacgttaaactttgttttgtgcctagcgcaacaaatcaactcacatctcctcatccggggcattccccaactattggaaacaaggcatacttggccaactatttacttagccagaggtgccccataccacccatatagtcgcactatgagaagctcggataaaattaccaaggaataagtccttatatgcaaaatataaaccaccgcgtgtcagtttttaaaaggattcacaacatatttttccacatcaacaaacaagggtgatgtgagctcatgagcacggtttaccgaggtaccacggggtggagcgacaagggattgggggtcatcagcgtcctattggagtaatgcaactactgggtaggtctgttggttcgtcgtgcgaactgagaccagtcaaatttaacgtgctcactagcaatacaattcgcaaacaaaacatttctaaaacaaggagcaatatgatgaaaaagtgccttgccactgtcttcgtcttcgaagtcttaaaaaatcttcgtccgaaataaattttgtcgtcgtcgactacgtgcatcaaagagaaaaataaacaaaatcctaaaataaaataccattgttaataattataagtgtcatttggtagatttcaatcttagaaaaaaaaatggagacttgaatgggatcgatcggagttacgaatagggatatatgattttttgaacatttaaatgattttctggaaatagaaaaggaattatttgaaatttggaaaagaatattctttggatcacaagtagggatgcaagcgggctgaccggtgaacctacttatctgtcaaataagtagtaacccacgggttcacgcattgtggtccggtttgtcgcacctagagatacaagtggattgatccataaacccatatatagatcaaattaataggtaacccgcgggtcaatccgcgggttatccactaattttgcttataagcgggttcatgggttggcccgcttgcatccctaatcacaagtgggtccacaagtcattgagtgggtgaagaaggagataaactggatttttttaaggaaactgggggcacggacttggtctttagcccaaagaggaagaagggtgacgagggtcataaggacttggaaatgcagtgggttgaagtcgacctatgcacacgtgtcctaggtggtgagaggctggcgagtgggagtgtaggggtggtggcccgcagcggccgacgtggtaggccatgcaggctttgaccaaggaaggaggagactagctagaaatatcgatgacaggtggcactcactagcgcatcactaatttacggtggtttcaagccgacggagaccattggcacattgagtgggcaggtgaagaagggtgaatggctcggatggggtagatgatgcatgataggggctagtagcgtggagccaagtgtggcggcgagcggccctcgctgtgcggcgaccaatagagcggtgacttgggtgtgtgatggttcgggtgaggtgtgactcttcaccaattgaagatagaggggagaaagagggctcatcagaggagaagaggagaatggtggcgacaaaacatcgacggatgagatttggggaaaatagctccatcgatgaatagggctcgggggatggctggagcgtggtcgcttagtggtgatgagtgtggtggtggcgttgagttggttgttttgaggttggtggtggtggaaccgcagtgggcagagtgatagcgactgacatggagcggcatcgtgaaaaggtaatggtgtcggtttaggggctcgatatggagggatggacgcgcgtaagacgttgagcgggaaggatggaaaagaaaagaatcgagagaagagagggaaggaaagggatcataaaagagagtaagatgggaggagagagtgggcttgacaggtggttctgtggggagcacggtcgctaacatatggacccgcgcgagaggtggtgcatgcatgcatgttgggcgtgtgccgacggccttgcgtgagttaaggagaggggatcgggccgttgctgatctgggttgaggggagagagaggaggctagtgttgggctaggcttgtggtgcgcgggagacttgaggaagagggaaggggaggagggagaggaaatttttagggaagcttttgaaaatttctagggaagctttctagaccatgtgcatagtaacaagtgaaaatttctagggaagcttttgaaaggctatttgaggatttcgagttcggatttgaatacaaatttgatatttgaactcaacaaattaaggggattcgaaggaaaggaactcaaggaatttgttagaatttgataatgagaaattcaagaggatttgaaatacagaaagtaattttggatcggggtttttgtggtcgagggagagattcaattgagacctttggcacctatgtccttaatcacacacaatatttcactaatgtggtaatgggcaattgcatccattcccccactttcaatcccaactgttgttttacccccactttttagggtttgcaaatttgcccccacttttttgaaaacaaacctgacggttgccctcacttttgacggtgttagttccaggggcgaaaggacatttatatctttagtggttgttgcatttttgccccctttttttcatcgtgtgattttaccctattatgtaatgatataagattgtgataaataattcaaatatgagcacatctcgtgtgatgtttttgtactttaacaaaaaaaatgacaaatactagtcaagtatagaatttgaacataattctagcagcatttcaacagaatttcgacacaaatagcacaagtaacatatatatagcaaacattacaaattgtccaacacaaataagccacaatacatagatgtcatagaccacaaacattacttagtgttacatagtcataacaacacacattacatgtgcacaacatagaaggcacaataccacatattacaagtccagatcatattgcaagtccatattagcacaaaagtgcacaaaattatttaaaaggggcatatagatgtccaaatcatgcaaaccatgaagctagcctccctcctcttcattgccttccccttccacctgcatcgccactgccacttccccttccacctacatcgccactgtcacttaccctttcccttgcacttgcacttgatggttaagagagatcaacaataacaaaataagcataagcaaaatctgaaataagcaaaaattgaagataaatataaggaaagagcaatacatgactcactttgatgtgcaacacttggttcgttgttcccctctctactgttccaatttctaaagatgagtgcctcctcttttgacttgctgtgggacctccttggcaagtcttggccgtgtggcctagctcattacattcagtgcattattttctcttactagtgccagcctcatcacttgcctttatcctagccattcttggtctcccagggttccgtaacaatttaggcttcttgattttatatcctatatcaacatgtccatctatccttcaatgtcactggactgaaagtccctacatatgccttcttgaacttctcaatggagaaccagtcatccacaaaatcatcgatatggacatccctactaagcttcgcaatgaaagctaaagcatgaccgaaaggctttccagtcacttgccaaaccctacaggaacatgtttgttactctccaaatgtactgcatgcctaaaggtgcccacagttacttcagctgttccagcttcacatatcaataactcatgttcctggatattcttgcttttagcattcagagactttgtaatagctggaattattctttcctccatgttaccaacaatattccatcttacaacaaacttgtttgtgatgatctgtcttattgcatcatgcatgtccacaatccgtcgatccttggttgttgagacccaactattgaagcattcagaaagattattattgatgtaatctaccttgcactcttcagaaaatttggttatgctctaaatgtatgaatgattgttatccaaccaggaaagtgcatcggaacacttctcctctatctcactcatgaagctgttggtagccgctcacatattttgggcaaatagagggccatggaacttctttttcatgttcttccacaagtgcctcatgcattctctatgttccactcctggataaacatcatctacaacactctatattcctttgcctgcatctatactaatgaccaaacctacaataggactatagttcttggttattcagttgaaattgaatagatggagcatgcaagaaacaacttaaagaatagacaacttttggagtaccaatagctttgttcatgttctgaacaaaccaagtccaattttccttagattcggtctcaatcaccccatatgcactggaaaaagtcagttatgaccatcaattgcaacagctgatgccaactggcctctagaccttccagtcaagtgagtggagtatatatctatgtaacgcctacatcctttcaaaaacccattgatatagggtttgagagcaacagagaacctcgtgaagcagacatcaccattgcactctttactgtccaactcatctaagctgcttggcactgatcttaatagctcttcacgataggtaggcagaagatcgtagctgtcatcccactttccatttatcctctgaagaccctaaattataggatattaatatggtgcttgcagatcctttgctccccttgaggggttatcccgcaacaagtccaccactcgatcaactacccacttagttgaggccatcatttcaccatacttgttgaaagataaacaagtgtgctttggtccacttgtcttaacctacaaaaaaataatgaatagctttcaacttattgaaagtaccttgcatccaatgtacttgggggctgtagatgcaaaaaaaaggacactcgcaaccctattccgctcttttacaaatggctctaaacatttttcttgtctttcttgatggtttcaaaagcatgatcattcaagatagtatgatgggtaactgcgaacttgcattgatcccaatcagggaacaccacatcaacatcaatacaagcatcatgaacatgatatgcaaagacattacttgtctttcttgttggtttcaaaagcatgatcattcaagataatatgatgggtaactgctaacttgcattgatccaatcagggaacaccacatcaacatcaatacaaggatcatgaatatcatatgcatagataggtaaatcgtcgtcgtcgtcatcctcgtcaactatttcttgatcaggatcaaacttagggtcagagcaattagagtcagtagattcggccaaatctgaatcatagctactatcactatgtgccacaagtgattcagtgtcagagtatatgccctcatcatcaattcctaccgcatcgttatcatttgaaccctttttttttatttcttggctctcttttgtgtgtctctcatttgtggctccctaatttgtagcaatctcacttatccatgctctaggccttactgaaggatgacacctacattttgtgggtgaaaattgcaatggaccattgaaattattggcttgggcatcgacgcacacaacccccttatctacattgagtctaaaccactctagcatatgcttatgtgattttatctcaacaataccatcatctaaagaacgccgcaaaatcaagtactgtttagaaccccaaatgtagtgttcagctataaaattaacaacttgcaggagatcatagttatgcatatcaatattttgggttggcaaggttttacattggaggtttttctttggccctccatccggcaaactaaaaaacgacttaactctaacaactaattccaagcgcagttttcagtgaaaaattgaatggcacagccagcgacttgattgaaaatctaagaaagaaaggatgaaaaggaaagaaattggtagacgtgaataaaaaaattgaaaaaaatagtcttagcaatatattgggaaattgcgcggggaaaaagagtaattgatgttttcatgatatatcatgccccgttaaactttttcatgtaaaaacttatagttgagaaaaaaatgtcaaagaaaagagtacaacctacagatcaatactcaaaaataaaaaattagctactctattttttcctgatctaaatgaaggttttgaactgagtggccaattcctggttgtcagcagtgtattgtgtatgttctgcagctagctcctatccttttatgcttagtagtatttcttcgtcctcgttgctcaaacatgttcttcggtcctcaataatttgtccgtagaggtttgaaggccgatttggaggatatcgtagatacaggtaccatcaatacatctcgtgctagttttgaagaggatatgacatcctgtgattattccacaacctgtgtacattgaagtgcgacgattcatgtctgatggcgatgctatccaaatagttggacaactctatcgtcaacacttggttgaactaccattgccaccatggctggaagatgagcctccacaaattctgctacactatgatttttcttacctgttgcaagggcgggtgtgggtatttgcaatgtgactccctaaaactttaattcatacttttggaacacctaaaatgatttagtattaacatcagaataatagttggaataatcaacatatttagtttctccaataagtgaacaaagattgaggaatcgatgtatttccctctaggatcaagaataaatgcaaaagcatacaacatggggaggtttttccaatatttaagataattttgtttcacactaaagactgctggtcctataagttcatcactatcatactctttgaacaaagtggcaatttcaagaatcttatgcaaatttaaattagctgttggataatatactttagaagttcagataaaaagaaattgaaagaacctctcaacaacatactaagtatatgtctatcaatagcagttgcccatcacttgtcaaaacatcacgtgtttgaagaaaaataataagcaaatccttataatgtaatacactttaacattagataagtggcattccaccgatgttttgtactggtgataaacttacgtgcacgctcatccgatgccacacagtaccttttccattggtgcgatggttagaacgtgattgcttaacgaatggcctcaatgtgtacatttaataacttaaacccttttttaacaattagattaataatatggcatgcaaagtgttgatgcagaagaatttgtagatgcattatccaatgtcgtgccccatgtgtcgtgcagacactgcttgttgtgtccggccgtgacaatccgcaaagtagccgtgccatgtcgtgcaggcccatgggctatggcgtcggtccatccatggcatggtcggacgggctgtgtgttgatgagaaagcatggcggcctgggagatcaacttagcttcaatgcaggtccaaaatatttataagatgtgggtgtgccaactagttttatcctgcaactaacaagatgtataaattgaagatcaaagagccaattggccaataagccgatataccaatgctagccaatgtcgataccaacctatatctatagggttttgatcaatcagctatatgttcaatgtatattttgacacttgagtaaataatggtatatagacaatcaactgataatgtaattaaacaatgatataatccaatagaaaccaatcggtcaataatgatatgatagaataattgtttgatccaaaggttaagcatacaccggctggtgttctgatgtcagtgaaacctttgtagcaatcagctaaaaccaacttgtatttaatccttgtaaacttatcctgaaaagaccgagttcaaggaagaatcgtaaagaccacggcatgatagtttaattctatttattaattaggcaagatttagtaactttccttttaactttaggaagtatttatctagtgttcgattgttaacatcaaaattttgtaagccccgaagtcatcatcaatctagagtcagtatcggcttcagagtcctgaaatcgaccgatgcgaattatctggtggccaatagttggattcttggtagattcggttaaggaaattaatcgattaaaggaagtttatctagtggagaccgagttcaaggaggatgtggtatggcagtttatctattactccctccgggctgataatacttgtcgttttagacaagggtaaggtcaaactttagaatctttgattatgaatcatttttttagggaagattatgaattatttttaaaatatttgtctttcaaatatggtgactacatgtatagattagtcttaaaaagtactttaataaaatcatatatttgttaacacttttatacatattataatagaaaataatagttaaagttgtttttttggagatcgtgcccttgtccaaaacgacaagtattatcaacccggagggagtaattaggagagtttgttagtttttttttttatccttggtaaaatgtgtttattgtttgataagtatttttatgtttttcttttatctttaggaaagtttctttcttttccaagaaggattagtatctacccttaggtataaatatgtacacccgtagtcgttgtaaactatctcacagatcaatataactactctttctcgaggttttatttatcactggcgaaacttggcacctgacgcggggctgtatcgattttcggtcttcggcgaaggggtaagtcctacgtttcgccggtcatggcaattgtatcgactatattggtattgtccaaggttgcatcgctgcgatctcttggatcgctctggttcggatgatatattttcctacctatttatcatatatctctgttaatctagtttggcagcgcaatttccttgtatcggcttgagatctgcttcaggatttttgccgatattggctaaattgctttgtcagattagattagctaaggtatccaccgctcttaaaatcagtcaaaggctcgattgtttagactttatgtttctttgcatacttctagttgcgtcgaccttagtcgtgcttagaaccataaaaactaacctacctttgattgtcaacaagggtttcatcagggtttcagctgatgagttatctggacgttgtatcggcttataaggattacacacaagttggatttagccaattgcaacaaaggtttcactatttatctaatcgtttggattttatgatgtcggtccttcagccgatgtatgctttagccttcggatcaacatttgttttatcatatcattattagccgattggtttctattagattatattattattatataacattattatcagtggattgtctatatatcattatttactcaagtatcagaatatacatgggatatatagccgattgctcaaaaccccatcgacatcgactggtataagcatcggctagtatcggcatcagctggaactattccatcgacttcgatcggctatttgatctgttgtttgcatattttgtcagctgcaggatcaaactaactggcacgcccgcatcttatcaatttttggaccttcactagcgctaagcagatctcccaggctgttgctgttttcaacttagttcgtgctaacatagatctggcactatcggccgagcctgaatttttcgtcaatagaatcttaccaaattttggtgttaacacggtgctggcacgacctagtagctcgtgggcctatgccgagttagggcgggtactgtagcaacgtgcctggctcagcccgatagagcatgacccattttgccagctttaggtgggggtgagcttggggccctccctctggacaaaggtcaagacacaagcttagggtcttgccttgggtcatcggatgggatcaaagctcaggatacggtcatccctaccttggggttagaatccatggactggttgtgacaacagcaatgcattaactactgaacgtgacttgttggtactgtcatttgcaaggcaagctttgcattaaatgctaagtgacgcatatctacacggtgtgtgatgggagttacgtggtagcggttgtgcggctatcatgcgcaccatcatcacccctacgaatagagcaaggctttcagatggcatggttgactgtcttgccgcttagacggtctcagtgcatgtccacactttcttccaccttaggctgacagtcggatccagaaagcgtcaatagtgctctaggtaggacatgcggcaaagcgagaagttgtctttccaacgagcaccgagagggccacacaaggtcccgacgacctggtccacttgtcaacaagcgaccatatttcatatacctaatccctgtgcgctgccaggacctagccgttagagtttagccattgtggtattcctcgactaactgtatggcaaggtctaaggccaccgggttaggggatcgaaccttagagatctttcctcttagagatctttcctctgttagtctctgcatcgaagagcatgagaagaaccccacgatattatgctaagcgtggcttgaacctgtataaccgacttttcctcatatactcccgcaacaactcatgttctgcattcccttgggttgaactcacaaaggggcggtcaattgattccccgcttgagagctcattccgagtatcattttgggtcaataatgatgtcaccatcacatggttagaggatgttacaaacatatttatcaaacatgatacatttgatatgtatataggagccatcaacatcaaatatacatattaccgcaaacatatagttaggggtgaaaacggtatggaaatatcctgatcgcccgatactgtttctgagaaactaatataataataataataataataataataataataataataataataataataataataataataataataataataataataataataataataattgtaccgactactaccatttctaaaacgaagtttttccaatttctaccagcgttacattgaacttgacactgaatagttgaaaaaatatggaaatttcctgactgtttttgtctgttttcgtaaaaataataaaataatggtatcgtttccaaccgttttcccctacccttaattacaacatcctatatacacttttcctataaccatcggttgattttcggaacatcgagaatctcaatatacgtaactttatcccaatttctgttgtaaaaactattccttgagcccattatgtatatccaatctttatatttgagaagatttggttgggatggttgttcttgtaaggaattgaatatgtccacattaataaagaaaaacaaaagaagaattaaaaattaatatgatctagccatgaaactttagacattgtaaccatatttttacaaggccgacgtcgctgcaacacatacacgaccgatgtcatatattctggacaatcgtgggtgggaccaaaactttctgaaagtactcattgcacccgggtaacctgttgaattagcggctaggtccatttgacatgagggttgaatccgtctccagaaaatgttacattaccttcgatggcttgattgttatgcggcgccatgagagaagacttttttttctgccggggggggggggagaggggggggggccttcacatggtcccgtatcatcttcattaataatccattccttctatgctcatgcttgtctttgcttgatccatgcaggtactaatgttaaaaagaaatttgagatgtagtatctttggttaaatatatagaacgcatgtgcctttagttaattaatatgtaaacataggcatggtcatatctaagacgattatgccctcataagacatcttaaatacgtagttcaaatacatgaaaatcctacacgtggattgtctcgaaaggtattttataatagtattattttagtaggttttatgtatatatattgttcaatcttcaaaagaagagtttcacaaaacaacaactatttagtcaaaattagaattttgctacaactttagacagacatttcaccaaacaacatcgtagtggacgattttactagaattttcactattatgagtgtcttgcatgtggaccttggaaatagttagctaaagttgcatcaaactgataattttgacaaaatggttatgatattctgagatgtactcaaaagaaactagtgtcaaagcctagagtgaagagatcccaaatcaaaaccctaccacatgaaaattatagattggtagtccttagaaaggaattgaatgaggcacattgcatttgagcatatctttgtagttgtgaaaaaatgcattaattgattgtggtcatttgcttgcaaaatatatttcattctctttttgttgcttctcttgtatatattttctttaatatatatatttacagtgggggtctccctcactgtttttgggtcaatatatatatatatatatatatatatatatatatatatatatttatttatttatttatttatttatttatttatttcattctcttgtactagttgaaccccgactattatccttttcgtgcatagtctttttcccatcaacgtattgctaccgtttaattgttgcccctttttttttagaattgtgaccacaattgtgagaactatttaattcatgtaagaaaactacttagcatgctaaatatgttaacaattgtgaccacaattgtaataaaactacttaattcatgttcttttgcatgtcttgatgtagtctcatctttattgggcatggtaattgaagataaattgcttgataacatatttatcgttttctatggcatttgtccttggtctttttgatataccaacaatagttgttttatcatcataaaagaatacagtgtaattaagaatagtcattctttttttaaaaaaaaaacatattagtgctaagataaatctagaattgaaaatctttgttattttgtctccagtttggctgccgttgtggttatttgtggacatatctttgtaaaatgggtgtattttggcaatggtacttttagatgctttaattatactattatgtctatcttctctattttctcatatggagtgcacttattttgacagcatcactacttagctcaaaatggagatcttgggtcaatgagagaacatgctcgatacacaaaatagctaccacatttttgctattttattgatatgtagcatgtgatgtttgtcttaagcacttagcaaaaaaaaaatgtaactatcgatgtaaattgttttttttttctctataaaatatttgcctcattatttttagttgttatgttaattacacagtatttgcattaaaaaagttaaaattcgctattgtggtgcatgcttattaatttaaaattataaaatttgctttatttccatagttatttgagttagcttcacccatatgaggccataccctcccaaagacagtaaagttgtactcttgtttttcatagaccttggctaggttgagttatttatttgtacttgaacctatgcagtcaacctcctttgagattcatattagattatatatggtacctagtattagatagaaaatatgacaattattatatataattaactgccatttaggaagaggaaaggtgcacattagcttccaagatctatctagcccatttgtaggtgcattgtctttcaaccaaagtccggctattgtctgactttgtgaatatgaattaacccacaattggctataatgcaagagtttttatgcttggctcaataccaacacaccatacccttgctagaaccttactttatgtcgtatattgctcaaggataactaattattgatcaaaaaaattatgttatttaatacccataaaccaagagatgtgcaaaaaaaatattctaatggctattactccaacactaatgtgatcaaggataaaatagaaatcaaggtaaaaaaaacaaatcctttagtttcttacttcagatatgttacacccaaaagcatatatatcatcaaggtaaattggttagtatagatcgttgctaatttatggtaaaatcatttgagcgattctgagtaaggaaaattgagaatttgcataacataatatgtgcataggttgattaaagaatttaatattagaatgaaagatgtgttagcattgatgcataagaaatagtttgaaattgttgtttttctagtaatatgttatgttcttttgcatgtaatttgaatctcaaaagataatcttctcatcttttctaatccaaactacactagtcccaaagtccgacaaatttttgtgttgatctttcctttcttatctcttcccccaaaatcatgcatgttaaatattgtctcccttcaccactatctacaactctactctcgcgcgtttcatggtctttctgtgttactagttgcctggtgcaactcccatcatagccaggtatagatggccatgtgggccgcccggcacggcacggcccaagcccggccgtgcctgggccgaggcttgtcgggccggcacggcccgaccgacgcaccgggccgtgccgtgccagcccacgtgccgcactcacagcccaggcacggcccaacacgcctcgggtcgtgccgggccggcccgaaggcacgatgggccatcgtgcttttcctcagaataagtctaaattttctccctcctattgggctgtgacattgtatagctaaaaaaagtctattttacctccctcttctttgtgatgtggtatataaatagctaaaataagtctatttaaggtccctattctttagacattgacatttatatgtctatttttagtccctatactttgtgtaccgggtctggcctgccagcccatcgtgccgggccggcccaaccgtgccgggccagcccagcgtgctggtggggaggcccaggcacggcccgacggtcgggccgggccggcacgggcccgacggtcgggccgggccggcatgggcccgacccaagtcgggccgtgccgtgcttgggccgggccaaaaaggcgtgccgtgggccgggccttcaggcctcgggccttatggccaactatatagccaggttatgcttagattcatcattgatgttaattcctacttagttgaaatatatatttctcatactaatcccttgttatagttctctactgaaggttataaaacttggttgctaaatcacctatcatcaaaattatcatgtaactagctattctgtttaaaatataggtttatatacatatatcttatatcattcagacaaaaacaagcaaatgtatttctttttatgtatataggcttaaacagtagaacaatcaacctagagaaaaattaagttctgatttcgtcatataattgtaatttgtatgtaaaaaaaacatacttataaattggtgaaagagaaggattcaaacacacaaaaaaaaaactaattcatctttaccatgtacctataaattggaaatctagatgtaaaattagtatatattgttccaacttgatcacatcaaagttccaaccataccttaattcattatacaacatcaatcagtgcatgatgcggatttcttaaaacataagatttgtggatatgaaaaaacccatatatccataactactaagtttctatgcaaggaatcaataatagacgtcatacgctatggtgtaattgtggctttgagccttggaccacaatgaatgacggaagtttagttgaactaaccttgtgtgatcaccatgtaaattggtagctagctaattatctactcggtttggtatatttgtgacaggatttggatcctataacgagaagttagcttcatagacctggttttagaatattcccccaccgttcttttgatctcacatagataaagggggaaggacaaaaacacaacatggtcaatgcatggtttaatgggttacgatgcattttacattgattcataaaaagccaagtatttataatgtttgtatcaacaaaagacatttataacatggaagtggtaagctcataccattaggaagtttaactatttgtgctcttataacccgtcgtcctgtgtttgccgttggagagaagatttctaaatactatgccactatgtgtaacacattggcatcatatggattgttgatgtgagatcccaattttgccccgatcaaaaggaagaaacgattaaggatgtccatggctgtccttggccttagatctgcatttgcatgtagcggagctgaccaccgtggccgttgatgtagtcctcgtcgacaaactccaccctcatgaaattagatgcttgtagttggatgtagaggagctcaccactatgctgttgatgtaagtccttgtcgatgaactctatctcgggtgagccaccatgttatccatttgcttattggtcgctatgcacctcaccatccacctatgccacctcgcaacccccgtaacatcgggcaagcacgcgcggcctcctccttccttttgatgcaacaccccacaaccactgcccactatcatagcccctcgccacacggcaacaaatcgaattacaaaagatagtcgtgcctaagaactcaatggctagcaacagtatcctcccacgtgaaaccatgctacgagttgtggaagcaaaggaggcgaaagaagaggaagagaaggagggttgttgcctcccgccgccacaactagtctactcttcttcaaggccctctcaccatctgttgctgacgtccctggcaaggacgatgatccccatcgaccttcttggtggaagctttcgccacatgcccttctctatccaattgaccctccaagtccaccatcggccccaacatcatcaatggttctactgagctcccgccaccttcactgtcgtcgcaaagaaccatggctcacatagggtccccagcgacagctccatagcatctggtggttgcggcagtgacttccacgggtaccagaccttgggggaaggggctggagcaaaatgaacttttaatgtcaatcttccatgttggaatacccatagtgggaaaagtggcacaaggttaagaactattctcattagaagcaaacatataggaacaattgcaaaagtggcaagtaattaaatttttccataccacttggaatgcttagtgataaatgttttgtttcaatgttttccaagatgcaataaatgtcttcacaagctaacaaccccacactacacgactttgccgctactacaataccattgtacaagtcataaaataatagcctttaccactcgtatgtatatctatttttcacccttgacccaagaaggatgaattgaactcacagttgatatacatgtgcatcagttgaaccattgtgagagtagacccaccaatgtaagatataaacccaagtacgtgtcaaatatgttgtagttctttggttggccctttgactcaaagtgagaaaaaggtgtaatttgacttagcatgcttcttgtgtatattcaaaatgtaatttgcaataagcctattttagtggtcgaaaaatgtgtatacattagactcaagtcaaatataccatttatctcgttaagatgatgcttcgagacgagaataaatactatatcataatgacaatgggtatataaatggtggttatcctacaattaaagtccaaatttagcccttcaactattgcgttgatctaatttttgtccttttaactataaagcaattaattactgatcccgcaactttaaaaatggttcatcaacatggttccattgatgtggtgagatggatccaacatggcaacggggttgggtcggttcgtgttggacaaaaactcccatccctgttcgcttgcaggttcacccggtcccgaccccgaaagaaagaacaggttgaaattagtccctggccgaaaccccggcccctatagggcctcgcacttcagccaagtcccaacatcccctaagcaagcggaagttgccgacggttggaaggagggaagaacgacaagtgccaccttcaaccaaataaagcaatcgtatggagagaagagacaacgtcgggaggcgaccgaagagggagaggaatggagtgggcgccggtggccgaccacaagatgaggaagaaggtgtggggcacctgtggacaagatggtgtgggactccggtgatagcggcgggcgggataaagtcgacgcatgggcgacgtgcgtgactcgttgcatgcgcagagcattgaagcgatcgcacaaatcatgcagccgatgggagcatcgaattgtgcaggtggattattgtttttttgtccttttatattctatttttggccttatgggcttttgatggctagaaatacatacatgaggtgactatttcttaaacttcagggctccacgagtgaagatgtcacctcggccctaacaccgctcaaagtcagggccctactcagtaacacccacgggtgaagatttggccctgtccccggccctgtaggggtggggacccaccgaggccctgtttccaatggggaaaatgccacccctacctacttgtgaaaagagttgttcaccacacaaatcaacaataaacaacaaagaaatgtagaaaatattgggacccacttgtcatgctcaccacctttctctcttatgtatcttatttattttagtttgatagctactacttaattctatgttatcagtcattttagttttgtcctatgttaaacttcttttaactttgaccaaattcataaaaaatgtaacaacttctataacatcaaatcacattcattaaatccaccatgaaatattatggatgttggtgcatccttctataaacctggttaaaatttgattttggacaaactaaaatggcttacaatatggaaaggatggagtagatgctttgtggcatccaaatcataccaccaattacttcaccgtgtcataaaaaaaacctggtttgggcttagggatagctttattacgaggtacaaaactgagcaattttatagtcgaaggtcaaaattcagatcaaggccatagttgagtggttgaatatggacgttttccttgaccttctcatagaggatggatacatgggagaaaattcctacaacttatttatgtttaccaatgattctaacctccaagagtgacttgcctctacaaagcttttctgaaatgacgtttttaccatgttttctagattctttatatacttaagccacatcatttttggtaaaatcaaccatttccatctgaagaaattttcataagacgttcatcaatacacacgagccctttggaaaacaacttataagtgaagctacttagacaaatagcaagttcgatacactagaattgtgagaagccttctttggcttcataaagaattttagtagcgggaggctgccatcatgggtcacagttgatatactataatttactctatatttatttctttactcttactaaagaagttgttaggtgttggtgtattctacttccatccagccaaaggatttcatagattatttattttaaatgggtcccgacaagtgcatatgcatgtggctaattgatcttatgttaccgtgcatcaggttttagatgaatggagaatttctttctgcaatttattttgttgataaagtatactccctccggattgataatacttattgttttggacaagagcacggtctccaaaaagtaactttgacaactattttctattataatatatatagaaatatcagcaaacatatgattttattgaagtactttttaagactaatctatacatatgatttccatatttttaagataaatattttataatttatttatagtaaaagattttaaagtttgattttacccttattcaaaacaactaatattattagtccggagggagtattaattagcacatcttatggcgaagttgacttgttattttaataactctttatattggcatcgcctgggaagaatacggtgccacagaaaagcaccccagttttaactggttacatgactttaacagcagcagcaaatacacttagttaaccataactccttttcattttcaagactccattaccaagttctaaaaaggcaactgttgaaaatgtctgatgattagttcaaatcaaataaacgcaagtttctgtcttgaattttgtatcatatgtctgttaattttagttattatttcatggttttcctcaaattttatcaaaatgttctcctaggtttatcaaaaaaatgagcaacaatgtgatattgttttgttcagcagctgtatatatgattatttcattcgcacgattccatttgtaccagttaccacattaatttgattattaggctgtggataataaagaccattcaatgataagcttgggcaaagtttgagaccgcagaatgaaactactagaagttctggaacagttataccttttataaattcttctggtgtttttagcagataagccctaaattttattctgcatttaagtcaggaagatgttggaggactacctttatctgtagctagtatatctatttttttttcttttgaacaatatctacctatctatatatgtctgtagtttatcatccggcaatttatattggatataggtcacacagtgactcgaaaagtatgcaacaatccaacaaacactcctatgttttcttgatagtactagtgtaaatgcccttccaacttcatgagttttcttgatacatatgtggggtgttctggcttaagatatcaatatgacagagatcaaacatgtatagttagattgatcttttcatgatctaaaagattgatcttttctccttatgtagcatcagaagatcgaaaggcgaaaaacctctctagttgcagaaagaagtcaacctttgaccgcgttctttttcttaattaacaatttatgaagctaattggatatttaattgagatatatctaacgttttgtgcttttgtaattgaaacagaattctaacactattctgacataatcttgctgcttttctctttacttcagtacgcagaaaacaattgaacgctataggacgtatacaaaggaaaatatcggcaacaagacagtacagcaagatatagaggtatataattcttgttgacaaacttggtcatccttgtaccatagtgttattgctgatagactgattttagtataatttatgtcatatgtgtgcgtataatttccgttggcagtgtcaatgctgctccatcaatagatttcgttgtatattgaggtaaaacgaaatgtatattaagttagttattttggggaactctgttttcaaattttatttgaagatgccctatatctgatagattgtattttttttaataaaaaaacagtagattatggttatgtataaataagcatatataagatccctgcactgaagcagggacagtactatttttaagacaaagaaaatcagatgtattctagacttttaagaatcagttttcaattcaccaaggatgtgcatagtcttcgagattatggtaggaatgttttggttgagaaataaataaagaacatgagcactaaacaagcaatgaaaaaatgtgttctgaaataaaatgtgcttctagtcgttttattgtagctggacaattttcaatagattgtttggttgtctgaattgtagcaagtaaaagctgacgctgatggtttggcaaagaaacttgaagctcttgaaacttacaaaaggtacccccttcagcttaattacagaagtgccgtccttgtagctgtcaaaaaataggctgttatcatcgtgtttaatttgttgatatgcagaaaactgctgggtgaaaagttggatgaatgttctattgaagaactgcatagcctggaggtcaagctggagagaagcctcattagcatcaggggaaggaaggttggctaataaattttccatttcagtctacgttatcagcaattaatttatctatatatatgatgtgcacaaacttacaaccaattctctgcatactagacaaagctgcttgaggagcaggttgccaaactgagagagaaggtacctcaccaacttcgtacttactataaataaataaatatatatataacctgaaacgcaggaccaatcatctgttcctaatgtcgtgtttgtctcttttttgcattaacatcgaccaggagatgaagctgcgcaaggacaatgaagagttacgcgaaaaggtaagacgagtgaaacttttactgccgagaagacaccagcagccagcttaagtcgatcgcccagcctagcatatgattatttgagctaattcgtgcgatatcttatgtgcacaccaatataaatgccgagaattttctgcgacactgaaagatcaactcacctgatttgcttcccttgatcatgaactttgtgcagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcatacttgtactcctgcttgattgtggcttggtatttgatgtgatgttggagcaaacatatgctgaacatatctcagttgagattctctgcacaaggccggaacgggaggaagacgaaaggaggagttttaaagagggagggagtacattcaggtgacagatcgctttgacctgtacccctgttgtatatgacgcgctatgctggtattggtcgacgtttcgatctcttgaatgctacctgtggtcgacgtgtcgattgggcagtggaagccgaggagacttatggacccttatccccatcgcttctagtagtatccctcgattcggtgcgtgataacggtttttgcttgcaaagccgcgatgtgatttttccaactctggagtctgaagtagtagtagtatatttctctttacagcgagtatatatggaatttttttgagaattaatattatttttatggaaaatcgcaaaagtagtggccaaccggggaaaatcgcgaaagtaggtccctgtcgaacgggtgcaattcgataggacacctatcgaacaacgggcagtcgacaaacacctgtcgaacggctggcgttcgacacactcacctgtcgaacggagggagttcgaaagggcccaccaccggcgccgcgaggcctgtcgaaccgggggcgttcgacagcgctcacctgtcgaacggagggagttcgacagggcccaccacccggcgccgcgaggcctgtcgaaccgggggcgttcgacagggccctccaccgaccctgtcgaacaatcggcgtttgacaggccggtttaaaagccccgtccgcgagttcgatttgtttcgaggaccacatcgccagccgccgccgagagtcgccagttcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggg

SEQ ID NO: 495 - DNA, 5506 bp, Oryza sativa
tggtactccctctgtcatattttaagtgcagccatgattttccgtgcacaactttaactgtccgtcttatttatttttttaaaaaaaattaaaatcataagtgacgtaaaagtactattcatatttgggtgaatagctaattaagtccctcaagtttcaccgaaggctcaatttggtccttcacgtttcattttatccacatagctcctctaaatatttgttttggcttgacatcatacttgggcccacttaatatgccatatggctatttttaagtcaatatttctattagaaaatatcccttttgcccttaatttatatacaactatatactaaaagggagaaaaccaagatgaataaacaacattgcatatatacttcccattatttcaatatgtgcacatgaaacttaagcaattactatcgtatacacttgctagtacataatttattttcgttttacataatttactaaacattatcttaaaaaaataaagcatacaaattttctcttatatatgtgaatgatgggggtataagtgtcatttatcaagagagttgttggtttaaggataagtttgaactaaaataaaaacttgaatgagtaatatggatagactgaaacattaagaactaaactgagctttggatgaaacttggaggaccactttagctattcacccttcatattttatcatcttataataataaaaatactaattataaaaaaatttaaataaaacggacgataaaaattagacgcaaaaacttataactgcacttgaagacaggggagtaccggagtgccatttaaaattgggaaaacggaaaagtgaaatattgagctgaatttccgggcgctggggagtaggggggtcaaaagagtcatttccgcgtatttctcgcccgttcgccatctcttgtcgtgtagtaccgccgaaaaggaatttccctttccgcccctgcgctgtgcgctccactccactacttgagtcccccatccccagactccgccaccaccacctccggctccccaccccgaccagcggcgccagagcagaggcagtgaggccgagctcctcgcctcgcctcgccgtctccgcccgcgcggcgctgccgccgagccgccgccggcctcctcctcctcctccttcccggttcggatcgggcccaaggtatatgccactcgtcttctctccctcctccccgccgcttcatgagccaccggagattgccttgaggggatttcttcccgctcggatcgacggatccagtcccgtttcttccgggttcttgcggtgtagagtcgtagtcgtagtggtagtgttggtagcggcttgtttttcgagggagggatttgggggggtttggttggttcgggttcttggggagggtttagctgaacccgtgaggtttctgaggtccccgcctgaacagatctgtggtgtctccgtgtgggagcatgttttgctgcgtgcgtgcgtgcgtgcatgctagccatggattggtgctcacgccgcatgcgtgagctttggggggggggggggggttcagttgttgttggattatgtgagcgagaacgcatgatacgatgcaatgccgcggtcctttttgttgtgatgggcagcctcacagcatgcgtgctgcggcattcacatggacgtcgacaccgtgtcgattctttttgtgtctcttgttgtgttgtgaaatttttcatgaatggtgcaaggtggcggttggtcttggatgtggatgttgagctgggaggatcagttatcctacaaattgcatcttagtagtacatatgttgacatggcattactgattcaccctcctttttttgcttctgcatgtcattgccctgttaccccttaaaataggttctattatggtatacctatccagtgtgcaagaatgatatgcctttgacattgttgcgtcatctttacttggtactttagatggtaaaatggaagtgtgatggatgtaactgtgtcaatacagcggagaagatattaatcaataatcatgtacatttgttgtttttggcatcttctcatgtaaaatcttttgggtctgttcttgttatgtgcttcactttcacttttactgttttttttttaattttcaagaaacatacagcttcagtgtggtgattgataaaaatcattactctaactaattctgttttctcctcgaactgttctgttcctagagccggactgcagccatggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtgtgtttcacttcggatcgaatatttgatgtttaagtatcaaatatgcatttaaaacgaggcttttcaattatataactacttctagaaatgaatattccatgccataaattgttatgcttgcacatgcattctattacttatatctttgggcttgatgtaagttcacctaactattcttgtgcctgtaccaactattttagtgtactgcaatctactgctgcttacagttcactaataatttctgttattaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaatttcgttgagacctttgatggtttagtcgtccgggttttctccccattccaaatgggatttttcatctgaactatccttttgcttagaacttgatgtgcagtgtttgtagcactttgtaatcctgtcatcgtcgtccgtctgctcttggtacttctttcacccttgatcaagttgctgaacttagtcaggacttaagtggtatttaacccaagatctgaataattttgtggctactggactagttaatttcctcagctattaatttgagctgtagcatcagatgaggtgaactttagcaattgagctgctgtttctggtgtgtcattattcgtcaagaaccttttctgttcattttaatatacttgaactgatcaccagtcactatcgcactatcgatattgatcatgaaaagcaagatcttgaggaaaattgagtgatggggttggggccaaaattgtgggtcgttgcaaaggagtactgtttgatccacaagaggataagagatgatttgagggaaacaggagaacagtgttgcagacgtgaatgggatgcatgtgctaccggttatgttctgttacatagaagatggtacatgtaccaccgctttgaggctcttttcttccccttgtaattcgtggtggggttgaattgattcctgtagaaaataaacgctgctcaccctttcgtttaattctcccaccaagtggattgaacgggatttgaagagaaataataacacacatcttcctcaattctctccaatctctttcttacgacaatgccttatgagatacaatggcgttctcttttgaaacaaggggatttctgattcatgtgacgaggtctctgtatcggagtcctaaccattggtgatggaagggacaagaaataattcttcatatatataagaaaaaaagagaatataagtggttccttttctttatatatgaaattcgattatttcatttgtgttcgcgtttgagattttagttgtgacttgtgagagaggccccagtcatctccattccttaggggttccccaattacacatcaaccacagctcattccttttctccaatcataaataaactataatctctatatttttctttcatccccattctcttctttctaattaaaatagaaacggcttgaaccatactcttagtatttttaaagttctacattcaattagggaggtagagcttggatatggatttttcagaacttccgcttggaggaaatggacgcttgattgcataatttgattgcatccaacaaattttagtaggccatgagtaccttttctttataggaaaagctctccttttgcca

SEQ ID NO: 496 - DNA, 8262 bp, Oryza sativa
aagcctccatatatgacgtcgggagtttgactgcgatataacggtaaaagaatttaaaggtttttaccgttcaatagtcaaaatccctaccgtctctcctccaacatgctctttcgtttcataaaaatcaccacagcaactgaatattgatatgtatattctaatattccctccatcctaaaatatagcaaccttatatcttatactggataggatatatctatatccagattaattgaattatgatttgtctcatctagtaaaatgttgctagtatattttatgacgaagggagtactataaatttaaatatattaatatttagtattaaattgattttttatgaggaggatacagtaggctataagccagctgcaaacatattttaagaagataaatgaggagagagaagagcagcgggctatagatttgtagccacctgtagcacggacttcaagacgcagtgcgtatgataagtgggaccatgtattgatagtgtagtatgtaactattacttcctccgttttacaatgtaagtcattctagcatttctcatattcatattaatgttaatgaatctagacttatattgtgaaacggaggaagtatatgaatgagctattagattggctctagatggattagagctattagttggctatactactccctcctttcctaaatatttgacgccgttgacttttttaaacatgtttgactgttcgtcttatttaaaaaacttttgtgaaatgtgtaaaactatatgtatacataaaagtatatttaacaataaatcaaatgataaaaaaagaattaataattacttaaaattttttaaataagatgaacggccaaatattttttaaaaaaatcaacggcgtaaacttctctggaaaactactccgaagtccgtaccaactgcccgcgactcccgctgcaacgtgcgctccgtgggaagaggaaaagatagaaagatacctatcgctttccacctcaacgctccactccaccaccaccgcgcccgcgccgcaaggcagcacagaacagagcactccctctcccaccaccactccacacctgacaccacgcgggctgcctccatcgtcatcgatccatctccgtatctctcaccgaccccaaatcgcacagctccagctcctcctcgatccccgtcgcgatcggcgagatggccacggcgatcccgcagcggcagctcttcgtcgccggcgagtggcgcgcccccgcgctcggccgccgcctccccgtcgtcaaccccgccaccgagtcccccatcggtaccctcctcttcaccctctccaccctctgcttctgcctctgattagcctttttgttgttgttgttgttgctgctgttttttgcgtgtcggtgcgcaggcgagatcccggcgggcacggcggaggacgtggacgcggcggtggcggcggcgcgggaggcgctgaagaggaaccggggccgcgactgggcgcgcgcgccgggcgccgtccgggccaagtacctccgcgcaatcgcggccaaggtagggtggtgactacccccacccccccccccccccccaacgcgacccgcgtgcgtgtgttccgtacagggggaggagctccgcgtggctctccagtaggtttttgagccccaaatcgatcgatatgctctagttttaagtttgctgcttaaattcctcaagggtttagtttgcaaccaaatccttattttagcttcggtataagccccccatatgatgtgcgtgcgtcggcatcggaagtgcgtatcctctgttctggactaggaattggccataggttgatcgacagttcgagtattctgcttctgtttggaataagttggaagcatggctgattgtgtatctggatgctgtttttgtggtgattcgtttcaagctcttgttaattgatgggttcaagcggagagggtgcgcaacaacaagtgtatatggctcacggccatgggtgtgcacatttgattggtgcgcaacaacaagtgtatattgtttgtgtgcttcgttagttggcaggtcctagtcactaaatcactattggattggtactagttacttttgtgccttgacgatgggactggattactagccttttggttgcctttgtggtattccgttgttatgggcctgttgatggatggatccctttaatttctagtgccaaatgcatgctagatttctcacagtttttctcttcaggttatatttctcgtatttccttttcctaaaggattgctttttcatgtattttctggcatatataggttattattattattattctccagaacaagattacccatattatggatcactagtgtacacttttttggatgaaaaacctacttactgaaagtaaaacagtgaccagtgcacactttacttgaactgtcaaaccatcaattttctagcaaagcaggggatgctagccttccagtctaaatgacagtaaactactatacttttgtccgtaggtttggaaatatgctaatttctatcataaaaattttcatggcatatgcgagcattttatgatcaccttttccctttttcttcagataatcgagaggaaatctgagctggctagactagagacgcttgattgtgggaagcctcttgatgaagcagcatgggacatggtatgtggccagttatccactgtatgaatatgtagttgcctacacagcaatctttcctgaacatgaatcctgatgtatgatattccatttgtcaggacgatgttgctggatgctttgagtactttgcagatcttgcagaatccttggacaaaaggcaaaatgcacctgtctctcttccaatggaaaactttaaatgctatcttcggaaagagcctatcggtgtagttgggttgatcacaccttggtatttcacatttttctctcatcctgcgcttatatttatttatgacccaagcatggtactaaatagtactagtaacatgcatatactgaatgagtttacaactttacatgatttttttgaactatgaaagttgaagacatttgagattttattcctcttctcttgtgcaaacatattattgtctcacaaattgtacctagcagctactctctccgtttcatattataagtcgtttgacttttttcctagtcaaaatgtgttaagtttgaccaagtttatagaaaaatttagcaacatctaaaatatcaaagtcatgttttagtgttttttcaggctctcatgtaagcaattttgatgtgccctctcctttcttcttaatataatgatacacagctcttgtgtattcaaaggaaaatatatatatatataatgatacacacctctcctccgtgttaatgcagctcatttgttctgtcccggttcaaatatctatttttctcatatgttgtcagcatgattcacttaatttagtatatagaagatgccattatttatgtctggaatcttactgcagaagggaaaacaattgataacggaattgattgcattctaatttgttgtttctttgttatgttcttatcgacaattacaaatttgattctgagaatcatgttcgggatgtgtatttctactgcaggaactatcctctcctgatggcaacatggaaggtagctcctgccctggctgctggctgtacagctgtactaaaaccatctgaattggcttccgtgtaagtttaacatgttaacttgttaatgtcatacccatgctagttgcaatgacatttgattttaaaatgttgtggcatgtccatgctgcaagcaatgtaatttgaaatctctctctatcattaattaccaggacttgtttggagcttgctgatgtgtgtaaagaggttggtcttccttcaggtgtgctaaacatagtgactggattaggttctgaagccggtgctcctttgtcatcacaccctggtgtagacaaggtacagctattcctcctgtaatcatgtataccccatcaatggaaatgatattcctctcaatacatggtttatgttttctgttaggttgcatttactgggagttatgaaactggtaaaaagattatggcttcagctgctcctatggttaaggtttgtttccaaatttctgtggatattttttgttctctttctactaactctctattatcaattctcaatgttgtccttttcttttaactcctttactttttagaattgtgatcaagacactttgagcatcattctagtagccagttctatcctgtttcttacctttttatggttcgtcttttcttgacagcctgtttcactggaacttggtggaaaaagtcctatagtggtgtttgatgatgttgatgttgaaaaaggtacatgccacttgctatgattaactaattctgaagtgcgggactttgtaaagcacttaactgagctggatgctagacccccaaaagccctttttggtgtcttgggcttgttgcagaaatactggtcccagacgagcaggatgcaagaaaattaactacttttgccactgattagtatttcttagaagttacacctcaaggattagcaatactttcttaaaatgtgctattgattaaaaagatgtcctgtattattttgagcagatcttgtactggttgatcggcttgcatgaaaatattgttgaggattataatgccatgccaactgagtaaagaaaagagttgtaaaatatgttatgcaacatgaatatatatgtgatttcatttttcctttttcttttcgtggcaaggaaggcagttaggaaggactgatgtgaaaagcacaagtactattcttagttctggaaaactgtgttctttattttcctaactacaattcaccttgattagtcagtaacttgatattggcaattctagctgattatgaattctgtttatatttcactaattttgaatctttaattacattttatggttgaaatttaacgttttgtctggttatggactctgtttgtattcactcaatttggatcttccattagatttcattgttggtccttcttcttgtacagctgttgagtggactctctttggttgcttttggaccaatggccagatttgcagtgcaacatcgcgtcttattcttcatgtaagcattgaatatatccgtcaatcataatctattgttgtacttgattttttttctgatcaactcctgagttcagattattatatgatgccattactattgcacagagcgaataaaattgtatttatgcacagcatgtattttgagtaatatatgcattgcctattatttaatatatagattgtagcacttaattttgtgtccatgtctctatgatgtttattactttattattgccggcatgaagcaactttgaactctatgttgatcttgaactaaaattgaaattaattggcttattgctattaatgatatagctttcagcttcttgctcctgaccatgaaagttttgcagaaaaaaatcgctaaagaatttcaagaaaggatggttgcatgggccaaaaatattaaggtgtcagatccacttgaagagggttgcaggcttgggcccgttgttagtgaaggacaggtaccacatgtaaactttttctaaattcaaaaaagaaatgccactgatcaatggtaggtccttccaagccttattgctggattgttgcactgttttgtcaattttgtgtaatatagttctgaatgaattagtcggtgtatgctcttgctagttgctagtatgtggtacagggtcttcctactttgagcaaattcgtgttaaaatgcattgatgaaaaggccacctttccgtaggtttatcttgtcataatttaaaccccaataaaattttaattttttgttttgaccccatggcactttaatgaaatcacttagccatgagcttttgtatatattttcaaagcaccagaatgtttagatggtttgttggaaatcttacacatcctattgccttgtgtcagtatgagaagattaagcaatttgtatctaccgccaaaagccaaggtgctaccattctgactggtggggttagacccaaggtaataatctactacacggttgtatatataggtacccacatatcattatgaagtagaaataatcttgtatgtttttgtcagcatctggagaaaggtttctatattgaacccacaatcattactgatgtcgatacatcaatgcaaatttggagggaagaagtttttggtccagtgctctgtgtgaaagaatttagcactgaagaagaagccattgaattggccaacgatactcagtgagttttttttttaatacagttcattgtcctgttcaatcttgcagcatatgtatatactctgtggcatatgaacttattctgctactactacttttgatagttatggtctggctggtgctgtgctttccggtgaccgcgagcgatgccagagattaactgaggtatatccaagtgaagggggttggcattgtttgattcatatgacatggttgcatcaagctgatattcaagaatctcatttattacttgcattctatgcatctccagttcttccctggactccggtcaatgttaatatagtttgtttgctagtagtatgctactccaattaagttgctcttcacttccacatcatctgatccatgactttatatttgaccccttttttttgcaaaagaaagggaaatacttaacgaaaatttcctactgcaggagatcgatgccggaattatctgggtgaactgctcgcaaccctgcttctgccaagctccatggggcgggaacaagcgcagcggctttggacgcgagctcggagaagggtgggtagcacacaacaatctcactttaaaacaccatttcgatcgtctgatgatctcgacctgacatcatgcctttggtattttcattcacttttcaggggcattgacaactacctaagcgtcaagcaagtgacggagtacgcctccgatgagccgtggggatggtacaaatccccttccaagctgtaatgtaatatgcgcatacgcatgacacgcccatctgttctgatcgtttggaataagaggccatagtatgacgggatggactttgtgcatatcgatgtttgatttgccatgtgctgagcctggaaataaaaaaggttatagttggagacttgtgagagttgtacgacttgtactgatggttacgcgacaatttgtgcatggatagtttgtgtgcttgtaccggggttctctccgtatcggcttgtggtgtttcaaccttaagacccctgcagtgcaggagcctgcaggtcatctgttctgcagcgaaggttttgcgtgagcggaagttagctgatgaccggttcggtttagctaaaaccggatgatggatgatggattatttatcaagaggattacgtgccacgcttctaaaaatataacttaaatttttctcatcaccaaacgacttcttcaaaaactttttccatcggcattggttagctttatattatatgctattttatttattttatagggagatattatattcaattaaacctgaactgatagattatccatcatccttcaagtcacctgtttcaagcgggaccaaggtcagtcagacctggttaattcgagtcccaaacttgaatcttgacaaggtcctatatataaatgactattgatatgagcatgagaagttttaagggtttatttcaaataactagaaagaaacaaaaaggacggaatttctcaaccgataagaaatgctctctttggcaagcaggctggacctcgggactcagctgtcagcagactgggttagcaatggacggagcaaatagcagaatatacggaggaaaccattaacatagtggaaacacttcataaaagtaaatagaattgctgaaaatattctcatagtagaggaggtgatattatataaccatacaaaattcaagatcaaactcattttctctggcgaggcaaggaattttttttatcttacagatgaaatcaaatccgcgtttcaaattttacataattgtgcaatatcaccttccccacttctcataacttcttgagaatcttcaaaagtttctacagactgttttattgccagaggccagagcccgtgttttcaagtccaactatagccagagtttgggggagcttaagattctgagaagcagctggttggtagccagcttctcagaatctggaaaagctgggttttcca

SEQ ID NO: 497 - DNA, 4548 bp, Oryza sativa
tcccctcctacggagtctcacacttcgacaaacaactaaaaaataagtcagaaaaaataagaaaaaatgtatgtgtactttctatagtattatatctacgtgtaaaatgacattgaaagaaaaaaaattctaaaagatttattgtcttaaagttgtaagaatatttttacagttaaaatataatgaatttgatgttaaaactttgcaaataggtctaacactattgatagtatatgaatatttttttctagatttttttcgatatttgttagttagtatgcatagagtgtgtacgtgaaatttatatgcacaacatacgtttcctagtatcaaatcaactaaaggtcatatctactctttacctagactaatatagtactatgtagtttaaaattttataaccaaacttatcgttgcatttttatctgtcagttttgtaagatgcattggcataagttcatgagaaaccataaaatttccctaacgataaataaaaaaagaaacatttaagtattatatcgggcatagttatcttactccttttcgatcatactttggaagtagttttaagcccttatgagcttgataaaacatactccagtaattttaaatcgaacttttttaatgaaatgtctcccaacttaaaaagggtacaaagagatatcaggatgtaataagccgcaccttgggctacacagatcgcaggcacagactgggaaagaattcggctcgccgttgtcttccgagatggagaagtgagccgtaggcgtagagccgcatttctcatcactcctttttaattcgcggcgatttttggggtggtgggccgaagatttgtaactggatggtgaggtctgtctggtgaaaaggatggccgcgacgaatccgtacatcgatcgatccagcgctgtgcgtgtgtgggtggtgtgttggagagagaaaagggatgggagagaaggcaccggtagggcccaccgcgcagtgagagtctatagatagatgccttcctctctgatcacctgatgcccttcctcttctccccccttgctactactagttgcttgcctcttcccacctcacctcgcattgcaatctcgcatcgcctcttccttctcttcttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagttacagaatgcccccttgatgctcctgtgaacatgtcgaatgcgtttgctgcaacaacggcagctttgcttgtgaaatctaccgacctaggataccttagattcacgagtccagcttgcatatgtttgtgcgttgccataaatggtttcccaatattggagaagcaaccagtgatgcgtcttacggttgctggattggaaacatctcgttaagtttcctcgagtgtactcctccgccctcgtggccgtcctacgctggtagttttcgatctaaatatgagcttgagctttcccccgttagaactgcctaaccaccaatctttctcctttccatcagtgctgaaacaaatcagtactagtattcatcactgcacctttatctaattagtctctaattagtgtgtcgcattctccagataaagatggtacataaccatagaactacaacatgtgtagtagaacctaaaattacagtttcgaatcagactagtagcaaagaatcgaagtccatgcgaaaggactggatctaactagtgtggacaccacacaaagcacagcacatgtagctccacttggtactcccatttaccaaatggagacagctgcttcggtagtcccctctacaccgtattaatccccacataaccaccgtcgttcaattctacgtctggtacaggaacttttactgctcgctgggctcggattggcgcagggagagagagggaggagcagtggcaacctgagaggccactggcctgctgctgcacagtacggtacggcacattgccacttctgttgaggtcttgtcctcccatgaggcacaccatgcagcgtggccgcctcccacggcccgctcgctttcgaaattaaccgcgcggcgcgcgccggaaacagagaacatttcacgcctttctagtctttcaccccaacaaacgctgtagctcgccagtgaaaaacgcccgtgggggcggagcgaaaactcacggtaaaagctcgggttttcg

SEQ ID NO: 498 - DNA, 3274 bp, Oryza sativa
attgcaaatttgcaaagttacacgcgtcgatcggaacacttcaaaatggactaatcgaaacatctgcactaactagctaatgattacttaccgatcacagtttcaggatatatagattggtccttggtcgacgtcaattcatgatttattagcatattagtaatcgattagttccacgagcaagcaagaacaaagtatggcatgcatacatcaaatcggaacagagccaaccaaaagcgagacggtttcatgtactactgatgtatataggagtaataatgtaatatccaaaccttggtttccatggattttacgtgcatatagcaagctttctagggttccctctttgctgggtaaacccgctggtgcggcgcggcatgggcacgtggcaagtggtgggtggtcatagcttattataactgggctgggcccacaggctgcctaccggtggtgggccacaatgtagagggtcttctcccggtgattagacagagagagacacgcgggcccatcgccctttttctctacggatcgatcggtcgttctgtaatctgttccgtaacaactttctctcagggcggatgaaactccctatgttaatggcgaaaataagtcattggctaattgctacgaggttgtataataaattaccaaattaattaccagattaattagagtgatgagagatcgatcatggtggtttctgattataatggtgaacattaatttagagttgtatgcaaaatacaattctactcatagtaaagaataaagttagagttaattatacaaatgaatgcagtgcaatcctacataaacagtagtaatcccgtaatcgtggataatcatgctgaaaagccgaatagttatgtactaatcagtcatcaatcctctgcggcctgatctcctctcggatgctatctagcagcctatttgcgtagcgcatgttagcccatctccttataaaagacaccctctccctttctgtctccctcacacacacttctcccatccagctagcttttgcagatcgagcgaaccttcaacacaaaccggccagcttgttcctctcctctctctctctctctctctctctctcggtcgcagccagctaacttcgagtgtgaagaacactcacgctagctagctttctcaaggccacatacgctagctccgcctccacgcgcggcgtacgtctagtttgattgaggctgaagagagtgcgtgtttggtagaagaggctagctgttgacgatgtcgagcagaaggtcgtcgcgtggctccatctcggaggaggaaatcaacgagctcatctccaagctccagtcgctgctccccaactcacgccgacgcggctccagccaggtagctaaccacattcttgcatacgccaactgcttgtgtactgctagtgtgctgccactttggtagtagctataggtttgctttcggtgaacacagaagtggctactactagaacaatccacacactactatagtcgtgtgtgtgggtggtggtttggggttaagcccgtgagcgattcggtgtgtgttttgtctgcacgagacgagtaatgtggcgttaatgcaggcgtcgacgacgaagctgctgaaggagacgtgcaactacatcaagagccttcaccgggaggtggatgacctcagcgaccggctgtccgacctcatggccaccatggatcacaacagccccggcgcggagatcatccgcagcatcctccgctcctgatcggcaagcagcagcagcaagcggcaccggccggccggccggcctatgtcgacgacgagataggccgggccggccgggcaacgcccgcggcgccaattaatcaagcgtacgtcctgccggcgccattctccggccaccagagagcatttagctagggtatatatatctacatatataaaatatttatgtcgtatgtccctccccaaatgtacgagccacgcttacacgcgcgtgtatcgatctctcgatctctctctctaagctccactcgaagtagggcattagcactaggggcctaagcagaggcttatcctcgctttagctcatattttcatcgcttgatgtgtcctctctgaacccccacatcttgtcttgtttggtttttccctctcccttccaatctatgtaaatttagctggtgtggtttggatcgagttgtgtcctctacagacaaccgaccgaccactactacctagaggaaattaatatcatcatgggtgtactgctccagctttaacttcaattcagttggctacgtactacgagaaaccatactgtatattaggagtatatttttctcacatatgattaagatattctcgcgcgagttcccgcagggagatcgatgagctagatcggtcgtcggttctacattttcttctatctgtacgcacgtgaaaccgagcgcgtttactctcgcagctaaaatatatttgcatgataggcaccgcacgatcgaattaatgctgcagctaggtagcggatattgttacggctgtatcgatcgacgccgccggccggtaagttacgttaagttcgtggtcgacggcgacagtcgacgagagcttaggctgcagggagcatgtgtacgtacgcttccacttggacttgtctagtagctaggtctctgatctttaatcaggctgaaagaaatagatgaggggatcaggaaaaaggttggcgtcaaccgccttgtttttgctcggccgttaatgccgtggtggcgctgtcgatcgtccttaattttctctctgcgacgcgcgcccccacatgttatggtcgatcgttcgatcggtgcaccagacgagaccaacccaaccccggctggcaggtgaaagtcaccctggctacagtgacctgagggcaaaaggcatccggctaccttgccttgtataggactacgtacgtgtactacttacacaagtactagtactagtaacaattaatcctgtattgattttactaagagcagttacaataatagactataagtcagttataaacatataaaataaataaatatagaatagagaaaagcagcgaaccacatatttgtagccagctacagtactgattctaaggcacaatgtatatattcattgtatatgataggtacgatcatatattaatagtgtagcatatatttatagataactattgtataaattaactataaatgattttgagctagttggctatacgctctaagtaccgaaatttagcgtgacaatcaatttggctttagta

SEQ ID NO: 499 - DNA, 10851 bp, Oryza sativa
atctccacttattttttaaggtgaagttgaatccgtttggttgtgctcatcctcttgaagctgtgtcaaacaaacacttaattgttataaacctgaaaaattaattactttcatactccctccgtttcaaaatgttcgacaccgttgactttttaacacatgtttgaccgttcgtcttattcaaaaaaaattatgaaatatgtaaaactatatgtgtacatgaaagtatatttaacaatgaatcaaatgatatgaaaagaataaataattaattaaattttttgaataagacgaatggtcaaacacgtacttaaaaaatcatcggtgtcaaaatgaaaatgatatgaaaagaataaataaataattaaattttttgaataagacgaatggtcaaacacgtacttaaaaaatcatcggtgtcaaacattttgaaacggagggagtacattggagtaatttttatatagaaatattttcgtacaaacacaacgtgcaatagttttcaaaacgtgttaatagaaattaaggtagaatctgcatataatcagaaaagaacagaacagggccttgatgatccgcgtaaaactccgagttccgtcggcgtccgctcgtctgttccgttggtgctttcgttgtacatgctggagacggatgggccggatggagaccggtcgatcgagacgtactcgactacttcgccgttcgcggcggtggtgctcgcacgcggcgacgccgcagacgcgccagccaaaccaacccaacgacctccgctttgaacccgtcaaaaattccgccgccgccaagcggcctcgccctcgcgtcgtcacctctcgccatggcccactacaaatcggaggcccacctgtgcgaatatctcaggcccaaatactgagtcgcgcaccgcccccgctggatcaccggcccagtacggcccgagcggaggaggagcggtggcctttttctctcgtctcggcggaattccccgtgaaattccggtggattttctggtcggctccggccgccgcgggcgcgttggcttccgcttcggtttcgcggatgcgggcttccgctagggtttctcccgctgtaagtattgtgaatgccgtgctccttctccttctcagaagttttggtgatgtttgtggcggtttcgtcggtcctcttcgtgtgtatttcgcctcgtagggtggtagaactggtggtttaggaatgccttgctagcttatgcttgcgcggacggctgtcagtgcagatgttttgcaggttgcaattgcgtacttgtgttaggcttagatgattgcgctccttgttcggatgggtggagactggagaggcgaaggattttctggggatgatgcgaaggattttctgtttgtgaaatgctggtctaaatcaatgcgtatggctatccaagtgttaatatgcaaaaaaaaaaaagtaatcaggaaaaaataatatgccattgtggttttgttttttagaatacacaaggagtgcatatttgtattaagaggaataaaagttatttacaggagaaagaaaaacaagaaggggacgggatacagatggaaggaccgaaaaaaacactaaactaaacctattctcacaggattattgagcgacctagaggaagtaaggggttggacattcaacgccataatggggcttcggtggccattgccttcacaagctccggccacgatctttaactctgggaatgatgcatagtttgatcttaaactatataaaggctgtaatgcatagtttgatcttaactttccatcgttttcgttaatgaaagcgggagagatgcggcctctctttatcaaaaaataaataaataaataaaggttgtaatgcatattactgcatacatgatccattatgtaaagttcatggttgtttaagaaacctatttataagttataccatcaggtgtactgcgcttttagatgtaatgataagggtggggagtgaaggatacaggaaagcttcagactaacttcctttttcattagtaagagtgttgtgcctccagttagttgttccacgcacgtatctgatatcccacgtatttatttgatcattgaactccctgtcctcctcatactgcaacaaggattatcatttaactggaaatatagcatttgtactgttaagctataacggggactggtatacttttctatacaaatggaacttagatattctctcaagtcctatctagtaactagatccgtatatttaaaatctagaattatttttggctcttctaaatgatgaaaaagttaagcttcgaggcccatttgaaccttttgatttatgcaaaggcagttgctatctgtcttaatattggaaggatttccttgtggtgctttagatgctgcactatcaatttagttctatgctgattaataagctttaggtagacctaatttgagaaatatctattaatcttcaatctgcaatggtcttattgcattcgaaacttgttagttttgtttttgagggggaagggtaggagctctaccaatttcattaaggaggatagaaaagatacatgatcacctctcaaagggtccatcgaaacttgttagcgacctggaaatgaataaatactcctttgtcatcgttcagcaatgctgttgaacataaaagtcttggatacaggaaacatctttcccataaacaatgtaaagcttcattcactaattacccaatcattgggtatgaagcttctctgatttatgtttcgattttgtcacgggattttaccaggttctgtgtaaagttgattttgtttgcatgtcagcatccttcagtccaccatctactcataggttgcaactgttttccctgattgtttttcccgttttactgatgacaaatgtcttgcctacagagtccctttataaagtactacacttatgagtaccctgttggtagcatcttttctcttaccactgtctaattgtctataataaaaaacttcaatttttttgcacgttagtttcattgcacttttattagaggatacatgagatggtagaagcattttcttgttaaaattcttgccaattgccattattttgagtttccattacatggttacaattctcaatcagtaatcgcgcatcgggctgaaattttatgagacatcacatattgtgctacttttagtctatttacctagtaagaatcaacttaacaagatgaggctataagggtacctagctttgattgtttatgtgttcccttccctagcacgaaattctttgcaaaaccttaaattgctatgacagctttgttaaaattttaatgtagcaacgaagtgttgggtcttttgtgtctcgtcatatatttgttgaaaatctgagtttgtgctcatgttgttggagaaactatgttgtgttttataccctaaaagtccaaaaacccagggtagtttagtgcgagaagtatgttacagaagtcaattgtagtttatgtggtcaggtaacttgttgctattattaccatgaaaatagttattaacttcatttgacaatgctgattaaccattgcctgccgcttcctagatgaaacaatttgattggatgaaacatataaacaacaacatttagacgtgatatgcactcagcatgcatgaaatgttgtctgaagcttttggtgtcgacaagacgacaagtatacctccatgctttcccttaatctccactccctttccttgaattcccttcctgaagctatctcaacacattcaactcctattcagctttgctggaaacctatgtatttgctttcttgtctcacaaacactaaggcatgattatttactgcagagtgaagaaatttacaagcagtcaccttgctgccttgtaacactcgttactcttttttttctcatcattgacgcttggtcctgaatggcttcctccataagatggttactaatagctttggtctcaaataatttattttaacaactgtttaccaaccgtccaccctagtataatctagctttcaatgatgagcatgttggggttctgcagcaagatctggattcttttctttgttaattgaaataggtttattgtattccttgggctattggcaccaagaacgttgtcagaactttaattttaatattcatcagcaagtagccttggatttcccaaaagtggctgtatatttctcaaatgtgttgaactgaagacagctgaccttcagtatctccagatcagatgattcctcttgtgtcagagtaatacctgtcaattcctctgattaagatctcccgtagttatatggagagtggaagcttctttcactacagtatcgaccttggtaatttttttttcatgtttttctttttgtctagagccctagtgcattcctaggtgtgatgatagatggcattctattatgtaactcacttaattccttgtcttttttttttctgagagcaacaagttagtctagtataaatcagctgagaaactgagacacattctaagtatttttaccacgattcattccaccatgctgtgaatgtccaaaatattaacaactgatcggcaaaaagagcctgtttttatcatggtattagtacaccctaattattcctgaactggatcggtcctggggatctttgcagtatcaggcagtggggttctacactgccctgattgatctggttacaaacaaacttacaacacattattcacataaagcttttcacttacacatgaagagggttccagattaaaatagctaaagcatgtgactgccctgttagtgctgagcactatgttaagataatgcatgtgattcctagcatctgtatggcaggcaggcctacttgacctattgtttagtagataggaggtactcttgattctcttgcttgatcaagtgtgcacttaaacaagagactgatctcacttgtgtgtgtgtgatggtgtgaccttgggtggtggtgaaggggctcagcataaataaatcgcctccacgtgacaacctgtacggggtgttttctactaattggattgagctacatgtgacccatgagacatgctgcagtccagatatgcttagatcatcgcccactagctgattttgattggtgatttgatgttttatactgtttacatcgtacttaatgagttacatagtcatttgtagagtttcttatcctgtagttggtattctatgtaagagctatgagggtaattatgcttggaacatagctagggctaattaactttgtgaaaaggtcaatgggaccattttataaacaggcagtacctaacagtttatgattattttatcagtggcagtggatcttgtgaaaaaaaatacttgagagacaaagagaatttttagcgcatgtatatgctgtgattggctggctaatcagatgtttaccaggctaatatacctattagctaaatcttgtgctcatcctacgtcattagctcgtcatttctaaattatctcttcgttattatagattttcccatcgttatcctagatatcctttaagttcataaatgttgctgcacaataattatttgaatgccatttcaattaattgtttagcagtttgccgatgaacatgttttcgtttaaatgaatacccgcttatgagctagtgcaatgtgtgcattctacagatcacttcgatctgtagcgttgcgctgcttgaaaacttcatctgcattactatgacatggtgttttgctgtgctgcactttgaatgagtcactaatgaaaaaaatggaggagatcttgcagctggaatttgctttaggagcattagagatcttgatataaaatgcaagcacacacgcatgcacatgtttctgttaaataatttattgtcatgtcaacattataataacatctcttatatgcagctgttgttaaatgaagaaagcacttggaatacacccagtagttgcactttacctgctggagagatgcattgactggtcaaattctgaatgattgctctgagttgtgcagcaactgtttcctggaatgattcatttgcttcaagatctatacataatacttaataactattaagtttgtaaacatatagggtgccatatatatatatatatatatatatatatatatatatatatatatatatatatatatatatattttgaagagaatatagggtgccatatagtcccctgcatctagccctccttgaatacagaactaaatgttgtgtaattaagatccacaaatattcagataccttacatttgttagagttgcttggaagctgagattacatgactatgatattcagaattaaatgctgaacatttgttagagttgcatatagagctaaatgttgccaagactaatttgttgcaaatcgtaacttcccaaaagccattacaggttatgttttaaagcctcaatacatggataccatagccataaaatatttatacttattctctgttcccattgtttaacatgtaactgactgaaaagcttgctcactgtattttgttatcaggtctaacttgagcaacagaacaggaatggctaagtgggggtgtcaagactcaagaagttcagaaagtaaaatacttttcatgccacatgtaagaatttacttacaatcagacaattccctagtctaactccaaattacatacccgaaagttgaagcagtgcagggacctgatgcatctgccctgatatcggttctcgttctccctgatagtttgagtaataacacctacagtgtgacccatgcctgtattgattatcaggcgccacaagacatgggctgtggatgccagatgattggagaagagaccagccagcatcgtgacactgctgagtctgatacacatcatgaggtaatcagcactttaaaattacttgatccggttacttatgttaggtcatcaactgatggtttcatcagcaagcatagtaattctatatgacacaggagcacgtttctagaggacagagactttcatgattctattttccttgtttggtatcaaaggtgtttagaaccatgtagcttagttatataaatatgaattaaactataagcaaaataactatacattgtctaggaagcaagtcctgttgactgcttcaccctgcgttgtttttcctctggacggccacgggcggctagccggggaggcgtggcagaccgcatttggccggcgcggcagcggcggtaggagtgctcggaggccagctcgacgcatagaggcgcgggctagtggcagcggaggtcggcacggcgcgaggaggcgcagctggcggtagtggaggctggcttggcgcgaggaggcgtgggcggtggcgggaggctggcttggcgcgatgaggcgtggccagcagtggaggaggccgacacggtgcgaggaggagctaccagtgggtgcggtacggtctacggcgcatgaaggctggccggcggggggtgccggtgtagtggtcccacatgtcggcagaggttggacagtgtggagcatcggggcgccagccatggactcgcaggtggtgagcggcgggtgaaaacccagcccagcctcggccgggccggcaacagtgacgctcaaagcgtcattccccttctgggggcgttatcatgccgtctcatccctcgtgtgtggacgttgggtaaaagtcgagtctcggttctctttgagaccttgacggacgacgacggcagtgttttcgtcgcttctctccttggagacgtcgtttaggtatcccttagccgaaaccccccatccaattggtgcaaactctctctagatttcttcctcctgtggcggcgccctagtctctacaaattggccacgtcggagggcctagaaggacaggagttccattcttctctctcaccctctctccctgactcctgaagacttggatagagcggggctttgtgttgattgtaagggttgggttttgggggatctcagctgtgtttctttgtttgcctagaggcggtcggtcacgcttagcggctgctggcccggtgctagccttttcttggttctgtgttggcactgttgatgtgtggatggtggtatatttttttcctttttcctggttacgaccttccagggttgtaatcttgtaatttttctcctgctctatcaatagaacctcgcacagtcttgtgtgagtcgttcaaaaaaaaaaaagagctcctagtcctgattaggaagacaagaggtgtatgcttcatgcatggctgtatactgaatcctagacatggatacaaagccatccatcaataaatgtagcctcaccattttttttcatatacatatatattattaaatatcaaatgtgggggaaaataataattaatccacacattttttgtaggccaagtaacatggtttgcgtggttctttctgacagtgtaggcctccaagtcgccttctcaccagcactttatctcctgttgttctgagcttctcccacttgcaaggggcaatacacgagtagcagaacatacactacacatcactcctcagtatggcctgtccctctcttccatctctaagagttcctcttcccaattcatgtttctggcatgtgactgccattggggccatattgtagtgtggcccctgttggtcagagccttgagctaggtgacacacttgttgtaaacgggaaggtcactctccctcttgcctgatctcatcaggttcctctatttgcagctagtagtagtctatttaacacgccagtagccacccatttctttctcccgtgcggctgtcttgtgtttctcaaactttgtcttacgccagccaaccgtaaacagacactgtctgcgcgtctctcttgcaagaacagctagctctcccatacatctctcctacgttggctgagatcgattgctgccacctacattggccgatatgtcaagccggaggtcacggtcgaggcagtcaggctcgtcgaggatcaccgacgagcaaatcagcgatcttgtatccaagttgcaggatctcctccccgaggctcgactccggagcaatgatagagtatgtaattctatgcactaaatggttaattgctccacaaattcccagtctaaataacagctcgaatttattctagttataatagattagcattattcaccgttcactctagctttgaccacattaagatgggggtagaacatgatcggttgttacacctactgccttggcaaaagaaaaatagcagcgcaagttgaatgctccttatttctaattcctaagcagaagttgaagatcatatgaactgatgttaccaatcgactaatcgactatgtcaaacaatccaagcatcgcatcattttgcattcctttttccttcaacaattgtaattaagcaccaaatctcaagagctgacagagaaatcttctcttctccaaatccaggtgccatcttcgagggttctgcaggagacttgcaactacatcaggagcttgcatcaggaggtcgacgacctgagcgagaggctgtcggagctgctggccacgtccgacatgagcagcgcgcaggcggcgatcatccgcagccttctgatgtagccgccggcggccgtcgtcgccacattgtcttttgctgctgggcaatcagcgcgcacacaccctcggaatgtttgtagcttagagagtgatcttaattagtactggaggagcagggattcctaattcactctacgttcataagtaatgtaatgttgttgtcatgtcatcttctaaaccagatcaatcttttttgtgtacttaatcaaaatccatcctgattcgtgcaaagttcatacagtaccattttttgtgtgttttttgctgctatgtgtacagtatagtaccaacctcgccggcttaggaattgccagcgagttgcctctttcggcgctggctgaatgtacacactgctgccccttttggcacaggaagattcttaggagttgtctttcagtttggcagcagggtgctttgctaatgccagattcctctctctctatttcctaagtatcttacaaatgcgagctctcaatttgtgcaagagcgacaaaagcgtcgcaattatcagtccatggccaactgattaatcatttaatcacaaacacttgctcggttgctccatattgtaccgtgtttgtcgcaaaaaaacaaaaatgccagtttgatttacactttggaagcacggtttccatatttgctaatgccaaatatctgtagtacagtactccctccgtccaaaaaaagataaaccctgggttttcgtgtccaactttaacggtccgtcttatatgaaatttttttataattcgtattttcattattgttagatgataaaacatgattaatattttatgcgtgacttgtctttttatttttttcataattttttcaaataagacggacggtcaaacgttaaacacggaaactagagtttgtttttttttggacggagggagtagtaattagtaaaccgtgccagcctagccgagcgtgtaacttaaaaattacattggccgttgaaaggatttcgttagctgcaaaaaaaaaaaacaaaaatgcctggttgatttaccctttggtcagtctgtgaagaaatatctggtagcagtaaaccgtgccagcctagccgagattgtaacttagagcagataggatagtagattattagtcaagctataaacatattttaataaaataaaagatgagagagaagagcagcgggttacagattatagcacggactccaagacacagtgtatgtatgacagataagattatatattaataatatagtaagcaactg

SEQ ID NO: 500 - DNA, 14874 bp, Oryza sativa
gtctggcgtggtcttcgacgcacgaaggctagccggcggagggcgccggtgcaggggtcccacatgtcggcggaggttgattggtggtggagcatcggtgtgttagctgtggtttcgcaggtggtaagcggtaggtgaaaacccagcccagccttgatggttaattccccctcctgagggcgttgtcgtgttgtctcgcccctcaagggtggttgccgggcgaaagcccagtcctggctcctttgagccttgacggacggcggcggcggttttccgtcgcttctcttcttgaagacgttgttttggcactctcttgctgtgtggcgatctcgtctgtgttcctttgttggtctagcggcggtcggtcacgcttagcggcggccggtccggtgctagccttctcccagacttgtgtttaggcgctgtcgatgtgtgggtggtggtatattttttctttttcctggtttcgaccctccagggttataatcttgtaattttttcctgctctatcaatagaacttcgcaccgtcttatacgaatcgttcaaaaaaaacatgtatatatatatagaggctggatatctacccattatctaataaaagaatcccttaaattttaagacatatataccacacgaaagtgtgtagctaggtatactgatagatagtattgcttcgatcgtatttattgattattttcactatctaaaaatacgcatttgcttcgtaaaaaaaatgaggaagagatgattaacacacgcaagatcatatcgtactatctagttgatgggactctgtatttgcatctgaattttttttcaccctctgttttttttaagaaaaaagtgacaaaagttttgtctcgtatatattgatagacaagggacttttcaccactgtatttgcatccatgtaagcacggttcaactgtcctggttagcttcttccacccgtgcgcgcgtgtgcatgcagcaggaggagaagcttcttcttcattagcttttacgtgtgggcttcattacatgttggctgttgtattcaagctaaaaccacgtcgtctcgtccatccagtcgtcaatcgattctctatataaagtccagacaggtcgatcgatcgttggggatagatatatcgtgcgagctttttctcgtctgccgcacacgtgttgtactatacccctttgttgggttctttgcctcatataaggttagaagaaggttagaagaggctagatataatcagcattgcagccttcgcgacaagttcagaagatatatggcaggaggcagtaagacgcggatccatgcctcgctcgtttccactctcctgctgctgctcccattggcgtctgcgatccacaggagcgacttcccggcgtcgttcctcttcggcacggccacctcctcgtatcaggtcggtttttctcgctccgtcgctcgcttcctcgccgatgattcattctctcgatgcagatatccagcggcagactcttggctggctggaatgctggatttttgtaggatctagaggccaccgacagtccgaaatggtggtgttctaaaagaactcttatcatgaacacttggataggagtagccgagtaacagtagcacacctacctgcaaggctgcaaccgctagaatctttaattggccctcaatttgttgtggcctcaatcttaggtgatgtttggatatagggaattaactttagtctctatatttagacactaatttagagtattaaatatagactacttacaaaactaattacctaaataaaagctactttgcgagacaaattttttaagcctaattaatccataattagagaatgtttactgtagcatcatataggctaatcatacattaattaggcttaatagattcgtctcgtgaattagtccaagattatggatgggctttattaatagtatacatttatatttataattagtgtccaaacatccaatgtgagtcctatctaaacagggacttagtagtaggtcccagtcctggcgtgtccttcaaaatagcagtaatcagtacgtactacctcaggttatataattctcgatattatgtggtattcaaaatatatcttttaatcttatttttatattaatatatatatatatatatatataataaattaatatatttctatttttattatagtactttgtatgacaaatctatatatgttgtttagtgtctctaaattagatatttttaaaatcattgattaaaaaatttgaatctcaattttgtttaaaatgtcaagaattatgaaatcatagggagtatttcagcgccgtagcgcccgttccgtcgtggcgcctagcgggaaaattatctcttaaaaaccctaattgtgaaatttgtttctttgcttgtcgtctagtgtccgtgccatcttaagatctcaaatccccgatctatcgtcaagttcatttccgaatccaatccttccaaatcaaatccctccgcaaaagtctattttgcctcacccggggtcgatgggccgaatctctctcggcccatctccccctcccctcccccgcagcgcgcgctctctctctctccctccctccccctcccctcccccgagcagcgctccctctctccctctcccccctccgctccgccgcgcgctgcgcgcacgtgcgcgtgagccgcccgcgccgagccgagccctcctcttcgctccctcgctgccgctccccgcgcgtcgttcgcgcgcgccacgcccgcgtggtcgtcgcccgcgtcgcgtctgcgccgcccggccccgctgccctgccgcgcctgcagccgctcggccccgcagccagcgcgcgtgcccgaaccgcgccactccatccgccgcgcctcccgttgcaagccgcgcgcgcgtgccgagtggccgaccgcctggtcgccgccgtcgtcagcgcctgcccgcgcctgtcgcccgtgtcgccgctccgctccacaccgccccgccgtcatcgccgtcgtcatcgcctcggccccgccactccgcgcgcaagccgccaagggacggaggctgagccctcctccctctaccgcgacgcccccgctcccctcctccttttcccaaagaagaaaggggcgagcccccctttctctccctccttttccccttttcctcccgccggcgttatcctccctccgccctgtcgccgattggacgcgagcgctgagcgccaactcgcgccttgaccgcccaagtcggttccaaaccgacattgccgcacttaaagcccaggcgccctccctctcttctcctcccatcgccattgttgccccttccgagctctgtctcgcctccgccgttcatcgccaagcgccgggagagccggtgcgttcgtggacgcggaaggggactccgggcgctcgtcttcctcctcttccccagcccgaggccggagagaatactcccgcgccgtcggcctctcgtcacagcgcccctcctcatctcggtagtgcctccctccgttcttcctcctcgctccatctctcccccttagttttcggtggtagcacgagtagcctccccgtagctagccggcgccgccccgaccgttgccgtcgctcgccgtgtgctccccgccgtcgccgcccaagctccgtagcacccgctcgtcgccggcctcgctcggcgtagctccgcccaatccgacgctagcaacggattcccgtagccgcgtagatgctctcaccgccgggaattggcccctcgtggcctcgtcgccatttccccctttgctctctgccggttgccgccgccgaaatccgccgcagacgggctccctccagcgaatccaagccgttggctcgctccctctccctcttcctcgtcatcccggtgtacgccccgtcgcccctcatcgtcgcaaggcgccccggagaaaccgccgccgcccgccgtccattcgcggccggcgccttcgtcttcctcccgccagcccacgtggcagccacgtaggcgccacgtcggcgctagctcagccgagatcgggtcgggccgaccccggccagcccctcccgtgcgcgcgttccaccgcgagccgtgaggctgcgcgtcggcccgccgcatccgttcctccgcggaccacgcgcgtgcaccgcgtccctccccagcccgcgcgcgtgcgccgcgtgctcgctccgcacggtgaaccgtgtcaccgacaagcgggtcccacccgggaccgcgcgcggtgagcccggtccaccggctctctctcctccctcccgcgcgcgcgaccgccttgggccggccggcccattaagctcggccggaccgccccaaattctctcgggccgcgccctaaccgccgaggaaaagtctatattccctccctcttttcttttcttttcttttcttttccaaaaaggatttaattaaatccttttcctttagaccaaaaatccaataatcttagaaattcaatatcttcccaaccgtgaatccgtttgactccgttcaacttccaaaattcctcaaatctcgagatctatctaatggcacgcttagaggtcattaatagggctttattttcaccgtttgttgagttgtcccgtttcgcgtgtagtttcggagcccgaagacccacagtgcgaggatttcgaggatcaagttccagatctcgagcaaggcaagccacctttgaacatcttgagcctatatttgaaatctaattatgttgcttgaaaaatattatgcattgataggaccgcacttaatctgttagtcccatctgcaaggcagattggcggacctacctagtttgttgcatttgatccttcctatgttaattgatatatcatgtccccttgtaaccatctagattgcgcctcgatattcgtgcaccctgtgcgagtatcgacggttgccttcaaacttaaaatctgaaaaacttcttgagtaaaacttgggttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgaagggatcagctaggcccgggtggccgtttgaaagttgttggcccggatggccgtttaaaagttgttggccgggtgccaaccttgaacaattttaaagactgatacatagcacaaactccgaccggacgagacgcactgtctcatccgtgtcgtttgagaagcactcacttagttgttttcagaaaagagttcaaataaaatcaattgcaaaaacaacagcctttccttgaagcctgcattaaacacttaattcccatggcttgctgagtactcccatactcacccttgctctatataaataatcccccccaagttgctgaaggagatgaagcggatccttctgatgaggagttctttcaggagcaagccggctacgatgagttttagggtttcggcctagttcccaagtcgcgcctgtgtcgtatggtccaagtcctggcttccgtttcccttttgtaatgcagttgtgagctcgggatctgtccgcagcccaacatgactgtacatctactctataataaagagacctctgttgctgtgatattctgtctccctgtgataccagcactgtttcctgggactggtatcgaataacaggttaatttggagcgtcacgggctagtttcggtcgggactagttcggggcgtgacaattaaatatagactacttacaaaactaattacctaaataaaagctactttgcgagacaaattttttaagcctaattaatccataattagagaatgtttactgtagcatcatataggctaatcatagattaattaggcttaatagattcgtctcgcgaattagtccaagattatagatgggctttattaatagtatacatttatatttataattagtgtctaaacatccaatgtgagtcccatctaaacagggacttagtagtaggtcccagtcctggcgtgtccttcaaaatagcagtaatcagtacgtactacctcaggttatataattctcgatattatgtggtattcaaaatatatcttttgatcttatttttatattaatatatatataataaattaatatatttctatttttattatagtactttgtatgacaaatatatatatgttgtttagtgtctctaaattagatatttttaaaatcattgattaaaaaatttgaatctcaattttgtttaaaatgtcaagaattatgaaatcatagggagtatttcagcgccgtagcgcctggtacaagcctcgtggagaagcaatagctagtccacgaggctcatacttcagcgccgcagcgcttggtactcgaacctcggtagtggggctggagttttgacctccttcagtctacaattttttttctcatacgagttaaagaagaggatataaggaaacactaagtggcacataattaattaaaatattagctatatttttttaaaaaaataaattaatatggttcttttcaagcaaattttatatagataatttttatgaaacatataccatttaacaacttgaaaaacgtgtgcatgagcaacgtgaaaatagaaataagaaaaatagagggaagaccacacagcttaatcacctaggtgaggctctagattaatgaagagggtaaagtgggaccgaattttaaacaggtcgtgtttttattactctctctgtcccaaattataacacatatatttttttacatgatctttaataatatactttgaccaatattttatttcattctatagtcccaacaaatatgaaattagcataacatgaaagtactttaaaatatgaatataatgatataacatgcataatacttattatatatatatatatatagttagtatgattattagttaaaagctacaaagtttgattttcttttaaaataggacagagggagggagtaatatttttctagacgagaggggttggagaagaaaactccgacccacttattaatgctcataatatatatatatatatatatatatatatacacggtgtaccgtactgagtacaatgtttttctttttgttttagattgaaggtgcatatctagaaggcaacaaaagtttaagcaattgggatgtgttcactcatctaccaggtatgttattaactctgattattgtacgtcatcttgtcatctataaaataaaataattaagccttactttctctgtcctataaaaaattaacctagtactaaatgtgacacatcataatactgcgtatatatacttctatccaggttggttatattagaatgtgtgtcacatttaatactagattcgttttttttataagacgggggagtacatctcttttgaggtgcccataatttccttgttggatgggcccaatttgaactgcagtatgggccttcccacgatggcccaggggatcgttgacttctaaattagacattaaaatactgataaaggaaattctgccgagataaggcccagtgaaatttcgaatttaatttctaggtagggaacgtataaaaacatgattttgatgagggatccgtacggaaagccgcaaaggatacgtgaacatcctatgaaaatccattcatttttactgcttatttggtgcacactactgcaagcgccagtcaaaaagaaaaaaacaccggaacgagcggtcatgtatatataaactgtatttttcgaggtaagaagtatatataaaatgtatgtgtttcaggaaatatcaaggatggaagcaacggagatatcgcggatgatcattatcaccgctacgaggtgcaatgcaattaagcaaacaccatattgaatttacaaatcctgtgcttgcctaaactgaaatggtactgaatatttcctctttacaggaggacgtcgagctgatgaactccctcggcgtaaatgcctatagattctcgatatcatggtccagaatccttccaagtgagttgagttgtttccatagctaagttttcccagctgaccaactctgactgaatacagtatcacctcaatcctttgcttaatacaaaattttcattatgcatttgctgagcatagaagggagatttggtggagtcaacccagcgggcattgatttctacaacaaacttatcgattcaattttactgaaaggtatcgatcgatcatcaccatgtgtccatgtgcattacaaattacaaattactacttcttcttcccatagtcccatatttcatctctgaatttaattcctgatacatctacccatacaaatttgatcacctttattttttgctggagcaggaatacagccatttgtcaccctgacacactacgacatcccacaggagctcgaagacagatacggagcttggctcaacgccgagatacagtacgacgcgcgaatatttccccaatcagacaacaaatgccatggattcgaatttttaaacctcgcattttgactggttggctggttgcgatcaagttgtgagatcttctttctgtgcattccaggtcggatttcgggcacttcgccgacgtctgcttcggcgcgttcggcgaccgcgtcaagtactggaccaccttcaacgagcccaacgtcgcggtgcggcatggctacatgctcggcacctacccgccgtcccgctgctcgccgccgttcggccactgcgcccgcggcggcgactcacacgccgagccctacgtcgccgcccacaacgtgatactctcccacgccaccgccatcgagatatacaagagaaagtaccaggttggtgatcgattcattcttggttggttgattattccgtcggcgtcagccatcaggtgcatcaccaattcaccatggacgccgacactcgacgtatacaccggggctttgcttgtggttgtggttgtgaacttgtgatgatgaacacagctaaattagcttattcgttgacacttcctctctttctttgctccgttgcgtgcagagcaagcagagaggaatgattggcatggtgttgtacagcacctggtacgagccgctgagagatgtccccgaggaccggcttgccaccgagcgagccttggcgttcgaaactccgtggtactactacgaattataagatcactcgctccattgcagtgattgaacgtgctcgtaaaaaaaatgtggatttgttctgaatcaacagaggttttcttccgatttttgcctgtatgtactcttgcaggtttcttgatccactggtctacggcgattacccaccggagatgcgccagattctcggcgggaggctgccgagtttctcgccggaggacaggaggaagctgcggtacaagctggacttcatcggggtgaaccactacacgaccctgtacgccagggactgcatgttctcagactgcccacaggggcaggagacgcagcacgcgctggcggctgtcactggagagagcaacgggcttcccattggaactccagttaagcatagtttcaataagaaatcaacatctatagatgcttcgaggggattcggagattaaaactccgaaccccttgagccatttttgtcctttaacgatgtcagggacggttggaaatttaggatttaaggggttaaagaatgtacttgcagacagcgatgcccactttctacgtggtaccggacgggattgagaagatggtcaagtacttcatgagaagatacaacaacctgccaatgttcatcacagaaaacggtacgacagaacagagtgactgaacagttgtactacccctactagttgtgcagttgctttttatttctgttccatttacatgttctgagaagatttgttgcgctgaaaaatgattcaggatacgcgcaaggtggagatagttacaccgacgcagaggattggattgatgacgaggataggatagagtacctggaaggctatctcacaaaacttgccaaagttatcaggtcagttggaatattgtgcatattgccaagtttatacatgtggatgtcaaatctatctatctatctatctattatattattaaaacagttttgaaaggaggcaccacgtttgctgtgaggactaaaaattcccacattaatcggagaaaaagaaaaaaaaagaaaatgagagtccaagtagaaatacaatctaaaaatagctgaaattcggaattaaaaaataagcaatattgaaagaagtttccatataagaacccaatacgagatttatcaaaattcaaaataaaaataaaataaaaaccaaaattagaaaaggaaagaaaagtccaagtagaaatacaatttaaaaatatctgaaattcggaattaaaaattagtaatattgaaagaagtttccatttaagaacccaatacgagattaatcaaaattcgaaataaaaataaattaaaagccaaaattagaaaaggaaatgcgagtccaagtaggaatacaatttaaaaatagctgaaattcggaattaaaaataaggaatattaaaagaacagtccatataagaacccaatatgagattaattaaaattcggaataaaaagaaaaataaatccgaaattaaggcaaaagaaaataaagaagagttcaagtaggaatacaatttaaaattagctgaaattcagaattaaaaataagcaatattgaaagaagaatccatataaggacccaatatgagattaattaaaatttcaaataaaaatttaataatatccaaaattagaaaaattaaaagagagttcaagtagaaatacaattttgaaacaactgaagttgaaaataagaaataaaaacattaaaagaacacaatatggtattaactaatttttttagaaaaaataaattctgaaattagataaaaaagatttcaaataggaataaaatttataaataactaaaatttgtgataaaaataaagactattgaaagaaaagaccatctaaaacacacgacgagataaattaagtaacaggcctataaataagtagagttggtggcggttgatatggcatataaaaattgttaatgaaacaccaaatagaatcctaatgacgattaaaaggagggacgtcatgtaggacgtgaagcaaacaagtaaagcggttgccgtgacttctagaaagtaaaaagaaaaaaaaccacattgataattatttttgatttttaaaatcttaatgacaataaaaaagagaagtagcgggcggggtgtataagagtacagttgcagagcctccgacggttgacgggacttccagaaaataaaaaataaattgcaacgatagttatgttcgatttttagaatcacaatgaaaataaagagtaggcggcggacgagggctgcagaggggcatagtggcatcgtttgatgggacttctaaaaattataaaaaataaaactacaagtccaatttttaaaggttcggaacttctaaaaagttaaaaaaaaacccaatgataatcatgttcgattttaaaatctcaatgaaaataaagaagggaggcagcaggcgagccgtagaggagcataatggcaaaaccgctgacggtatggcgggacttctagaaagtaaaaatgaacccaaactataattatgttcgatttttaaaatctcaatgacaataaagagaagagatagtggacgggagtataatggcaatgtttgacgggacatctagaaattataaaaacaaaacccaacgtgacaataaactctaaaaactataaaatccaagttttaaaggctccaagaataataaatagaaatagtgatagatcgagtaagcaaataaagaaggagatgacataagaggtagcaactggtgtgattttaaaaactatgtaattagaaacacgaggatgataaggtttggtcttttaaagtcttaacattgagatagctctttaataaattttaagtaaaattatacttaaaaaaatatatgatttttttctgctagccgcgcaaattgcgcgggctacccagctagttatattattaaagaaatagaaaaaagagcctccgcgttcgctctcgtggtctagaaattctcacattaatcgaagaaaaagaaaaaacagagtccatatagaaatacaattaggaaatagctgaagttcggaattaaaaaataaggaatatcagaagaggagactagagtccatataaaaatataattaggaaataactgaaattcagaattaaaaataaggaatattaaaagtagagtatagagtccatatagaaatacaattatgaaataactgaaattcggaattaaaaataaggaatattagaagtagagtataaagtccatataggaatttaaaaataactaaaatttggaataaacataataaaattaaaattagagtttagagtccgtataaaaatacaacttataaataactaaaaattcaaaattaagaaaagcatgggaataagagtttaaagtcaatataggaatacagtttagaagtaactgaaatttgaaattaaaaattaaagaatattgaaagatgagtttagagtccacatagaaatacaattagaaataataaaaattcagaaataaaaataaataatattagaagaagagcatagagtctatatagaaatacaatttacaaaaaattcggaattaaaaaaaatattaaaagtcgagtctagagaccatataggaatatatataatttacaaataactaaaatttgatattaaaaataattaataactaacacgtatataaaatacaatatgaatattacacattaatagttttgtaaagttattgcaaaatttaaaatcatgttgtcattttaatatatttgaataatataatgagaaaacatatatgctattatatgagagaaaatataatgatgctaaccgcataatatgcgcaattgaggctcacatgctttgctactagggacggagctgatgttcgtggctacttcgcctggtccgtcgttgacaatttcgagtggttgtttgggtacacccttcgatttggactgtactacatagactacagaacacaggaaagatctccaaagctatctgcgctgtggtacaaggaattcctccaaaatctgcatgaaaatcaatagataaagttgtactttcgaatttaaatagggtgtaaaatgatagtaattcgtgtaatgatgtaactgtagtactgtacattagtacataatgttgattagaatggatacatgatatccacctatatatatccaatttattggacaatttactgtaaactatcaaatttaaaaaatgtggttcgacgtgcctaataaatttagctaatacatactccaatacggagtatatatttttcatgtaacttattttattatatggagaatgtccatcgtcgagtaccctatccaatatgaaaaatcggacttctgatccaacacaaaaacggggcacccttccactccttgctgcatgcggcacatgcatcaccttcctcacacccaccctttcatcatgcactgcctttctcccacctatagatgactctcttttctcctccacatactcttctctacatgtttgcagttcttaagtaccaaatctcaaatgatttttattgaactttttttcgaccataccattgtatttgttagaataaatctttataacaagatctcgcataattatattctgataaaaatatatgtgcttcaaccgttaagattcgatgtttcatgtgaaaaaaagtgaatgttttaagtggaattgtgatgttgcatattttaggttttcttttaaaaaaattttctgatgtttcaagtttggactcgatgttttatgtagaggttgttagtgttgtggtaaaatttttaagtttagacacatgcacttatataaatgagaaaattccatgtgtactattaaaactttgcccctataaatacgcaaccttcgaaaattggaccatcataatatagtgtattcctcactactgaaagaatagttatccataaacacaagcatctgtatcgagtttatgactacttaacccggatagaaagatttcactttaagaaaccaaaccaattaagtttattttttattttttaaaaaataagtttatttttaaatattgccttttttgaaatattttatcaagtgagttgaaatattgtattaagtgataaaatatttttttagaagcgatggaacaatgtgtacccgatttaaagtcatcccggacttatcaatttcgattagagatgacaatctcttcttacaagtgtaatagtataacaatttaaattaccaaagggaaacttattcccttggttgtagggcatacatgcgcttatctaa

SEQ ID NO: 501 - DNA, 3447 bp, Oryza sativa
agaaacatattttcatgtcttaaatcctaattatagaatcctaagaagaaatttaggggattaaattttgggtaactcttgacaatgctctaagaatacatccacgatataactaaaaataatttcagggcaaaacattatacttttagtaaaaaaaaaaatctaaaatgagtcttaacaatggaagccgaaaaaaaagttatacttcaatgtcagctatgatttactaccttcgttctcatatagatattgtcctaaaatacatataggcacatatcgaaaccttaaataattaattaaaataaaaattaagatttgacatgagaaaatgatatacataacaaaaattttaatgtggttatatttttaatagattttataaacatatagtaagaaaacatagaacttaaatatttgcaaaacatagaacttaaatatttgcattggaggctacattgatgtccaaaatgactagtaaaatgaagggaggtagattaggctttgttctatacaacattttcccaacttctccttcctcattttccacatgtacacttacggaattactaaacggtatgtttttttaaaagaaattctataggaaagttgattttaaaaatcatattatctatttttttaaaaaaattttactaatacttaattaatcatatgttaatctactttttcgtttttttactaatacttaattaatcataccaacctcccgaaactgaaatagataaaaaaaaagaaaaaaaatatcctatttggccataggccatagcggctaaaccaggtgggccatgggggcgcatccagtgtgattgtgtgaagagccagagaggaacatgtgggcccggccccccatctctcctttcttcgcaacaggcaggcagcaagctgcaagcttgatctggcacgggtgtctttgctcatcacatcgtcgatcgtcttagttaatcatttttcttagctagctcgatctcgcctcgcctcctccgggcctccagcgaaagtaatcaatcagattcagatcgatcagcagcagcagcagcagcagcagcatccgctcccatacatgtcgatctctcactataaataacctgccccctctccctttctgcttcaattcctacctcacacttctgcaacaagctttagctccagccaccggaacgagagatcgatacagctcgatcagctagccgcattcgccctcgccgccgccgacgatgtcgagccggaggtcgtcgcgctcctccgtgtcggaggaggagatcaacgagctcatctccaagctccagtccctcctccccagctcccgccgccgcggcgccaaccaggtactacatttcaccgttctcatcaccacaagttcacataaccaccatgcacactagcggcatgaacaagctagctacatgagtgatcgacgatgtgtagatttgtcggggttctaaatcttcggctacagctgtttgagaagggtctagctatttaaccactatagagggtctgccgttaaatgtgttagcccgctatttaaaactctctaattaattattgttgttaatggcggatgcaaaataaaatgcaggcgtcgacgacgaagctgctgaaggagacgtgcagctacatcaagagcctgcaccgggaggtggacgacctcagcgacaggctctccgacctcatggccggcatggatcacaacagcccaggcgccgagatcatccgcagcctcctccgctagctcatctcttctcatctgttcttcctcctcgatgatcgatcgatctcgtgttattctacgtacatgaaggatgatatgaatgcagctcgtgccctgtagctacgtataaatatacacatatgtatacatgcatacagtacatgatatgcatatgcctagatctgatctagctcagtagaaaatctactcatctcggtgtactactgatgatgatgatgattaaggcatgcagctggcttgatgatcggtactactactactacttcacttcagttcagtaggggcattagctagctagctagggccggctgcctaattaagtaattaagtaatttattatttgtagtagccagcttgatctcatctctcctcatgagccatatgacatgtggttaagttaattaatccttgatgcagtagagtcgtcccagctgtttcatcgatgatcgtcgtcatatgtgtgtatctcttgatctagctttgctgatctcctcttgtttcatttcctctttgttcttttcatgtgtttttctgtgagcttaattattgttgttttggcggttttggatcgagttgttttcctccagacaaccgaccgaccgctagctacccatcgatacaccgccatcagcgcatgtactactgtgtctgaaactctgaatcaatctaatcgaatttttgtgctgcgtacatgacacattctgagtatcattataccatgtgattagtcattactactgctcgatcgcttgaacacacacattaaaagccaatcgaaatcagaagaattatggtgttcacaccgttacgtttgtcctcgcgcgagtatgacctccagcccagaagatgtggaagctagctatttcttttcgtgccaaataacgacgatgctgattgatcggacactttaatttctatatagattgggttaatttgcaaccgtacggtagatgagatcaagtggctgcctgtgtggaaaagggaagaggaattgaccggccattggtgcaggactgcaggctgccagtgcactagttgtctactgctacatccgtctcgtaatataaagaattttttggctatacgacagagttagtacttgcccgctatatgttacactacggttacggttatttgcacgtgtcgttttgttctggcgaaagaaatgaaccgtttaaaaataagaaagttcgcaacaacggtgaccttttcgcgctggttgttattgttgttattattgttgttgccgttattgttatagtcgttattattgtttagcaatgtgcgtgtggactagactatgccgccttcttctgtacgtgatggggagcaggcacgcatgttatgatgttaccatcttcttttgctctcatctgtactgtatacgtgatggagagcaaagcatatgcatgttaggatgttaccatcaacggccacacaaaacgccagtacgttaattgacaggatggccgacaatgccgtcgtgttttcaactgtcgacgttttcaatttttgggccttttacacaatttttaagggtgttttccgatgatcatgttagagcaagtacaatagcaggctataagtcagctataactacatatcgagaagtaaagagaagagagaggaaaaaacgggttatagatttatagataactattgtatgaatgggctattaaattagctatagatgattt

SEQ ID NO: 502 - DNA, 6855 bp, Oryza sativa
cccattagtagtttcgtaaagttattgcaaaatttaaaattatattgtcaatttaatatatttgaacaatatattgagaaaacatatatgctattatatgagagaaaatataatagttcatagtgaattgtgaacactgatttaaaaacaaacagattaacaaccacatcgtttggcttattcgtggaataagctaaacggcatatttgcaaacgaaaagtaatttgtgaataaaatttttatatacgtgttcttagcaatctaaaatcaaagagtgaaaaataaacttcgatgaaaaaaacccaaaatcagcttcaaatttaaagttaaaaatttaagtttagctgataagtataagtataaacgaaaagatgatgccgtaattttctagacatgaaagatcaatagaacggattgacattttcgtaatggcctgtagatagagatataagccacgagaaggagcagtgctgctctcttctttacaagctaacttcagtgtttttatacatgaaaaatcgaattgatatctttgggttggttcggattgataacgatctccattcaacttttgctttttgtttcccaatacgttatagatggctttgtgctccatgcggtgaccatgttaggaaaaaaaagtatatggatttaggcttgtttgagctccagcttataaatcagagccaatatgaagacaaatcccaatatatatatatatatatatatatatatatatatatatatatatatatatatatatatcaaaaacatgagagaaacatgcaggtcacggacgtcccagggcacaaataatgttaggtcgtccacacagtaatgcggcccgcccgggcctgccattcttctgcccttttgtccgactcagcaatctttgaaatctcaacgcttaggggaaaaaaaacagcgtcttttccataatgcatctcttcaccttcgcagtataaataggaccccctctcctctgctcctgctcatcctcctctcctcttctcgctctcacttcttgtgcccaagtgtgagagcaatgggagttcttggtagtagggtcgcttgggcatggctggtccagctgctgctgctccagcagctcgccggagcgtcgcacgtcgtctacgacgacctcgagctgcaggcggctgctaccacagcggacggcgtgccgccgtccatcgtcgactctgagctccggactgggtatcacttccagccacccaagaactggatcaatggtaatgtgaactaactgaaatgttgccaacttgccattgttcatgccagaacgccggtcaggccgtatgatttgcaggtcatagggcaccacttgtggttgtggatactggatagatgagcaaagggaacagagtgctctgttcttgagaattgagacgcagaatcgtgcagagtaactagtacagttttgacgacgttgttgtgtagaacatcacctgaactaaatggctcaacttgagtaatttatagtcagagttgaaaatattgacatcatagtcatatcaaatgtttggcacacaacataaattacggacagtacactaaggcatcagtttttatgtccattttgtcgggtcagctagtagagtcaacgttagcacccacgcggtcacgctgaaagaagtagcttcagaagcatctcacagtaaactactgagagtttgccatctctttttcatgaagctcacacttagtcccttcgaactgttaacagatgtactaccttgttctacttttcttgctaatgattcttgtgacaaggcttagtcctaaccggcaattttcttgtgcaattatttggtgggggtgtgctctgctctacactgtgattgctgctgcgtcatcaacattggaaacccgcagatccgaacggtacgtcgttttcccaccctttataatatatcctgtcacgaatctctgtctactagtagtagtagtagtagtactagaacttttatgccttgcaacttgcaatttcgttgtacgggagaggactgtagttagtgacgcctttcatggtaggattaaaggttcaaagcacattttagcacgaaaatggtaggcgcactgggactccacatgcaggcttgcttgtcgaccgtggggtacctagcccctaccacggctgatgaccacaaagttcagaaaatcttaacttcctctcagaaagggaattagccaaaagttcacctttttctcgtacgaaatgaagcatctatagttctataattaatcgtgagcagtgtagagaaaaatgcaatgtacacgcgcgattaaactgaaatggtaattgatttcaatgtactactaagactgaagatcatttcttgatttggtgaaactgaacgggtgcatgcagcgccgatgtactacaaggggtggtaccatctgttctaccagtacaaccccaagggcgccgtgtgggggaacatcgtgtgggcgcactcagtgtcacgtgacctcatcaactgggtggcgctcaagccggccatcgagcccagcatcagggccgacaagtacggctgctggtcggggtcggcgacgatgatggccgacgggacgccggtgatcatgtacaccggcgtcaaccgccccgacgtcaactaccaggtgcagaacgtggcgctgccgaggaacgggtcggacccgctgctgcgcgagtgggtgaagcccggccacaacccggtgatcgtgcccgagggcggcatcaacgcgacgcagttccgcgacccgaccaccgcgtggcgcggggccgacggccactggcggctgctcgtcggcagcctcgcggggcagtcccgcggcgtggcgtacgtgtaccggagcagggacttccggcggtggacgcgcgcggcgcagccgctgcactcggcgcccacggggatgtgggagtgcccggacttctacccggtcaccgcggacggccgccgcgagggcgtcgacacctcgtccgccgtcgtcgacgccgccgcctcggcgcgcgtcaagtacgtgctcaagaacagcctcgacctgcgccggtacgactactacaccgtcggaacgtacgaccggaaggccgagcggtacgtgccggacgaccccgccggcgacgagcaccacatccgctacgactacggcaacttctacgcctccaagacgttctacgacccggcgaagcgccgccgcatcctctggggatgggccaacgagtccgacaccgccgccgacgacgtggccaagggctgggccggaatccaggtaattaaccgcacgtcctgactgcatacgtgcatgccatttacgtgtccaccatgcatgctgccatcttcagatagtcaatatcaccatatactccctccgttctaaaatgtttaacaccattgactttttagcacatgtttgaccgttcgtcttattaaaaaaatatgaaatatataaaactatatgtatacataaaagtatatttaacaatgaatcaaatgatatgaaaagaacaaataattacttaaattttttgaataagacgaatggtgtcaagtattttgaaaaaagagagtatatcttaaaagtcaaatggaacaacactagcagctcaattttgctggtaatctttgattgaatcgtgtgtttgtgatgtgatgttttaggcgattccgaggaaagtgtggctggacccaagtgggaagcaactgttgcagtggccaatcgaggaggtcgagaggctgagagggaagtggccggtcattctcaaggacagggtggtcaagccaggggaacacgtcgaggtgaccgggctacaaactgcacaggtattcctttttgcatctgtaattctgtaaaactattttttttaccccaaaagggcattcgaataaaactgctcacacatccatggttctgtgcatgacagtagtaattattaataagttatcctgtttgttttgctgtgtcctggaccgatctttatcttatctggcacgcctgaagttgtgtccagtgtgcagtgcccactgaacaccacctactacgtgtgccgtgtcgctttcttctcgtccccttttaccatctcctgcacactttgctcgtacttaactgatctcactgattctctcgtcatccgcgcatgtcacgtacaacttccaggttgcagcgtgattagtgcacatatcactaagacactaaacaacataattagagagatagttaaggagctcaattaatgtgctttgttggtgacgtacgtgagtaggagctgtgatctctgatagcaagtttaatagtatagctaactactggctctaaattatctatagtcaatctaataataaattcatataatagttacctataaacatatactaaataattaatacatggttccacatgtcatacacatatgcatcttaaagtccgtactataatttgctgtaaatctatagcttgttgtttttctctctcctcttttatctcctcgatcgaaatgtgtttatagctggcttatagtgtgctattgtccctggtctgatgaagtgatcatgcattctgtttggtggggtgcaggctgacgtggaggtgagcttcgaggtggggagcctggaggcggcggagcggctggacccggcgatggcgtacgacgcgcagcggctgtgcagcgcgcggggcgccgacgcgaggggcggcgtggggccgttcggcctgtgggtgctcgcgtccgcggggctggaggagaagaccgccgtgttcttcagggtgttcaggccggcggcgcgcggcggcggcgccggcaagcccgtcgtgctcatgtgcaccgaccccaccaagtacgtgcggcttttgcactttatcggtgattgatcgcactacacaataaacaaaatattgccttgactccgtttactgattttttggtatggtgcgtatgcgtgcaggtcatcgcgcaacccgaacatgtaccagccgacgtttgcagggttcgttgacacggacatcaccaacgggaagatatctctgaggagcctggtacgtaataggaccaaattatcgggaaaaaaggaaaatgttgcatgacggtatcccgttcggataaaattatacctcttaaatattgtccgatacctaataaatattaattggctaataaactatttgaatgggatgatatctttgaggtatcgtctgatacctatctgataggtacctcataggtatcacctcgtccgaacgggttactgttttataacattcatctggaaaaggttcataaattgtagaatatgttttgatatcttgtgtctctcttgtgcagatcgacaggtcggttgttgagagcttcggggctggaggaaaggcgtgcatcctgtcgagggtgtacccgtcgctggccatcggcaagaacgcgcgcctttacgttttcaataacgggaaggcggagatcaaggtgtcgcagctcaccgcgtgggagatgaagaagccggtcatgatgaatggagcctaaacaatatttgaaattgagagagatagatgcaatgcatgatgagaactaccttcagtagctagctagatttttgagtttcagcggaaaagaaaaaactgattgcccttaattatgtgctaaatcatgcccccttgtgtaaaatggtttcagtcacacgtgtcgtatgcatatgtaccaaggggacagtttgaatgcatggatgccattaggactaataaagattgatgctagtataacccatgagtgcgcactggtgttagatgcactccggttgctttatttgtcttaagatatcatctttcaatgcatagaccagaccactgatataccagaatatctgaattttttttatgtgtaagtgtaatcactggatttgtcccaaaaacctaattgcattttcaaaatttctttctggataacgacttaatagtttctagaaatttgcaattacgaaagaaaaataattgtcaaatgtgtgtacaatcatcctgataggctcccccccccatatgagcggaaccagttgagttgacgaacgaaattacggttagtgcggggggaaatggaaaaagtttatgtaccaggaaacactgtgaaccgaacatataaatcccccaactttacaagatcgttcattcactgctaaaatagttttgcaatgtgtttttttatttaatttgcatatagattggacaagcttgactatgtgacatacacattggacatgtgtgtgtcaaaatctctacttattattttcccacttgttctttctcacctacaaataaatactaatataatactcgtatgatcttactgtagagcataaattaaggaccaaggattgacaatgtgtaaatgtgttatgttagttatttaaaaccattcatttaaacatccaaatacgcaccatcactgtctacatcaatgtaggggtaatataatcagtatttcaaattttaaagggtaagatgttcggttttaaaatttgtggtgttaaaaggactttcattcaaagattaagggggtatatagactgtttgaaaatacacacagagataaatttatcatcgatcactggcaagttccatcaaaggactctagttctttttctcaaaaggtgaacatgagatcacctgactgcaacatagttaggtatatgggctattgtgcgactgaaagttaacaaccataccaaaagatcagggcaaggtaagatatgagattagataacgttctttcaataaggaaaaaaagatgtcatttgatcagacatctatcttgtgaaagccaacggttttttttaaaaaaaatggccagcgcgtgaagtgcaatacaaatggcaacataca

SEQ ID NO: 503 - DNA, 5874 bp, Oryza sativa
cttttttttttcaaattaaaaaatatgtttttaaacattatttactttaccaaatcaaaacgctggcgaatagtttcatactagccagttagcgtgctaccctttttgtgacaatttagcataacaagatgcccgtttgcaggacgttcccattgttctagctgaacacaggaagaaggcaaatcatggcagcaatatcttgtcatttatcaggaaaggtagacggcatgcgtaagagccaaaagcgccaccggaatagctcgagactggatatatgcacgcatactttaatgaattcagtattgattggcaacaatgtacaacctaatatcactgaatccccaatttctgtcaaaccagtgtccattgaccatcatgtatgtttagctttgcatttgtgccagcagtaaattcggcccgatcatcctgaacatgtaacaaacttgaaggatcgagcagtaatatctgcttggaaagctagtttttcttcccctctacaaactctcaatatcatgtaacaaactttaatctgtctccttattatcaatgacaaagattcaggtgaggaatctctcccctccgatgacttcgtaaaaaggaaacctgaacacgaattcagcaaattctgcatcatcaaggaaaaatacatgtacgttcagtacttcagggcatcttttcctttgtgcttgagaaatcaactcccgaatcccgatatatcatatatatacatgcagtaattctcataacggtgtgaatcaactctcgtactgtactgtggcgtgctactactagtagtagtataaaggaatttcgctttttacgcgacattcttgagggtagctggcccatcataggactaattaaaagcactcgcataactactaattaagtagtaagctcctgccacaagctatgccaattcgatgagcccgctcaacatcatatcgatcgaccggctcacgcatttcattcaagaagcaccgtccggttgcatgaacgccccgcgccgcgcgtacgtagataactaccattcaaatccctaactgcctgtctgccatttctctccatctcggtctgtaaaatgccatgtatctagtaccagtagaacagttgtactacctcctgatggtctcacgtaacttctttgttccctttctcttcaattacgccattgccgtcttgcccggtcgatcaaccctagctttctaagccctacaaaagacagcatccatctgctagtgttagcttagccttcagagttcagagagagatggggaccaaccggccgcggccacgaaccaaggacttcttcgcagctccggcgctctccctcacactggttcgtcacatcgttctatcgacggcccgatctttatgtagatcattttgtctgaaattttcacctaatcacctgtgtgcttgtttgtgtttatgtacgtgcgtaggcaggcgtgttcggccggaaaaatggacctgcggcgtcgggtggagacggggtggaggaaggcgacgaggaggtgcaggctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgtgagaatttcctccatttctgttgcgtgaatatcagcgtcaggtgtttcctgtcccctgggccgcgggtgaaaggggtgcttcaccaggcccatggatcagatagggccaggcccagaaaggatgaacttgcatgagagggagatttttttagtttaagcaagcgttccagtagttcctcaatgatctgacatgaaaatatttttcaaaatggaattttgttctgaatcggttgaatgagcaggctattcaaagagtccccacatccggatgagaggcagcggcagcaggtcagtaagcagctcggcctctctgcacgccaggtcaagttctggtttcagaaccgacgaactcagatcaaggttaattactagcgctcagtcttaactataccagtgtgctcgtcccaccgatcaacagcaaacagcaaatgaatcatgaatgcatggggattttgatctgtgcaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcccgtcctttccggtgcgctacactgcaagacactgactccggcgaactggcgatgttgaacttgtttcagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggtatgtgcatggcgatatgccgatattgtgaacacacggacactagctcatacatgcatacaccttgcatgatttttttttttgtgcaggacaagtggaaggacctattccctaccatgatctcaaaggcagcgacgctggaaatgatcagcaaccgcgaagacgatggccgagacggcgtcctgcaactggtgacccgtcttgtgtctctctgcttctgaccgacgaaattcatagtgctaaacgtgtcataccttgctcgatatggtttccagatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaaggtatatacgtagaacacagtatggttcaagctggcgtacggccgtttcaactttcaaccaaatctctgcaccgtggtttgactagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggtaaaaccattactgacacgtcgcatgcagcgccgcgtgatccatcatcatccatggccgtctcacggatctctcccgtacacaggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagaggtgagccgccgctgcgcgcatttcaacttaccctgcatgcacattatgcacactctgactcactaatcaaattgttgtagtgggacgtgatgctacccggaaaatctgttcagagccgcgtgaatcttgcaaaggggaaggaccgtaccaactgcgtcaccgcctacgtaagctaaccttccctggcagctacatgtgcatctcgtcgacacgtacattattgctttccttcggatggatgaactgcaggccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctagtccacgggacgcggaaatattctactcctacttcggattcgttattcgtatgatactccacgactccacgtgaccatgtttgcaaagtaaatttgcatcgtgacttaccatgaacataagtgtacagctaaagggatactcgtactatagaactacacggtactgtaaagtcaacaattaagcgttaaaaatcccccgtcttgcagacttctttatggtcaccgcaactagcagagagccgtgccatgggcggtttcttggaactcgatcatatccgttgcaatggaacgcaacaaaacgtaaagaccagcccaagacgtaatgatatcacgtctccacaccgatgacgttgggccgctgcgtcggtgagcccgtatcatcttctacaaatccgaccaccgcgtcgctcctgctcggcacgtcgtcgccgccgcttcccaaatcccttctccctctcaacaattttgcgtgcagcgctggtagcaacagtgcacaactaggctggtcaaaggtgtgcacggtggtgaagacaggatttagtgatagggggtgctggctacgagatgtaagaactcaccagctcctcggtaaacctctcggtagacaatggtgtggatcttgatggctcagttcatgctgagtagcagattggcctcacctcacctcttgttcgctctaatatgcgtagtcgccaaaagaatcattttttaaaattaggcaactaaatagcaccaattttacaaaatacatgaatgacaagacatcatttctattcatcctttttagttttggagacttgcaaccacatcgcttagttacgttaactcaggtaatcacgtaaagctaaaatctattggtcagttatgtataggctcaacttgcaactaactaatgagttaattgtatggattagatgcctaatcacccggggggtttgcagtgcatggggatgggggtgtcaggcccaccccggcacccccggtggcttcgccactgggtgtgcacacgaaaataaaaactcaaacacaataaaaattcgtctaaaagcaggataaaaagagataaaaaaagagagagaaaagcaacggactgcagaactatagccagctgcagcatgaactccaatacgtaatgtgcgtatgacaggtgggaccaggtatctatctattatataattaaaggaatagaaaaag

SEQ ID NO: 504 - DNA, 6546 bp, Oryza sativa
taaaagtaggcaaggaccccacttgtcatacagtaagggctcatttgaatcgcaggaatgaaaaaacacaggattctgataggaatacaattgtaaaacagagaatttgtaaaacacaggaaaaacacaggaatggccgtttgattggaccacagaaaaaacataggaatctgatgggagagatagatagactcagaggaaatgttccaagaggttagacctcttgctaactttcctccaaaatatgcataagattacccattccatagaaattttaaaggattggataggattcaatcctttgtttcaaagaccttcgtaggatttttttttccataggattgaaatcctccaaaattcctacattttttctacaaatcaaaggtgccataaatccaccctggtatacatgacactgaaagtatatattaattatatgatagcaatagattttctatcgttttctttacaatgtcatggaggttgaactttcaactaaagtgatattacctcgtcaaagaaaaagtgatatcacctccatctcaaaatattgcaacccggatctggacagatatctagatttattatagtaggaacaaattacatcctaaattacaatattttggaatggaggaagtaataagagtaatttgaaagtgtgtggaaaaggaaactttagctctttatgtgcggaacgcagcctaactacctaagtagacactacaggaatattggcacgcatgttcaaaaaataataaatatggtacctgtgaaaaacagacttttaatagacaatgagagagataggtaactgagtcatctctaatttctaactcccatggaattactagagaagccaaacaaactgcctctaatgtcaatcagtttcgctttccatccttctcatgctgtcaatttatcagtcaatcacactacaaaattaacataatctcttttttttttcttcaccatggacgatggatatatagatagatagatatatttatccgagtcctccaagaacaccaaacgagaagctccaagctcgcaataattcaccaagaatcgcaccacttttcaccttttcttctcctcctccatttccatccatggcgacgctgctgctgctgctgcacacggcgcaacagtgagctatagctagagctcggcaccacgggttagcaatggcggtggcggcggcggcggcggcgaggcggcgagatgtctcttgtcttctcctcctcctgtgcttcagctcgtcaatggcggcgaccggcggcggcggcggcggcggcgagcaggaggctgacagggtggcgcggctcccggggcagccggcgagccccgccgtgtcgcagttcgccggctacgtcggcgtcgacgagcggcacggcagggcgctgttctactggttcttcgaggcgcaggcgtcgccggcgccggagaagaagccgctgctcctctggctcaatggaggtctcgatcgcttctgctttttttttttctaaaaaaaaagaatttgctgcagtaaaagctctgttaaatgttaatcggttaaaaattctgttagttaagtaagtaattactcctagtaaaaactacagtttctgtttgttcttttgtgtgtgcgatatgaaaaattcagatattttctcttgggtatttgttctgtggagtacttgtcgtttatgtttgtttagttttgagatgaggtttcaggttaaatttgtgatcattggttaatctgaacttctgaagagctgcttattgattttttttctttcaactgatcatattgcataaatataaataaataaatgattgttgcatgcaacatttatgttctttcttgatggttaattaggaatatttttttttctaaatggtttgttaattttgttcttggttttgtcaggacctggttgctcttccattggctatggtgctgcatcagagctagggcctctcagagttgcaagacaaggagcagcactagagttcaaccagtatggctggaacaaaggtgcagagtttattttgtttcctttaattcctgaattatttaaatatttttcatgcttaacatcactgacatttgtctttagtataattctgaaaacattttttttgtgctataaaattggtctttgccagaggctaacctcctgttcttggagtctcctgttggggtcggcttctcctacaccaacacatcctctgacctctccaatcttaatgatgattttgtaggtaattaagctgattgtaaaatgatactctagtttgcttggccatctacaggtgatctgaatttcgattgccttgtaataatgattagaagtgtaattttgtggcatcctttttttttttgttgcagctgaggatgcttatagtttcctggtgaactggttcaagagatttcctcagtacaaggacaatgagttctacatctcaggggagagctatgcaggtaaactcatttcagaaatgaaaccggtaaattttctaatcagttttgtatggtctaacattcagaattcttcattttcatcaagaaattaaaagatttcctaaccgcaacatattacaaaatctggtgtgagacatttttctcatttgttctcatgtggatgtaaacatgtccaagatgccttcctttcaagattccagttatctaatcaaaatggaaggcagcatcccaatccttgaccaaaattttcttatcgtttgctttcacaatatctcaaggattgtatgtatcgaattatgttagtgtcaccatcttatctgaaaccagaacttccactgaagaaaaaaatcatcactgactttatagaactagctgacacctatcatgagttcatgacagctcttagttcagcaatcatccccttagcaagcaaacaaaagatcatacttttaatggtgaaagtgtcagatcaggaaccaagtctctaaaataatataaggtttagtttcagccttctcaaatattcctgaagtacaatattctcagagtcatctgattgttcagaattcagaagaaatttatgtagaattcagtaaaagatgacctgcttaaacaaaaggtagaatgatttcagttgttacttgcatttatgtattgaggacagaaattataccgatgccatccgaactgatagattttctctgcttgaaacaaagtttgagtttttggattgtaatattggtccattagatctctgaacatatgtccctgaaagaatgaccaaagcatcagtggtaggttcacgggctacattgggcttctttcacaatccacatgctgtggaccagaagatgctctgcaaaaaaagcttttgttctgcacatcatgcaagatgaatctcaatctgaacttttcctgtgcaatgtccctgttatacaggtcactatgtgccccaacttgctgaccttgtctatgagaggaacaaagacaaaagggccagcacatatatcaacctcaaggggttcattgtgagaatttcttgaattgctttcagtaattattgttatggttttgccaaaaagttcttttatgtgaaatgtgctcatgtataagaaaccatatacaaacttagaaagtagaaagaactgtttactctcaccgtttcatattgcttgtcattttagctttgtcttaagtcaaacattccttacaacttacgccataaacttttactcataagatttatgtttttagattgaacaaaagaaatactttcataatatataattcacatgttcttaaactatatgaatttacagaaattgatggtcaaagttaggtatattcgacttaggacaaaactaaaacgacaagtaatttgaaacggagggagtattttgaacaatagtttctcagttgtaatgctcacaggaacacccaattggaacacgattaacttccatttaaaccatcctaaactcataaaattggttcctgcatgaacataacagtcaaaaaatctgcttgcaggtaggcaaccctctcaccgatgattactatgattcaaaaggtttggctgagtatgcctggagccatgcaattgtgtcggatcaagtttacgagcgcatcaagaaaacttgcaacttcaagaactccaactggactgacgattgcaatgctgcaatgaacataatcttcagtcagtacaatcagatagatatatacaacatttatgccccaaagtgccttctaaacagtacttcagcatcttcacctgatcgtgcattcttcgcaaataaccaggtaaaactgatccatatgcaaaaaaaaggataaagtttcattctggaccctcttctgaaattcatgcatttctgtgttttgacaggaacaattcaggtggagaatcaagatgttttcaggctatgatccatgctactcatcctatgctgaggactacttcaataagcatgatgtgcaagaagcattccatgcaaatgccagtggactgcttccagggaagtggcaagtttgcaggtgaattagcccaaagatttttcagttttatatttcaatgtattagccattaattcttttagcttgacaggaagctgagctcatccatttctttttgcagtgaccaaatcctcaactcttacaatttctcagtactttccatcctacctatatactccaagctcatcaaagcagggctgagagtttggctctacaggtttgcctcatcttaatcttagacctgttcaattaaatccatttttcagttttttttatcattcacctcagatcttccccattatcctccatactacagttcttgtacagtttctctgaaaccttgaaattactgttcaaatatattggtagtaatatgcatctacataaaaaatatgcaacaatgccctacaatttacctgaatcagtctctgttcatcaaagcagcggtgatgctgacggcagggtcccggttatcagttctcggtactgcgtggaagcactcggcctaccgatcaagaccgattggcaatcttggtaccttgacaagcaggtctgcaaaccagaagctgaactgaacatcaatacatcatgtgatttgacttgtatacatgctgaaacatggagcaaaatatttcaatttgcaggttgctgggaggtttgtggagtaccatggaatgacaatggtgactgtcagaggggcaggtcacctggttcccctcaacaaacctgctgaagggcttatgctgataaatgcattccttcatggtgagaagcttccgacaagcagatgatatgcgctgctgatgaagctttggaggtacaagatggcatgagatacaggcatggacatcaattttcattgaaaggcgccaatcggatagatttgatatggtagtatccaaatcaatttcaagtgcgccgtaaattcagtactctgttgaacattcttttaaatctgttgttgactatgactttcttcttttgtgttttttttactcaccttttccatattataagtcgttttgggtttgtcctataatcaaactttttaagtctgacagtttatagaaaaataaagtaacattttcaacataataaaaatacactataaaaacatattcaatggtggatttaatgaaactaatttggtattgtagattttatttctttctgtaaacttggtcaaactttaataagtttgacatatatcaaagtatcaaaccgaaaatgtcttgtagtataaaacagagggagtgacacttagtgaattataccgatatgtattggcagaattcagcaaagtttaggtgacaccagggaagaatgccccaacaaaagatccaaaagacaacagtaagtcgagcaagtaggatatcacccgtttcttctgccttgaccaaattctcaactcttgaaatttctcactactttccatcgtacctacatattccaagctcatcaaagcagggctgagagtttggctatataggtttacatcatcttaatcttagatcagtcaattgaagtcatttttcagttttttttttatcatgcacctcaaatcttccccattatcctgcacagtacagtttctgtacagcttctctgaaatcttacagttaactgttcaaatatattggcaatatgcatatataatccaaaatatctaacaataacatacaatttacttgaatcagtctctgttcatcaaagcagctgaaatgaacatcaatgaattgactattagtattcatgctgaaacatgcagcaaaacattgcaatggtgacagtcagaggggcaagttaccaagtttataggctgctttcttctggaacggttgcgatcttctcccccacacacgcaaaacagagcaagtaattacgcatttgttataaacagctttcctacagatttttttttgtgcaaaaaacacaacgtttagcggtttgaaaagcatgcacgtggaaaacaatggagtagatggcatgagatatactactaggcaacattgtataggtggcaagagatacaggcaagaacacggggacatgaacaccaa

SEQ ID NO: 505 - DNA, 7918 bp, Oryza sativa
atctgggaggaagggagggagggaggggagccatcacgtcgttgggagtagatgccgccaccgccctccccctccctgcggccaccacactggggtgcaccgccaccgctaggtagccgcctctggctggatccacgccgaggagaggaaggagagggagagggagagggaggggaggggagatgtggaagttgacttagaaaattttgacgcccggtggtttttaagatactttacctttttgcaggcggatttattaaagaggtccgtctgcaaaaataatgatattttcacggtcggacctcttaagatatctacatgtagaaatctatatttttttacttaaattactgccagggctttgcctcgtagtataattttcataaaaactcaaaatatttacaaattacaaaagaggaaggaaggagaaaaacttataaagattacaatgtttgtaaccaatcaaaaactatctgctttaaaggatctttcattctacacatatgaagaagaacttcttttctaaacgatattcttcatgaaccaaaggagggaagctcattccgaaaatttttcccatttctctgctcgtaggcggataactatctcatctcacggttgttatttttgtaggtggctatttggcttccagagacctactcgtccgggaaaaagaaatgccagcatctagaaaaatagtttttctagtagagtgttgtgagcgtctgcgatcgtggtaaagaaagcaaaaaaggtgaaggacgagtggcatgatacatatgggaaagctgtagactttgacccttgactactcgttggaagtgtgcgtctgcatgcattattgaacggctctgatccccgcggcgcagcggatcggggtcatgtccggatgggcatatcgacgagaaggatccgtccccgacaatctttcaaggcccgtgcccccgtccctcctctcctctgcgcctttccatcatcatttacgcccaaccccaacacatgtacatttcccttggcttgcttccggagaagaaaagagcggccatccactccactctccactctctcccttccatcattacttgcccaaaaacggcaatcccctcccctccatctccatgtgctcttccacctagctccgccattcaaagcaaagcaccaagcttttgcctctccctctaccatgcctgccccctatacatagctgctgcaccgtctctcttcataaatatactagtaggagtagcagagctcatcacttcgatcatctccattatcggaacttcggagtgacatggcaatggcggcggcgccccggcccaagtcgccgccggcgccgcccgacccatgcggccgccaccgcctccagctcgccgtcgacgcgctccaccgcgagatcggattcctcgaggtacaatctatctctatctgtctatatcactaccattcatactccttcgatcttgcttcaaaacaaaaaaatatatatttcctacttcatattcatatacacacgtacggcttgctatctgtcgaattgtttgcttctgcatgcatgcatcactctcattgtaagtttttcccagcttaaaaccactccttttatcttcgttcttcttccttcttgtttttttttaaaaaaacaacaactcatttaatcttcatatagtgtatcatgcatcatttgcttctttgatcagttccccaaaaactgctcctctcttcccagccaaataattaaacttaagcaaacaagcaagttgaactgatgatccaataaaacaaaacaaaaccgatcgaataggaagtcaatggcatataccagctgctatagctgaagccacgaatgcttagcttagctctagtcgatccctgttgactgttcaacacactgcactaacacaccagttaatgagctgattaattaaaccattaaatgagcttaacgggcggctagcttcttcctctgggcccgtgccgatcgtaccatcggtttgcgcgtccctccacctaaactctctgccttgttattccctttgcctagtactacatgcatttgcatcatcatcccatcaccaatagtactacgtttcaactggattttggtggtgtccaaccatatcatatttggttttgttctctagtttactcctacattagtctctagcggttttgtggagtactaaagaaaacaactaatcagccagggtttaacgtttaatcggttggtggttttgttaattaatttcatctactattttagacttcacaggtcttcgagctataagcatcgattgccatgcatcaatcgatgctggtccacgctagtttctgagttctgactagctctcttaattgtgctttgacctactttaattaattaaccagtggctgcgtcactcattgaccaacattgtcatgttacccggactgattttttttttctttaaaaaaacaccggatatattattagttagtgtatatatatgtctgctcaagaagcgcatgcatatagtttctcgtcaaacaaaaaatgtactgtatgctcaaagcatctgttttggaattgtcatattcgcctttataattaaaataattaaaatggtgatgcccagctttttttttcctccaataatttatttattggcttgatttcctgtgctattaggagtaaaactactccgttttaattagcaccatttttaaagcttctaaaattaacctaagtaaagtacgacagtacttgctgtctagctttaaatgttttgggtgttaaaatatccctcagacatcacctgaaaagttgacaggctaaacacatgcccatctccctcgtttacttaaattaattcgaacaaacaactgtatatatatttcttgcagggtgaaataaattcaatcgaagggatccacgctgcctccagatgctgcagagagtaagccagcctgctgtttctttttgtactacttccatttcttctcgtctttactcttaccatgcattcacaaaatatacttacttaccccagtttttgatcatgaactttgaccgttatctttttaagcaacttcaataaaataggtttaaatgcaaatgttatgtacaccattgattataaaaccttggcaaatgaaagtaaaaaaccagcacatttaatttctgaacgttgggagtattattatttttatatcttttactatcatttaatcatagtatcgtgcaagctttttgagtgtaattaggttgcttaaggtaaaaaaatgtaactaggttacatttagtactaaactgaacatttaattagtaatgtttcgttaagtaactgtaatttcaatgcatgcatgtcctcccgtaagagcaagtttaatagtatagccaactactagctccaatttatttatagacaatctaatagctcattcatacaataattacatactacactattaatatctgatcccacctgtcatacacatactgcattttggagtccgtgctatagctgactacaaatctatagtccgctgctcttctctctctttatttatctccttaaaatatgtttgcagctggcttatagcctgctattgtacctgctctgaaaatagtgcagagactgttcaaaaagtcattgcacaataactattcacatggaactgtgaaaagtatatattggaacttactagctagatccttttgggaacatgggaaaagccaagtcacgtgtggaatccctattccctgtgttcttcagctagaagagtgaaaataatgtactactactatacggagatgaaattacagcaggagcagaaagcgggaaaaaaactttaaatcaattaaacaaacctctctctgcaaaattcaacaccagcaacgaacaactcatcaagttcttgtgttatgtaccggccggtaactaattgttgtttgcataagcgaaacggtatatttgcaaacaaaaaataatttatgaataaaacttttatatacatgttcttaattatctcaaaacaaaggttgaaaaataaacttcgatgaaaaaatctcaaaatcaattccaaatttatggtgaaaattttaaattttgtctgataaacataagtataagcaaaaaaaaaagtaaagcaatgtcactatgttaatggtattggtatatatacctttgagtttctgtctgtactttaggagtacatgctacgaacatgttttcttggcttctatttcgttggaattacttgcgtattgtgggccagacgcctggtgaacttcgtcgattgtgtggactaattaagctcacctgaaataagtggttgaaaacaaggctaaagatgattttaatcatggattttggcttggaaatttttttgtagggttgacgaattcatcggaagaactcctgatccattcataacgatgtatggattttcaggtcgagaatttgtctttaacttcgcacgactgttattttttttcttattaattctctgtttacaagcagttcatcggagaagcgaagtcatgatcattctcaccacttcttgaagaagtttcggtactcacttcattcccggatcttaatgtatatatgcatatctgcactgtgctaattggtgtacacattatgtgatcatcagtccaagttaattattacttacaaaactgaactaataaacactagaaaatatgtaacttgcaaagtacatattgaatcagggattcatatatagaactccacctgcagatttcttccaatatatatatgctgtcaccatgttttcacttgtcacctagtacacctttgactgggagactttccttgatgatcgacgtggtcatattcttcagattgatttaatttcagatagaaaaaaatattgtttacttagtttctctccttcagtaagagagatgtgcaagaccagcgatcaaactatatgaactgttcgtttcatgataaaaaaaacatgatatggaataactaggtgattcaacatataatggctgataatccctcgtttcaggagataccatcagttttctacttttctacttttctccatgttctctttttcatgtttgaggtggatcggagcttgtattagatgtttgctcagctcaattattgctgcagatttccctatatagcctccactgtatatatactccctccgattccataatttaatgatattttgaacaatgacgctgtctccaaaatatatctttcactttgttttcctattataatatatacaataaaaaaaatacatatttacttttcttataaatagtttcaaagacaaatctatatatgttgttatataactcttttaaactaaatatttttaaagttatagtcaaagttacaaaagttggacctcaaacatgtataaaacgtcgagaattgtatatctgatcaaccaataatttgtagtgcattgtcttaaaaaaattgcatttctagctatgtatctagataattacaagaaccaggtgaaatcacattttatttttactggaccacgaactcattgtttaattacttccagccttgcactaaataacaataattgaacctggcatcacctgcacaattaatttggacacaaagtaaacatgaatgcaacatacttcgtttcatattgtttgttggtgtaggatttaaattttgtgtcaaaatacttgccgttcttactacattcttaagcactttgagaactaaccttctcttcctacccttcatcaatacagtcatactaactaattggctcttatgccttgaaaaactaattaggatgtatttaatgagggtaaccatgtaatctgccaccagtgaatgcaattttggttcaaaatttcgggcccccgccctaaaaagtcattatctcgatagaatttttttgaatttagtcaaaatttattcaaatttagccaaattgtgttaaatttcaaataatttcagtctaaaaagtgctgaaaatcccgaaatttaggttctaccgaaatggccggaaattttcagcgaaaatcaaacatgaaaaccttgtctgccacatttgttagtttgtgtaaagatttgctagaacgataagtaatttgaagcggatgtatattatatatcccacaaaaccatcaacttgttaattacatgtatatttgtgcatgatgctttcaccactttgtggttgttaacgattaaatcacacgttttattttctcacagctgtttgtgcagagcaagtgcgtgctgcctcagctacctctcctggatctgctgctgcagcagcgccgccggcggctgctcatcctcctcctcctcctccttcaacctcaagaggccgagctgctgctgcaactgcaactgcaactgctgctcctcctcctcctcctcatgtggggcggcgttaacgaagagtccgtgtcgctgccgccgccgcagctgctgctgccgtcgctgctgctgcggcggcgtcggcgtccgcgcgtgcgcgagctgcagctgctccccgccgtgcgcgtgctgcgcgccgccgtgcgcgggatgctcgtgccgctgcacctgcccgtgcccgtgccccggcggctgctcctgcgcgtgcccggcgtgcaggtgctgctgcggcgtccctcgttgctgccccccctgcttgtgatcgatcgatcgattgagcgaagctgcactgattggttaattaattagttctcgatgatgatcgatcgagctgcgcgcgtacttaattagctagctaggttctggtgttaattagttcctcatcgatgcatatgttgattgccttgctctgcttgcggttatctgtaatttggctttgctgccatgatgagtacgtgattgctgatttattttacatatcctctgctatatatatctagctggtagtagctagttttgatctcacttgcaaaactattcatttcctgattttaacaaggtcaaatgacttggttgcctttggttcatactccttagagcaagtataaaggtttatatggaggagagaggtaacaaaaaaaaatcaagagtattggctctcatgcgagagctagcttatcacaagctacaaatcaaatatattaaatgtataagtaagagatagagagaggaataaaattatagctaaccttataggtaatgtattatatatgttaattttaaaataagctaatagtaaaaagtgagctttattattatccttgctcttagtaatggcctcgattcctacattttttttttgagagagtagtacatattttcgcagcgtaatatggacattggccgacgggcctaactattactgggtctaagtgcctaactgagctaaaagccttaaacccaatactgaaaacgaaaaagttcactccgggtccctcatcttgtcgacgggttttaaaatcatcattgaaccggaatacgcattcccaatctttcaaaaccggatcacactaggtctaaggcagtattgctcccgattttggctgatatggtggttgagtcagcgtgagacacacataggctccacatgtcaacgacccaatcttctttcacctctctcccctctcttcacatctttatcgccatccgatcaacgatggcatggaggtcgtcaacaacatccgggcgcacggggtcgaacaccttgtcgtcgtaggggttgaccaaggggccgtcgtgcacggtcttcagcacacgttgatgttgtgcagcgtaacaccaatggggccaacaccgagcaagcctgctctcgcagagtcgtggcgtcgatggttggtggagtgggagagagaaagaagagaggggaggtgattttttgtgtgtgtataacatatgggtcccatgttgactcagtctagttgatcaaagtcagcttgacatgtcggtgaaaaccagtagcaata

SEQ ID NO: 506 - DNA, 5738 bp, Oryza sativa
gaggatcaccgaagccactgtcacgatgactaggaggatgagagaaacctcagccatcgcatcgagaggatggaaggactgtgccgatggaggataggagagtggcaacgtagtcgttgtcgtggggagaccatcatcaccgtcatcgccaagagaggataggggttgaagcggctgtctccatcgaaggaggtagtggccacctccatcgataaaggaagggcgatgctaatgaaatcgaaacatataaatattacgaattgatactctggtaccttatctggtattagaaggtatcgatatgataccgatgcagtatcggctagtaccaacaagtatcagctagtaccaacaagtatcagctattactatgggttctagatctgatctcgacaactatcaagtgataatgatggggtatcggatctaatatcgacgactattggctagtgtcgatgaggtatcagaatcttatacctgctgttgattggtatcataccgttctaacggaactatgaggtatagcaacccgtatttgatagagtaaatacatagtaacagtggattgcagcttatatttgcaagtgtgtatgatgtccaactatcgacctattatcgatttaagtaggaatgctatggtgtagactgatcgatatagtaagagttgtacatcatatattcatgtctaatgatctctacagtcattcatatatgaaatacgttgtatctcatttgtgaaaatagattccaatagttgtacatcaaatctaattctgttttttataaatcgattgtatacaaaacacaaacacatactatatggaaacaaaagctcagagttgtatatcaactctaattctacagcttcgtgtaaaattacctaggaaagtcagctggtccctcttaaaaatttccttgacatagttccgaacatcatgtaatcacttcacctaaaagcaggtagcactgatgagccaagtcatatttaaaagcgcaatgaatttgatcctgcccgttgctgttgagagctgatctgtacccctcctcaagtatctatacgcagcttcatactgctaagcgctaaaaacaccctggttggtttggctcgcacgtggcgcgtcgtcctacgcacgtgcacggccccacggaccatcattcgtagggctgcgcgcctctctccccctgcctgcgcggctgcgggcctgcggcttccttcgctaggttgactactcccaccgactggttttgcgaacggcccacgcacgcaggtggcggcacactcaaccagccagccagaacaaaaaatttacaaccaaaaacggaggcaagcacagcacgctgctgcaccaatttcccttgctgttcctcctccctcacatccgtcctctctcctctcctctccaagagacataaaaatattgggaaaagaatcccactatctcatgacatatgagaagagagagagatagaaagggagagcaattcaattgaggccatccacaagacattcctcctctccttgactcgtgcctgcagctagctactcgagacatccaggagctcctcatcctccttgcctctctctcttctccttgtgttgatagcgagaaatcgttggcgaggatcgagcaattgggattcttcttgcatggatgcggcccactggcatcaggtaattaagctgcggcggctgatctgcgctcgatcctttctcgaatcggtgcatgcaacaccggcgacatgtctacaattaagatctctcaccgggggcccggccgggtcgattttggcttctgctcttcttctggatcttgttgatgtgggtgtttcttggtcgatccttcttgtttaatctgcctgtgccttgatcttggcgcttgcttttcctctggtgggatacggtgatctctattctctctcggctttgtttgctcttgggaaccgccatggccaaccttttattctttgtgcagatctatgcacggatcggccatattcttctcgctctgtgtgtatgtgggttagtttctgtcttctccattggcttcgagctgagggctcttgttgttgttgtttggggccttttaattctcttgctccctcctctccttccccttttaatccttgaaaggagcacacgacgcaccgcttttcttttcctttgttcctcgctttctttcttatcctccctttcctttttatcttttcatctctcttttcctcatggcttttctctccacccctcaccctttcgtctctctcctcaagcccacaccttgcatcaaaagagtagccatgtcttggaggatgatgtagtagcagcagcagcagtactgctacgccacaaacacaaccctacaagagcacaaacaaagttgtgtgttttgtgtggtggtgtgttttctctctcatctttactttgctttttttttcccgctttatttctatctttcacctttccctcttctagctttaatctcgctttgtatccatttgcttggttctttgttgcaccataaggatcctagctcacatcacacctcatgctcattcatcttcccccattcgtctctcatatactacatgttcttgcttcttggttcttgctaattgtctagtattgcataacttagttctaggtttgtgttgatacttgcaattgcaacatctaatggagtgcaacgacatgtgtcaatcaccaggggctagggctagtgaagcccatggaagagatgctgatgggtgcaaatccaaatcctaatgggagctcaaatcagccaccgccaccgccgtcctcggcggccagcgcccagcggcctatcgccccaccggcggctggagcggccgccggcgcgggcgccgccggagctggggctggcacggagcgccgcgcgcggccgcagaaggagaaggcgctcaactgcccgcggtgcaactcgacgaacaccaagttctgctactacaacaactacagcctccagcagccgcgctacttctgcaagacgtgccgccgctactggacggagggcggctcgctccgcaacgtccccgtcggcggcggctcacggaagaacaagcgctcgtcgtcctcggtggtgccgtcggcggccgcgtcggcctccacctccgcggcggtgtccggctcggtccccgtggggctggcggccaagaacccgaagctgatgcacgagggagcgcaggacctcaacctagcgttcccgcaccaccacggccgcgccctgcagccgccggagttcacggcgttcccgagcttggagagcagcagcgtgtgcaaccccggaggcaacctggcggcggcgaacggcgccggtggcaggggcagcgtgggcgcgttctcggcgatggagttgctgaggagcaccggctgctacgttccgctgccgcagatggcgccgctagggatgccggcggagtacgcagctgcggggttccatctcggcgagttccgcatgccaccgccgccacagcagcagcagcagcaacaagctcagaccgtgctcggtttctccctggacacgcacggcgcgggtgcaggcggcggctccggggtgttcggcgcgtgcagcgctgggttgcaagagagcgcggcgggcaggttgctgttccccttcgaggacctgaagccggtggtgagcgccgcggctggcgacgcgaacagcggcggcgatcatcagtacgaccacggcaagaaccaaggtggtggcggcggcgtcatcggtggccatgaggccccagggttctggaatagcagcatgatcggcaacggcagcagcaatggcggcggcggcggcggttcttggtaaggtggtgcgagctgctactgcttgcccgccgccgccatgcatggctcatgcatgcacgcgtggtggtcagcagctagcagcatgtggagatagagaaacgagatagagacaaggggggttaataagcctgtggtgattagtgttacatatggcgttttgtttctctttgctttgtttggtttttcggtttcatggtgttgcttctttgttgtttgttcatgtgtgtgtggttaattatcggcttgggggctggctaacacagcaggatacacagatttttaagggtggtgaacttggtgatattatacagctgctgatctattcaccaatcaatctctcattttgtgatttaatcatgtcatgtagaatctgcactgaagcatgatactcttatcatttttttagttttgatggctgtgtgtgtgtccacggacggtacgtacgccgtttgagttactgtatgtagtctgaacaaacaacatgttggttagttgcatatgtccgattgattggccaaattcttgtgttggttttgcatggcatgcatcttgcagatgcaggcacaggtgacatgttagaaatttcaatcgatggggaattagagatacagaattaatggccacttgtgtcgtcagaaaccacattgatatacctccagttaactcggtgcatagttcaatatatgcgtcctaaaccaagctcacatagatcactgaggggcctggtgctttagcatacaatgctctctgttagaggggcacctagcaacagtcattttttatggtggcttcagtaagttcatttatacaccatgatagtaactttgaggaacagcttgtaataatactcctattaatttactgtcgtttacaactactcctacattaatatattgattatatttgccatccttttattatgttctcctgcatgcaaatgctgatttgtatatataccgatctgtcatctcgatcgctcgctcgcactctgtgctatactattttcttgtggcaggtaggcttagctactctctgagatgtcgaatcgtctctcatcatcatcatcatcccagaggcaagaatcttccagccatgaaagccactagtgggagctaggaggagaggagggaagaagggccggcatggcgcgagtatgtatgacagacgcccctactttaactttctctctttctctcaccttccatccacatggtactattatcatatgttaggccatctgttttagtgcacggcatggtcatttgtactatcctattacaaaccatgatatatttatttttctgggccaaaaagctatatataggtactcctctaactcttcatcaccatcatcatgcttgcaccctgcctttgcacaattgcactcatactgtatcttgagatctctcttttgtcaagtttacaacgagtgcatgctgggctttttttactctagatttttttccccggatgcaagttcaactgcccataccagaaagttgccatatactatacctaatgattctttcaccgcttcactatgcccatgtacatacgaacgcggccatgtgtagcttcttctacctggatgtacggcgctagctaggaattgaaaatattgataatattttagccatgcaattagcaccattctttggagggcccgggaaaacattctcctagggatgcggggctgccgaatactaccagtccaccttgtggttgcattttggccgtcctaataaattagtgtgctgctacttgtagcactacactcattaaggaagataagatatgctacatttgggtgtgtgtgcaagtgcaaccatgtcctacagtcctagccatagcagaccaccatgcattcacccatgcttcacgtttagtatgctagtggtgtactacaatgcatcta

SEQ ID NO: 507 - DNA, 8807 bp, Oryza sativa
ggaaagttttgatgtgatggaaaagttgaaagtttgaagaaaaaattgggaactaaaccaggcctaaatgatgatgatactccctcccccctaaattctccttccgatcacaaataagtggcttttttaagacagtgaaagtccctaatacactcgtttaattaccaatcactactacaaaattgtagaaaggataaagcagagtgataaaattttaaaaccaaaaactaatctatccatagcattttttaaagtcaagtcaaaagtatttaaagaaattgatcgaagttcaaacatattaactacgtgtattgtacaacatcacttgtttataatcagatggagtagacccataaaccttttatgtctctcggttattattttctaaatgcataaattaagatgaagattacatatattgaatagtcgttcatcaaatatagccaattttaggtattaaatatctccatgacctcaaccataccaaatgaaacaaggtgacgtgaaaaaaaaactccacttaacgcacacaaacccatagagataacctcatctagacgcttcatacgagacaaaaactggtggaagcaacccccccccccccacgcacaccctgaaccccctttcttcatcaataagacacaccgacgttcaaaccgatgaactcaaacctacgcaccgccaaccaagaaaaaccaaaacctaacacgtggatacaaaatgcaacctggaccccacgtaacccctccacctcactgtacatccagctagagatcatcctacgtagtacatctatcttcaccgcccgcccacccaaaaccgtcacgtctccactgcaatccgcttccgcacgccatatatacaaaagatgctgaccaacacgaaaacatctaaaacatctttaagctaaaaaacatataacaaaaaaaaagttaacaaacatgaaaaacactctcatctcacatctataaaaccacggaaaaaacaggtagtataaagcatagacaaaggtaccaccagcatcctcatccccaccaccctctctgaaatctactactaccaccgctatccccacaagcggctagacaggcagccccccgccccgttgcaaactgcggctatgtggctctggcaccgagattattatagcgaccgcagcagcagcagcagcagcagcagcagaagctaggctacagaggtcgcagtctctctcgcagtcgcagcggcagagacaaggccgctcttctcttctcttcttcctttccttgtgcatagcgtagcggctagctgttgcagcagcagagaggtctccacttccctttcctcccaccccgagaaagccaaaaaaagaaaaattatttttcaaaaaaaaagctcgcctcgccctcgcgtcgtcgtccccatcaccccccctcctccgctccgagtacgcgtgcgtataccaccacctccatctccaccaccgtatgtatctacggtgaggcggcggcggcggaggaggaggaggagggggagtggtgagggtttcatctgcggaggaggagggaggaggagggaggagggtagatctgggagggggatggggaacaggataggggggaggaggaaggcgggggtggaggagaggtacacgaggccgcaggggctgtacgagcacagggacatcgaccagaagaagctccggaagctgatcctcgaggccaagctcgcgccgtgctacatgggcgccgacgacgccgccgccgccgccgacctcgaggagtgccccatctgcttcctggtataaaaccgcctccggggagatgtggcgggtggacgggaggaagagatctctcccctcttcctcacttcctcctcccgcttccttccacttcagctttttctctctttttttttggtgggattttgtcgtaatgctactactagtacttgttgttgcgagagtagggcgtggattgcgtgtggccgggtggtggcgtggagcgtttcgattagggggttgattacttttgctcctgttcgattgtggagagtgccggtggtgtgtggccgttatggagatggatgaccacgcgcagtgttttggggcaagaatttcagtcgacattggcacggttttggggttgtttgtattgttcttggataattagtgcggttcgtggagctgattttgcgaaatgtagtagtagtgtttgaattatttctggtagttagtagtggtatcatacttcgtatgtacattgtccgcaatgttctcctaaattgttttgttttcttaatcatagtttacttacttttattatgtaattctgagatacgtttttttgggataattatagtctaggaggttttgggtactcatttattattgtcaatattctataggcctatctattggctgcctggctgtgatgcattgcatgaaatttaatgtttactgccactcccggggttgggacattacagaccttataggaaatttgactagtttcataaatgaataattggccaactgttctgcaatgttgggtgccttcaatttctaatagtggatgctctatagagtacggaggtaccatggtgatatttgtttgttgtgtgtaatactttatttttggtgtattaatgctcttgggaaccgagattgagaatctattgtagtgaacttgattctgttagctgtgccagagtattttcgatgtctcttgtcaagcctgcatttatttggcacaaagtagattttttaaaaaaaaattctgcagctttaatgctactagcttactgcaattaatgttattactatataggaattttaatgcaattctatatggttgcaattttattgcaattctgcttcattagatctttagctcaaaatcactcaataaatttggttttagatgaaatcatgaaacttgtattataggagtatattatatttggtgttgaattatatgtttgcatttgtgctaatagtggtatttaacaattatcacttctggtatttctgagttcaaactgtttgacaaccactcctgtcctgaaatgcatgttttctttctttgtagtactacccaagtcttaaccgatcaaagtgttgctcaaaagggatatgcaccggtaatacatctatcctataactaacaattgtgttttacttgttaggaccatatacccttatattcaatggttggtttttttgcagagtgctttctccaaatgaaaccaactcacactgctcagcctacacagtatcctttgtgtcacccttgattatattttgtaaccttggcagttggcaatctatattcctttttatgaaaaaaatacttaaccaataaagatgtccattctgcaaaactcccagttatgctgtggagtatcgtggtgtaaagacaaaggaggaaaggagcatagaacaatttgtaagtaatttatattctgatgttttttttttgttttgccaaatgcatttcatttatctcacataatatgtgttacaggaagagcagaaagtcatagaagcacaaatgaggatgcgccagcaagcacttcaagatgaagaagataagatgaaaagaaaacagaacaggtgctcttctagcagaacaatcacaccgaccaaagaagtggagtatagagatatttgcagcacatccttttcaggtctgcacaggctgcaactaacatagaaatttagtaatgtaccatttcttctgcttgatgtggtaatttactatgtgttatgtctgtttcagtgccgtcataccgatgtgctgagcaagaaactgaatgctgttcatcggaaccttcatgctctgcccagactagcatgcgccctttccattctaggcataaccggtatgttattatctttttctctgagttttagggtgtcattgtagcctggttatgttgaactgcaaaccttactacacttctatgttaaataccctacctcaaccatgttgaagggaagcaaatgagaagtattgttaaaataggataaaggaaagtaacagtattatctatagaatcaaatcgataacaaagatcaaccgttggattaaattggatagtggggaccagacaccataaaacactggcatttcggacaagatcatttaattattccactttaagcttgtgcagtctgtcctgatccactgcactatttaagtggatgagaagctgtgattggagttactgttctagtgttaaggttgacttgtatcagatacaattgcctatccagtgacaaagtttgaatgtttaatttgtgaaagtgtgaatggagagaatttctgcccacatcattgttgtaccatgatagttacagtaatctttagtttatctatactctagagggataaaaacaccaaaacagtttgatcaaaattgttcgaggtaaatcctaagtataaaattgagaatggatttgtttttcaatatggttatttgttatcgacattcagtgtttttatttcacacaatggccaattccgaaaaaacaatctgggttctttttatcccactgtccataccaagttgatgtagcaagtaactactacacaaaatagtatattgtagccctttacatgcatccaatagattaagtggtcttcaatccaaggatgaaataagcaataacgtaggttccgataccaaattagcacaaaacaatgctaaatgcttttagaggaagtaaaccactcatttggttcttttacctataaacttgtgttcgcttgatgttctcaatattgtcaggctattttatagacttgaggagtaaacatttcttgatgacgttatcttctcctattgtgctagacataaaatacagtgtagcataacttgtgtactgtgagtttttttcaagtttttcttgatgctgcacaatagtatacaacaatcgtctattcagtcacacatggcacatcctcacatcaaacagaagttactttttatgatgttaatgtgtagtataacagcagaagctaaacggtagagggatacaggatactcgagtcaatatgaagttggggttccatggagtatttgaatcgaataaaacatcttgatgatcaatattggttttcatattgtttctataagctagtttcatatttttctagagaacctattattattttgcttcctgtcctcctcagaagattgacattctgtactggtagtgaatttgtgtttccctcataccctgtttgggagggtttcaacgtcagcttagtgcagtgctgcaaagtttaaactctatgaccagagcataagtatggcttaaggacttctgatgacaaagccatttttgaaacctgaagcctattttgatcaacttatgaacttatatggaaaaccagtttctgaaagaggccaaatatcaataaatggtgccttaatctcccttcagttttatagtttaccatatggatatttttcctgtactaagtgtttcttgcttgctggtcatgataatcctttatgctgttgagatgaaaatggtttctaaaattatgaaactgtgtgtttccccttacagtgatgataacattgacatgaatatagaggatatgatggttatggaagcgatttggcgttccattcaggttagtagttttctcactggtccttacatgagattattgataatatgcatatggcatactgtggataatattataaaagctgatttgttgggtcaggtaatggtttgtaaatgagctgcacaaaaatagattgttatttgcattgaacatgaaagtttgctaatctcctggcatgcttgttgaattcagagcattttgcgagttctgataaatgcaagatctagtctgcacaagcagaacctgtattgttaagtgttcaataataaaaaaaaatgtcaattaaattgttgagaagtgtattggcgatagtggataatgtaggatatgtttggtttgagggaccaacatcagttagttcatcattgcctcattcctcaggcacatgctagtggaaaaatgagtaatgcagtattcatgccaaaatcatcctagatggtgtgattcctcaaacaaaacaggccagtagatgatggggttggtaagataagttatctttttgtcattttacttgagcagtactgcgcttggcacaaaaatatttctggtcattttgtgagaacaagaggacttttcacattcctgcattcctgaagggaacttattatctaacagcattgctaaactcagctcttcccatgcccttagccatcaaattgatttgttatgatggttgcattgttagttttgcggtcccaattattagccacttaacgttcaggtcaggaactaatggtgttttttttctccgtcctttgtgttatactacctccatcctaaaataagtgcagccatgagtttccgcgcccaactttgatcgtccgttttatttgaaatttttttataattagcatttttgttgttataagatgataaaacatgaatagtactttactcgtgacttatgtttttgattttttcaaaaaaatttcaaataagacgaatggtcaaagttgggcgctgaaaaccatggctgcacttattttgggacggaggtagtatcatttattcatttgctgttcaagctgtagctcatcgtgtactgttccccaataagttgcttgccatttggtctatgtttccagcttctttcttttgtgagcatttttccttctgtatagcttgttactagaaagatgtaaactttatgttaaatgctgcttcatctttgaatttagattcttgggaataaacaataagcaaagttcatgtattgcgtatagaaaagtctgcatatatttctatcctaatacggtcaatcttttctctgagcaggagcagggaagtatagggaatcctgtctgtggcaactttatgcctgtaactgagccatctccgcgtgaacgccagccattcgttccagctgcttctctagaaatacctcatggtggtggattttcctgtgcggttgcggcaatggctgagcaccagccacccagtatggacttctcttacatggctggcagcagcgcattcccagttttcgacatgttccggcgaccatgcaacattgctggtggaagcatgtgtaatctggagagctcaccggagagctggagcgggatagcaccaagctgcagcagggaagtggtaagagaagaaggagagtgctcggctgaccactggtcggagggtgcagaggccggaacaagctacgcgggctcagacatcgtggcagatgccgggaccatgccgcagctgcctttcgccgagaacttcgccatggcgccaagccacttccgcccggagagcatcgaagaacagatgatgttttccatggctctttctttagcagatggtcatggaagaacacactcgcaagggttggcatggttgtaggtagagcactctaattttgacgccttgctgccctctcccttgcgctgctgttgctgcccttctctcccctgcctcctgcttctgcctcctttttgccaccagctcttggcctttttgttcaccccttttttgcatgtgttttgtcgtcatggtttgatatagatccagctatagctctccattgttattgcttatatgtatgtaaaatggaatatgaggaaatagaaaaaaggaaaatgggtcaacagttcttttggcagtaggatgtgaattgtttttttggttgcgaaagcgtatagcatccttcaattcttgcagttggaagcaatgtttgcaggttgcatgtatgtttgtgatttcacatccttattgtgtaagaatgttacacttacagcagccaatggaagagctatctcgatgagaggcgagctgctaccagcattcagccattcatgagccaactcatgctaattgtatgcttttaaattttggggtgtcataatgtttacatattctaattctaaacacaacaattcggtcgttctagacttatccgtgttaaattgtgctttagcaggcaaaaataataattggaaattatactgttcctttttgttacatcgagacaatatttgtgtcatctaaaaaaaagagaagacagtatttgtgtcaactgtcaatggccttgtttggatccttcgggctattaaatagccctccgaaattttgctatttaggattattaaacgtagagtaccgacaaaaccgattccataacctcgaggctattttgcgagatgaatctaatgatgtatattaattcataattagcggctgattactgtagcatcactgtagtaaatcatggattaatataccttgatagattcgtctcgcaaaatagcctagaagttatggaatgagttttatcagtaatctacatttaatattcttaaatagcaagattttggagggctatttaatagcctctccggatccaaagagagccaatgtgcagatatggagacgcttatatgggctatatatggcctgcttacaacactggatggtccacttccagactcttttatgcccatcgaacgaaattaaactgggttgctctatcaagtgaggccagtagcatacttagcgcatgattaattagggcgctttcaggatgagtccgcaacttctccttcccatggagaacgaggtagcttattagtatataattaatttattattagcttaaaaaacttaaataacaaattaacatgatttttaaagcaactttcctatagatttataaaagaaaactacaagtctagcggttcgataagtgtctgc

SEQ ID NO: 508 - DNA, 3983 bp, Oryza sativa
agctcatctctgatggatcatctctctctccccgtgtggtaattccgatgtgatcgatgacgcgtgcatgcgtcggagtaggagtacagcctctgttgttctttttggtcttcttcttctacttcctcccaaaaatgcgttgtgagcgagaaaaagagaagcttttttttggtgtgcgtgagtgtgcaactctcaatatttgttgcccgaaatctttcgagtttgcgtctttttgggcttacactgtcccttttttatcgctgcgtccaatcctaatccactatttatgcctaattaattactccgtctgttcttgaatatgacaacttaacttaagtagtggattgaaccttacgtggtactgtactatatatctagacatacattatatctagatatattgtaccaggtaatatctcatatagtactaggatgttatattctctggtactctctaccggtagtacagtaggaatggtctgaattgttcgttattaagggtaaattataaatttactaatataatgattacggaatactttattatttatgttttttttgtctaaatcaatttatggtcatccattttattggcatcactcatattttatcgaaaagaaaaataaaagagaaagaagatttagtcactaataaatgacgattataccttacacctattttttttacaataatgctccctcaaaatttctataaccactaactgaaatggtaatataaatagatctaaaccactagataaaaaagataaactgttcatattgctttctatcagtagcctgggattgggacggaggaagcgaagagagagaaagagagaggtggttttgttttgtttgtccggtaatggctgccgcattggtggtggtggcctcctctcctcttcttttatttcgaacgcgacgccacccacgcgcctccccctcccccctgcggtttccctctcttattcaaaacctgtctcgattctcactcactctcactcactcggactcctcacccgctagctaccccggagcgcgccgcgccaccgctcgacagcggcgagatgggcaaggcggcgcggtggttccgcaacatgtggggaggagggaggaaggagcagaagggcgaggcgccggcgagtggggggaagaggtggagcttcgggaagtcgtcgagggactcggcggaggccgcggcggctgctgctgcggcggcggcggaggcttccgggggcaatgcggcgatcgccagggcggccgaggcggcgtggctcaggtcggtgtacgccgacacggagcgggagcagagcaagcacgccatcgccgtcgccgcggccaccgcggcggcggctgatgccgccgtggcggccgctcaggccgccgtcgccgtcgtgcggcttactagcaagggccgctcggctcccgtcctcgccgccaccgtcgccggcgacacgcgcagccttgccgccgccgccgtcagaatccagacggcattcagaggcttcctggtaagcaacgggtgctcgtcttcttgctctggtttcgtcgtcgtcgtcgtcgccattgtcgttaatcatggcgtgtgttcgtgcaggcgaagaaggcgctgcgagcgctcaaggcgctggtgaagctgcaggcgctggtgcgcggctacctcgttcgccggcaggccgccgccacgctgcagagcatgcaggcgctcgtccgcgcccaggccactgtccgcgcccaccgcagtggcgccggcgccgccgccaatctcccgcacctccaccacgctcccttctggccccgccgctcgctggtacgccgctggctaaatctcgccgacgacatcgccatgtatatgttcgatgttgacgttgtgtgttggcgatggatgcagcaggagaggtgcgccggcgacgacacgaggagcgagcacggtgtggcggcgtacagccggcggctgtcggcgagcatcgagtcgtcgtcgtacgggtacgaccggagccccaagatcgtggaggtggacaccgggaggcccaagtcgcggtcgtcgtcgtcgcggcgggcgagctccccgctgctgctcgacgccgctgggtgcgcgagcggcggcgaggactggtgcgccaactccatgtcgtcgccgctcccgtgctacctccccggcggcgcgccgccgccccgcatcgccgtcccgacgtcgcgccacttccccgactacgactggtgcgcgctggagaaggcccggccggcgacggcgcagagcacgccgcggtacgcgcacgcgccgccgacgccgaccaagagcgtgtgcggcggcggcggcggcggcggcatccactcgtcgccgctcaactgcccgaactacatgtccaacacgcagtcgttcgaggcgaaggtgcgttcgcagagcgcgccgaagcagcggccggagaccggcggcgccggcgccggcggcggccggaagcgggtgccgctgagcgaggtggtggtggtggagtccagggcgagcttgagcggcgtgggcatgcagcgctcgtgcaaccgggtgcaggaggcgttcaacttcaagacggccgtcgtcggccgcctcgaccgctcgtcggagtccggcgagaacgaccgccacgcgttcttgcagaggaggtggtgataacgtcatccgagcaatccatgggaatgaatgagtgagacgacgaggagagctttttgagttggtaattagaaataagaatgcgttttaatgtgttcttgggagctctctcgtttttatttttcatttttgtttcttttttttttgcttttaatttgtgatcaatcatgtgggtttctgttcttttctgaactgtttttcatcctctttttttgtgtgtgttaatgggtgccaaactagtgtgtatgaggaaaatttgattcatactacacttggatgtaaattcttgctagctattctctctgtcccaaaatgaaacctagctgttgtcttgttatttggatggttcttaaatgttttatcattttttaaaattaagatattacaaatacttgaattatgtgaaactattaaagaaaaactaaagctccgggtaaatttgttgaataaaaagcacaatttagattagtctcggattcatgaagtcatgatcctgttctccgacactgggacagtagcatgggaagtgggaccaattatgaatgattttgtgtgcttgttttggttagcttccaggctttcttgacatccaaatctaggatatgtagtactactactaatcactttgttgtggaaaaaaatataggagtatattagttatatgatttcgacaaaactgagggagaaactaatcagtgtatatgataaatgtgctctataggaaaatgcaataatcgagacaagaatggatacatgggttttatataacctggtttattcgaagtgttctataatgggctttattcataagtagtaaaaattaaatctagaccgtctttttcttctaatatatattgtaatgtatatgtaccactatctcaattactgataatagaatatttttctattgatagtataactcataaatcaatatttttctgctggtaataacagtagaatctaagtaacattagtagagaccacatctactcagtttatttaatgttctacaacttatgaagttattagggacggtcatagcacaactcatcgagattttttcatggattgagggagtttgaggtaatggtttgaaggagaccaagacaagtttgcatataacgtggtaacaagattgttttgcccttgggcaggggcagcgggggcgataattatatacacaacaagtaagacggtgatatgagtatattagagtcacgcctgtgatggaaccagaatcttattcctaagcctagtgctaaattagtattatttatataattttatcttcatgttctaatttttagaattttaaagtacaattttaatagatattt

SEQ ID NO: 509 - DNA, 7562 bp, Oryza sativa
ctttctcaggcagaaaggtggttaggctgctgaagcaacaacaacaacaaccggtgtttggtgataattaaacctgttctattcatacagcactcaacaacagtattataacgcattcatcagaagaagaagggaaaaaaaatctgctactattcctgagggaaaaaaaatataccccacctgttttaaaataactgacattgatactattctcttttaaactttaaccacttatcttttttcctaatattacaaacactacaaatgatatcatgttattaaagcgaggtaaaacttttattcacttatagtccaacaatttgagagcaattaatggtcaaaaattaaatgaaaaatagaaattcttggttattaagaaatgagagtaaacaagtactctctctatcccgcgaaaaaccaacttagtacctaatgttcatatattctagtactatgagtctagacaaatctagctgccaacattcggttctagattgatttttttttggacggagggagtataattgagaaaaggtcaaattaataatggaatggatggtattgccttgagctttaaaaacacaacctttcacctcaataattgtagcacaaagcaccacaagccccccttccatggcagtgcaaaaagatcaaagcatgcatatggtccctgcagggcccggccaaccccccctttcttcaccatttactactactgctcatccttcaaaaatgcctgccagggattgaatggttgcaagggaagcagaaacccagcaaataatagcactgcacagtacatgaatactacatgtacacagttacacactactcccctacaccatccttcactacagcccccagttgtttcttgcaagtactgagtaactgactacccccagttcctgccctcttgggccttggtattgttgctccaagatctttgccactactcctactttccttattccactagaaatcatatatacctttctcactctacataatccccctctccttagagtctagttatatagatagacagatctctatcaactctgaaactaacctctaaggtaatctcggaatcttcagctctcgtaaacagaatagttaaagactcttgcgagaatcttctaataaagtctaagtagctacagaatccagaaacaaaccagtagtaacttaccaaccagatacgtaacataacatgctgctccttagaacctaaagcctttttttttcaaggggggtgtaataatgatgtgattacgtcgcatctaacttgtgatggcaattagtaagcagtagagggagagggggagagatgtgtttgtcctactaataatgcgagtggtgatctgatctctgcttgcaaaagagacagccacggaatcgagagtgaggaggccagccaagaaaagcgacaccagtgtgtgcgtgcgtcaacacacagctcaagcttacgcgggagctaagctgagctacagcgagcggcggcggcggccatggagtgggatctcaagatgccgccggcggcgagctgggagctagccgacgagctggagaacagcggcggcgggggtgtaccggcggcggtatcgtcgtcatcggctgcggttggtggcggcgtcaatgcggggggtggtggcaggcaggagtgctcggtcgacctcaagctcggcgggttgggggagttcggcggcggcggcgcgcagccgcgggtcgccgtggcgggcgagccggccaaggggaaggggccagcggccgccgccacgggagcagcagcagcagcgtcgtcggcgccggcgaagcggccgcgcggtgcggcggcggcggggcagcagcagtgcccgtcgtgcgcggtggacgggtgcaaggaggacctgagcaagtgccgcgactaccatcgccggcacaaggtgtgcgaggcccactccaagacccccctcgtcgtcgtctccggccgcgagatgcgcttctgccagcagtgcagcaggtaaccccccccccccccccccaaccattgtctccttccttcccgccaaattcactgcaaaacaaaaaaaaaatcgtagcccaaaacaccccaagacgtcatggcaattcgcatcaagaactgcatatatcaatttctccacttcttttcagcgtcactgtctctgatcattctctttgctgaacaaaagaaaaagaagataagcaagagtttttctcttttttttgctccttttttttttggctttgcacaatctcttcttgcttccagttgcaactgaccattgtgcagtacatgcatctgcatctactgattctaatttctacgctacttcggatcaaaattaattcagtactgcaaagcacaatttcattgatccatttcatccagcctcggactttgttcatcatcatctatctgtctcttacttcctttccattgggagcatactatccggctgtctcgtttcagggacgcacagctttgcctttaatggcatgccttttcagccttccctcatgctatcctttagctcggcaactcgtattaccccaaattattacctctttgctcgcctttagatttattactatcatcttttcttttcttttttatatctcttcttcaccagtagctgcactgtttttgcactgctcaagagcaaagcagctgctgtagttgttcagtgtttgttgcttactgagaaaaaaaagtgatagagacagaaaaaaaagtgagggagagaaaaaaaaaaaaacagaactgacgcctgaatctcatcagccagagatcacattaggcaatttaccaccagactgttatgatattattttcagtgtcctcctgtctgaatatgaccgtctgcttcctctaacaagaacaataaatcagcacctagttcagtactaactaattttctcatgaataaataaataaatatagtcactgtaattagtgacactactagcacggtagcacctggtttagtggttaacaatacttggttcttgcacttctccctgtcgatgttttttcgcgtgggggctagctatcgattgattgattcctcaactatggcatcgaaactggaagaacatatgcatactgggacacacaccctgcttgctttctgaatttctgatttctcctcaaggcagctggcctaccacatatatctgactgagctgtgctgcttcttgccatgagagctaagctaccttagcttagctactactaccacttactacgccgtctgttttggaagggaaaggcagatgtggatgcccaaacctagaaagatggttgtaccactgaaagagagagtttgtggatgtgatctgcactaaagcacccctgtacagggaaaggaccatgtagccctactacaagttcaccatttacacctctgttcctaaggttgggccacacatatatgaagcttttaatgtctcggtttgttggaaagggttttgcattgccattacaagccagcacagtggatacagatagccagggtgctctctattggagaagaaaaaaaatggagccctgaacaccctgattggatctcactattgcatgaaagaatgatgagatttcttgtcttataatttttaaagattttttttctaaagtcagtcttagttacattcatttgttatattccagtttcagacttattggtactaggttctgtgagatctttttttttttttacatcgtttgagtatcatagggtgattcagtaccaccttgacccctgtttttatcagagctctaaacttctaacaccacttctaacttttgagctagtcttctaaccttgctgttttctgaacaaagatgtatactcaagattggtcatagatggagatattctgtgaacagaactaacataatagcaccaaattagtcagacatactctttacaaaattactttggagtttgttgtccactccttgaactagtacaatattgtcctactgaatgccttcctgcctttcaacttgaaagttccctattttatctgttagttcttttataaaatgtaactgcacattgtcagaaggatttgcatcttatttcactttgcgccagttttaagtaatacatggtatattggcataagaccagactctaccattttttatcttgcagagacatagcaaacaactaagtactttttattgtggtgtgctcctttacacagtagcacaacttgtaggatgcttatgtgattgtctcatcaattattctctttatctttaaaaagagaatgatacaaaaaatctctttatctgagaatacacattacccagtggggacagtctttcaatgatttgattacttcgtcagtgtttgcaaactgggaagatcattatgctgctgcatgcagactttataaattaagtgatcttcagagtcagaacaagatgttagctttctatacctatggatccacatccactgtattgtggtccatgtacaagtggggttaaaatatttttctgccgttgacagaacttcagttcaataaatttatctaagatgaagtatccaagcacggaaagagctaattaactgatgaaattcctgtggtcccttgtgttggtatatgagtattctaagagagaatatggagacagtatattaaattattctgagaatacttatcctgacgtttctttagtgagaactgtggtgcatcgttacaaaacttcagatcatgtttcaggagtattttatcatgtaagaattttaaaaagacgtacatcctaggtacagtcatttcttaaggtttcatggtactgaatgattaaattacttcttctggattgggtttcaagcatcatttggctaatttcaatgcagttaaatgatcataagcttttctttcttcaggtttcacttgcttcaggagtttgatgaggccaagcgcagctgtagaaagcgactagatgggcacaaccgtcgccgcaggaagccacagccagatcccatgaactctgcaagttatcttgcaagccaacaaggtattttcttgtttattattaccactctatgatatcgcagttcatataagattaactgggatatagtcattcagacttcctaactattgttagactaggaaaaaaactatgaaacatgctaatagcatagataagtcatggtaaaaaaaaagtaaaagaaaatgaaactgtggttaaaaaaaaacgcaaatattagggaatgacctaatatcaaataattagaaggagtgaggcttcgaacccaggtcgtctagcccatcaccttttgaagctagccagaaaacccctgggcgtttctcagaactgtggttcagctatgactctgttctttcaatcctgacatcttgtaacatgtaatgcattctagtatacatctaatgcattgaaccatatcttatgtactaatttgtgctgatatatcaaacatcgcatcaaaattcaggggcaagattctcaccgttcgcgacgccgagaccggaggcaagctggacagggatgatcaaaaccgaggagagcccatactacacgcaccaccaaatccctcttggcatcagcagcaggcagcagcatttcgttggctccacctctgacggcggccgccgcttccctttcctccaggaaggcgagatcagcttcggcaccggcgccggcgccggcggcgtgccaatggatcaggcagcagctgctgctgctgcttcagtgtgccagccacttctgaagacggtagctcctcctcctcctcctcatggcggcggcggcagcggcggcggcaagatgttctccgatggtgggttgacacaagtgctcgactccgattgtgctctctctcttctgtcagctccggcgaactccacggccatcgacgtcggcggtggccgggtggtcgtccagccgaccgagcacatccccatggcgcagcctctcatctctggccttcagttcggcggcggcggcggcagctcagcctggttcgcggcgcggccgcatcatcaggcggccaccggcgccgccgccaccgccgtcgtcgtctcgacggccggtttctcctgcccggtggtggagagcgagcagctgaacacagtcctgagctccaatgacaatgagatgaactacaatgggatgtttcacgtcggcggcgaaggctcatcggatggcacgtcgtcgtctctgccgttctcatggcagtagttttttcagtaactgtatgttgctgccttagtttcagtagagttggttcttcatttcttttcagtgatcaaattattgtttctgttcttttctgccatggtaagttccttttttttttcttcttcttgccttcatttgagttaattacagcattgatttgtgtgaacaaaattcatcataaatcagttcctcgcgagatcattggtctcaacatgatggtgccaagtgagaactgcagtattgtgcagttttcagttttgagtctaagttgtataaacttgcagttggagtattatgctctagtattaatctactatcagacaagataagatcactgattaattcacccctgacctgatccatcttgtgcacacgtcggccagcagcggaattgagcttctggatcagatcttaggcatcgtttggaacagagaagtttcaaagatttatgaagaatttgaattaaattcagtatagaatgcatgattgtgaaaagtacaataatatgaaaaataaaggattgagatatcatgatttaataatttattgaatactccatgtaacaaacccatagtaattgtccaaagtagatgttgggatagaaggaaaaatacagaaaacttatgattgtacggtgatttgatggagagaaaagggagagagaaagagacaacttgtagtgcaaccctaaaaggaatttgaatgaatatagttagaacttttgtggtagaaatttcttctaaaaatgtggagcaactttttcctatcctacaaaattccttcaaatcagtcctacataacctttccaaaatttcacaagaaatgaaataagcataccattccatcttgtgcacacgtcccccagtagcgaaattgagtttctaggtcagatcttgagcctcgctggaacggagaaattttaaagatttataaaggatttaaattaaatctagcatagaacgtatgaatattaaaagaaatatagaaataaggaaaacataggattgtgataccatgatttaataatttaatgagtccatgaaacaaacccatggtaattgcccaaaatagatgtttggatagcttagaaaaaaaatacagaaaattaagattttacggtgattagttggagagagaagggagagacataagttgcatcgcaattctcaaacgaagtcgaaaaatatgaggttagattttattctagaattcctctaaaatacggacgacgaaattactttgaatcaatccaacaaatctacataggaattactctttcggactcaaactcctcaattttttcccacttaaaaatccttcgccctaattaaagttcacccgt

SEQ ID NO: 510 - DNA, 7562 bp, Oryza sativa; identical to SEQ ID NO: 509

SEQ ID NO: 511 - DNA, 6094 bp, Oryza sativa
cttttttacacgcccaacccttgttcggttcttccccccttccaacctgtgatgaagcacgtctccccaatagcccggaaccgcccgttccaccaccaatcgccatcgacgcgcgcccccaccttcgtcgtcccgcgcccaatgtagctgcagctgcagctgctggtgtggacgtagcgggagcggaggcaggagcgggttggctccatcgtcacatcgatgtgagtcgtcagctactgtggcccagcgtccgtccagcgcggcagcgggatgcacagcgtactgctggcctctgtgcttgctgctgctcttgtcactcgctctcgcccgtggccgtggccgtggccgtgctcctgttctctgccgtctcctctaccgcagtactccctcccagattttaatatttttaaccatctattttatttaaaaattttaaaattattatttattttttataatttactttattatctaaagtattttatgtataactttttttatatctgcataaattttttaataagacgagtgatcaaacagtgtaaataaaatattaaaatctcttatattacgggacggagggagtactaattagagcaagtttaatagtatagccaactactagctccaatttatctatagtcaatctaatagctcattcatgcctccatcggttgactttttttttctaataagccaaaacggcttattagggaataaaaataaatttgtaggtaaaacttttatatatgtgttctttgtaacttaaaagccaatgttgaaaaaaaattacgttgaaaatatttcaaaattaagtttgaaaattcaaaatttggcttattttttggtttattggaccattggatggaagcctcatacaatagttacatactacaaaattaatacctggtctcatctgtcatacacactgcgtcttaaattctgtgttatagctgactagaaatctgtagcccgctgcttttctctctcttcatttatcttcttaaaatatgtttacagctggcttatagactgctattgtccttgctcttagaagtaagagtatagtcgatacgcgagattcccccatcggcgacaccgccgcggccgagcccccgacacggcacaaaatttccacgagagcatgcgcgcgccgctgttccacaccggcctgtggcgcctatatatggggtggagccgccaacccaagtttcactttcacccccagaaaccccgcaacacacgagttaaaccgctactcctcctcctcctcctactaccactagtaggcagctttgagctttgaaggtggtagctactcggagtagtagtactagcagtagcatctgggagtgtgaagcggtagtagtagtagtgcactagtgcgtcacactcacacacacacacaagcagcagcagcagcagctgagcttttattttactactccttttaaaagaggggtgtgccaccactgttgtcgcctcctcagctcagctcagctcgccttccttttcactcacacgcgcacgctcgctagctagagagagagagagtgagggagcggcaataaaaagaagagagagagagagagagagagaggctaggcagctagcaggaggaggaagggaccgaccaccgcctgccgcaatggcgaccggcggcagcggcggcggcggcggaggtggaggtggtggtgacgatgtccacgggctcaagttcggcaagaagatctacttcgagcaggacgcggcggcgtcggcgtcggcggcggcggtggagtcgtcgtcgacgtcgtcgggcggaggcggcaagaaggggaagggcgtggcggcggcggcggcgcccccgccgccgctgccgccgaggtgccaggtggagggttgcggcgtggatctgagcggcgtcaagccgtactactgccgccacaaggtgtgctacatgcacgccaaggagcccatcgtcgtcgtcgccggcctcgagcagcgcttctgccaacagtgcagcaggtaaaaaaccaaaaaccaaaaccaaaatcttcttcttcttcctcctcctcgtcgccgtcgtccagccattgcccctgcttcctctgctgctctactgttccacctgtgagcgcgtgagtgtgacagacactcaccaatccaccgtgtgattcgcccaactttcaaacggttcctgccaaaattcaaaaaaactccccactagatttggctacctcagcaagctctgattttaggacaagaaaaaagaaacaacctctgcaacttgcaaaaacgtagcagcaacgttggatttcaggcaaattaaattttgccgttttgtccctggccagattgagagattttcatgccctgtgtgtagtgtactgctgctgggtttgatagtagtagcgatcaatgtgaaatttaggacatgtggaacctgactagaatagtaagggacataaaagtgtccatccagaatatcttgtctgaggagcacacatatagtaagtctagatctcctttttttctattctagtagtatgtggaatgtggtaggatatgaagtatatatggggtagtagtaaggtactacactgtactactatgcactatttaatgccctaaaatggaagtagggcagcagagaaattgaggtggaaaacaaatcggatgaaatagtaactacaaaaccttgctaattaggaatgtttgctgacatggatgagagagaagcaaggagatgcaaacatggtagcttcgattaaacaaccgcttagcaacgactcttaacctctatagaatggaaacttttctgcatgagggttttaacaaggaaataatagtaataattttgtttttatgaatgcattgtttaaataaagtctttgttgtcgatctcaacagttgtaaggacatagtctctgaataaacatgtattatttaaaagactatatgggttctacctttgaacatgcccagcaataacgaagttggtcaatcatgctaaccaataattctcatttggttcatcagaaatcccatatacttactctaattttgtcctatatgttttcattttgtatagtagatactagaacacaaacacttatgcttatgctacataatctaaaatatcaaaatgaaataacatcatctgctatattgcatccaacaatttgtttggaaaaaatgcatactatttcatagttggtggcttgtggagttgtggacatatgcattaccggaaaatagaaggttctgactgttgtgttatttataaatctgctctgccgtagataaaacatctcttgactatttgatgtactaactaaagcctttgtttgtgctaaagtactatgggaatgattgcaggtgctctgtccacatggttaggtaacctttttattttcccggtcgtggtgtatgtgtatctaatcatgaaaggcgtgtctttggttagtgttgctacttagaacaaatacacattagtctaggattaaaaaaaagttgttatgcttgcatcgacgcagcttttcacatggcatgtggtttgatttatttatctgatgcacgctccgtattaagataagcagcaggggtagctgattcttgattacagagttggcactcctacttttcatgtgcttgcaattttctaaagtaaggtcactacaataagcaatagccccaccaaaaatgctcttcagcgtgctttttttttattgagttaaattgattattgcttttcattgtcagtgtagagtattttttatagcatgacattcttcattaggaaaactccttgtattcaattatatcctgcagtgtcactacgcttgtggtaattcactaatattttggccacttcaaatcacaggttccaccaattacctgaatttgatcaagaaaaaaaaagctgccgcagacgccttgcaggtcacaatgaacgccggaggaagccgacacctggacctctttcttctcgctatggccggcttgctgcatcctttcatggtaaaatgtggctcatgtttgtcctgttactctgaacttcagatgagtgtattgacttgttgcccctgcaacttttgtttcagaagagccaggcaggtccagaagctttgtggtagatttctcatacccaagggttccaagcagtgtgagggatgcgtggcctgctattcagcccagcgatcgcatgtccggttcaatccagtggcaagggggccatgaactccatcctcaccgcagcgcagttgcgggatacagtgatcaccatgcgttcagcagccatggtggctcagcggctggggcaccaatgctccaccacccagcctttgagctcacctcaggtggatgtctcgcgggagtcgccaccgactccagctgtgctctctctcttctgtcaactcagccatgggatactacccaaagcaccagcagccacaaccggtccccgccaatgtcgtcaacggccagcgccttcggaggcggcaacaacccggtgtcgccctcggtcatggcaagcaactacatggcggcgagccccggctggaacagctccagccggggccatgacggcgccaggaacgtgcacctgccgccaccgcacggggttgtgctgaacgaggtccctccgggctctgtccaccacggccatttctccggcgagctcgagctcgcactgcagggaggtgccccgtccaaccggccggaagccgagcatggctccggcagcggcgccttcagccactccaccaatgccatgaactggtctctgtagagaccattgatcatcttcttccccaccgtcactgcgccttcatgccaagagacatggaacattgggcagcctagttttgtgctccttaacattgccatttaggttttcaggatggagagggaattcgtaactgattaggccagtaatttcctctcgttgagcctgatgtgtccatgaattcaaaacacccgaagagatccactacctgtagaactccataaactgggagaattgatgtgttttacttgacctattttaatctcggattcatcttaaattggtttttgaaatcggtacgtactggaaaacattacgagaaaggtaatcggggcctgtcttgggactcttggtctccttcctctggttgagaatccttctccgacacggacacacgcctcggtcccgtgtcgaacacctcgtggcgcggcgcgatatgtaccatcgtgagtctccgtttactccgtgtgagacgcaactcgccatcacacgacgatggattccggcggtggcggtggcggtggcggtggcaacggcgacacgggcggcgagggctcgacgtggacgccgtggtccggagtggacgcggcgccgccccggcgcggtggcaacggcgacaggggcagcgagggctcgacgtggacgccgtggtccggggcggacgcgacgccgccccggcgcggtggcaacggcgacacggccggcgagggctcgacgtggacgccgttgtccggggtggacgcgacgccgccccggcgcggtggcaacgaagacgcgggcggcgagggctcgtcgtgggcgccgtggaccggggtggacgcgacgccgctccggcacggcatcgacgccaccgtggatgagatccgcgaggcgctggggctggcgcccgtgtcggccgccatggcgcgccgccgacgcgcggcggagcacctgcgccgcgccgcggagtacgtggagctgcgcgcgcgcgggggttgccaccacgacgacgcgcggtgccgccgggtgcagtcggcgctggccgcgcaggtgcgcggcgcgtgcgcgcggtgcgggtccaacttctgcgtcgtgcccgtggtggaatccaccaacgtctcgggcgaacagtgcgttcgctgcggctgctgcggcgagcgcgtggatttggcggcggcggcggcgctggtgatggctccccccgcggcgacgaggcggcagcaagggtggcaaccgtgtcaccaaggctacaacatgtagcagcgattctctgacttactgacgtataaaccatactactgacggacataatccctccgtttcataaaaaacgaatctagaataaaa

SEQ ID NO: 512 - DNA, 5226 bp, Oryza sativa
agtacagtgcgcgggcgcgagtaaccaaggacgtgaggtgaggcagccaaaggcagcagcaccgtcgcagggaatggcgcaggaagcggccaaaataggcgtacccgtacgtgctgcaccgtatcctccccaacgcccagcacggggatgttatttcccccaaagcacagacataccccccattccccagccaataggcactgggccgccctgtagctgacactgacaactggaccaccgccgtactgggccccacccccgcccgtcgcgctgcatgcatgtacacacccacgacctgcctcgcaggcttttttttttcactgcccaccaggtacgtaccccatgtcccatgtactccaccgcgtagctctgtggatgcctctatgacatgtggggccatggatagaatgggcccgtcgacaggtgggctgctgcgcggttgtcaactggtgcgttggctgggagaatctatcgtgccgtccggttccggatatgggtgggatctttgcgcaagtggctcccgtgatccgtacggacgcggggcacggctcgccgacaggtggggctcgtccggtggcaccagaggtgttggcccggcgtgtcagtgtcgggggaggcgcgcgctattggttggttggttgacgcgcggtgcgcggatgagcgtattgtcacacagcgcgcggcgtttaatgccgtggcagtcatgtcacggcgcagcagcagcggcagaggcagcggcagcgggcgagggggggcccgccttcgattgaacctgtcaatgacacagctccatgtggcggtggccccacatgtcacgagccacgctcgtgaccccaccacacaccccaatcctgacgggagatcccacatgtcagtacggcgcgtgcttcctcgccagtaggctgctcctccccgggggtgcgcttcgcttcacaaaccctcgctgcctggctgcttcgctttatatggaacgccagtgcggcaaacctactcgctgtacttacaaccgccgccgcagcctttttcccaatcggcgctagttttcgatccgccgccgtcggccggagcgaagccaagcccgcgcgaccaggtggctgctgctgtgtaacgacgctagctagcttagctgcggtacgtttacacataggtccgtccgtgtgcggctgccaccatggaaggaaacggctgcggcggaagcggggcgacaccacgtggtgtcgttgggatgcactgggctcccgtcgtcacctcgccgcctagcccgcagccgccgttcctcccgccggcgccatgcaggcccgacgtccagatgcaacagcaaggcgggctgacctgcctcaagctcgggaagcggccgtgcttctggggtggcgacggcgccggccaggtggcgcaggggagcggcggcggcggaggcggaggcggtggtggttccgcggatcaggggaagaggaaggagaaggcggcgacggcggtgccggtggtgccccgttgccaggtggaggggtgcgacattacgctccagggagtcaaggagtaccaccggcggcacaaggtgtgcgaggtgcacgccaaggccccgagggtcgtcgtgcacggcaccgagcagcgcttctgccagcaatgcagccggtgcgtcaatcaccacgatctacgtcacatgtctagctctgctacacgcgtgctcatagcggtctttcacttgtacgcgcaggttccacgtgctcgcggagtttgacgacgccaagaagagctgccggcggcggctggccgggcacaacgagaggcggcggaggagcaacgccagcgaggccatggccaggggctctgcgcacccacacggtatacacaaaacaaactcctcccgtcccggccgtaacagttccattaatcatcatactactagtacgtgtagtacgtacgtactactcccagtaatagttagggagaccaatggagaggcaggttagctgcacaaacaggagcgtaccactcccagtagtaggagtactggttggtttgatgccgggaaacaaggggagagctgcaggtgcgcaccaaaaagctcatcgggatgtgtgagacgctgagagcacagattttaatgcacgactttatgtgcactgcgctgcctgcctggccggcccagccagcctgcttgcttggagtggcagtggctgcgtggccactggccaggccgaccgtgcatatgatcaccatggcatcaacaggaacccgcgcgccgggtggtcgctgcgcacgcaacacggcaaacagtggtttcatccatccatcttccactccttatcaagagcctgtatgcttacggaaatctatactactacgtactagtactactactccagtacgcatgtacatacatacgcgtacaactgtacagttaattacgaatagttactgtacgaaggtatagtgctatagcgggactggccgaaagacttggacatacggcggtcgaatttcatagcggcattctaggatattcaagcgtgtattgattgatattgatatgctttcatgagtatagttgtactactgaccttcaaaggtaagcacggctctgcagttcagaaaccttgtatatatgtatactccttttgtcccataaaaaaacaatatagtgtcagatatgacttattctaatactacgaattttgatatacatctgtccagattcatagatttatttttataggaaggagggagtactccttttagtctaccactacctttctcttgttctgagaaactattactcctgcagtagaaaatacagtacatggtactcctgctgcactgacatagatcctgtagatgaacatgccttatattctgtgataacttatgtactccagtatttatgtggactttgatttggagtaggtccttctggctgtcttacagagaaatattatggaatgcaagatttaagttagttgcctcaaacaataaagacattaacaatcgtaaccaccacaaactttcgtgtcaacataatcaacaacagcataatgggcctatcttggttaacaataacattagtacgtattaccatggacctaaacttgacatcaaggtcgagtgcacgtttttactatgctagtgacccaaagcccatcagcattattgaccacttgaaacctgttatttgatcaacacatagacatgatgttgtggaagatcaggtagcgatcagtttgtgtaaagatatatagtatagtatcaattagttgtacccggtgaacatgcatggttggttggttttaaactttgtaaatttggttgcaaatgatcagggcaagcatgcaaaaatgattgcggttgagtaaccacttcgttattaggactgatggtgtgcattatgctttcttgatatgactataacagatggccacatttctgtaggcacaatgatatgcataataacgtgtcgacgttgttgttgcaggtatgccggtgctgggacacggtttcccgccgtacggcctgccgacgtcgtcggctggtgctctctctcttctgtcatcggctagagccaccggcccatggctgatgccgacgcccgacatctccgcccgctcaagcgcggcgctcgacgagctcatcgccgagaaccgcgcggccctcctctcgtggcaattcttctccgaccgacagccgccaccagctggccgtccaacgggccgcagcccgggctccgaaacggccggtggctggcacgcgcacctgcaggcgcggccgccaccgcccggcgccggagggcagcacgagaatcagtcggggcacgtgacgctcgacctcatgcaggccaccaccgcggcaggaggcagcggcgcgccgttccggcccgtgccagcgaggccccccaaggagggcggcgacgccggctgcacctccgacgcgtggacgccgtcgcccatggagggcgcccgcgtggtctgagtgtccgacctgccagccgcgacgtcgccgcgcgtgcaccacggtccctagctcccgtgtcagctgggcgtgggaagcgatcgatcagtggtgggcgcgcgcgcacggctggagctctgtcccgacgccgcgcgcagccgtgcaatcaacttgagttcgttggacaatagtgtctcgtctcgtagcaatctatcccgatgtagcagtactggtgcagtggtggtggtggtgccactagctagcaatgttctattttttcgctctgcttttctgatggattagaggccaattgggtggacattatttggtggtcacgggcgtgtttctgccatgatgtcgtggggggagcgacgaaatgctgtcgttctctgttctcctcttgaggggaattccaacccaagctgcagaccccaaagccctccgcatgatcacagttcgacgtgtgaattgtgaccgatgctacctccggcgccagacactaaaactacatggcgcttctcccgtgatagtcacgtatttgttcggttttcttcagtgacaaaacgtgtattgtgacagatactaaaactatggatgtgataatgcgatcttatcaggtcgtcgcattgggttctagaagacagagacgcggtcactgtgcgatagtgcctactagagcgaatcccccagatcctctcgatcggcggcaatgtcaggcggggtttgttggatgtcatgtcggactacaaagtcactgattagtaaaaccaaacagtgacagtacgtttggttactgttctcttgtccctaacattttgggtgtgtttagttgggaaaaaggaaatttttgggtgtcacatcgaacgtttaaccggatgttggaaggggttttcggacacgaatgaaaaaactaatttcagaactcgcctggaaaccgcgagacgaatcttttgagactaattaagccgtcattagcacatgtgggttactgtagcacttatggctaatcacggactaattaggcttaaaagattcgtctcgcgatttcctccataactgtgcaattagtgtttctttttatctatatttaatgtttcatgcatgtgtctaaagattcgatgtgatgtttttgggaaaaatttttgaggaactaaacgggcccaaagttggttccgaataatttgtgctacccacatcggccattgctttgatgattaacagctcgcgcacggcgcaccggctgatattttcaggaacctaagaccaacacatctttgtcttaga

SEQ ID NO: 513 - DNA, 4040 bp, Oryza sativa
ttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacattttttcctctccaaatctattaattaatgatccatttcaattcttcatcactgatttattcaccaattaattctctctttttttttcttccactacgctccaaaacttctctccctatatatacctctcccttgtacttgtccagttcttacactcgtctcactttactactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctggtatatatacatatatactctcccatgcattccatgcacatacactctacgtatatatctacctctacgtatatatctacgtattgatctacgtataatatacgcagtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtatagatgtgtgtgtgtatgtatatttatattcctacagtggaataggccatggatgtgtaagctagtgcagctacaagtctgcaactttgtaggacacatctggctttgtactgttgtgcaagcaagcatgctctcaacaagttaacaaaccagatgggccagacaatgcatgcatgatccacacggatacaatgcaagatgtagaagaagagaagaacaagcaagaaatagtacatggttatatgttcagggaagctcgaaattctgagaagcagctaagatgagtagctagctggattttgtatgaatgaatgaatctgaaaaagtaaaactaaactggattttgtatttcctgatttctagtttatttttttagattttacaactataaattcttggaattttgttaaagaattaattaggattctgtttgagggagtcgaagatttcgagagaagccatggctccgagaagctcctcgaaacagggctacactatgtgctagcttctttttttttctttttttctttttttttcttttttttatgccgggaacactatgtgctagctgtgtgtttacgaatcatgtacataatacatgtggggcaagagcctgaaagatgcagggtttgggcttttcctgcaagcacaaggccacaagggagccccttttgttctgaaagagtgaaagaaattggagatctctgcagggatccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagagg

SEQ ID NO: 514 - DNA, 5772 bp, Oryza sativa
cgttggagcgagtagaaaatttttggacaaattatactctaaaagtgtgccacaaaacgatctacaaataatcgtggcctggtaatctacagatacttaaataatcttgagtgaggatgataattgtgggccctactaactgccatccaaagtagaggcaaatgactggctcgtttcaaaatatcaaggacaaaatcgtaaaccctactttaaaatcacaattagaactaaaagtgagggcaaaaatgtgattgtccccccccccccaaacaaaaaaaaataatgtgtgagctagagggtttacatgccaatatccctccctaattctgttggaaaaaaaaagtaatgtgtggagctagagggctacatgtcaataaccttaactgccaacattttatctttacttttttttcctttaagaaaaatgacagtaggtaacaaatatattcagaattcaggaaatgatatatgcagaaaataatgctaataataaattaatgataattttctttaatacaaatccgttgcatcacacgagtcatatgctagtctaatccttaaaaatcctagaaacattatctaagtcaacaaatcaacaaataactaatattcttacatcagctactataattcttcgatgttgaatagatgaataattacgaattaattaaattgtaaagttgaaaaatcgattttttctaagaaattcacatatagaaagtttatataaaatcacaatgttcaatagctcggaaatcgtgcaaatctgctcactaaaaaaaatgctgactctataccgaatacacatccctatacgtataagtctataggtaagaatttttatatatagagaaaataacccgcataagtttatagagcatatggtaattgtgcatcatatgatattaggataaaatgaagaaaatataaaggtgagagtagagttttggataagcaaaaaatccatccatccatcctttaaagccgttggcggcgttggccggcccaacgacatcgacggccaaatcccccaatcccaccttccggaaaaccaccaacccggcagcggttttccggcagccactgccgccggacagccagccaccaccgttgctggctactcactctcacagccacagtgaccgactcggctcgcctcgcttgcagctgcacccaacccaacctcctcgccttcctcctctccttcctcttctcctcttctctactccactctgtcccacgcgcgcacacacgcacgcagcttcctcggccttggaggggtgaaggggggagggaggaggagcagaacgaaggatcttggggctcgggttggtcggggtatggatcggctcggcgcgggtgtcctaatgccgagctttcttggcaagatccatggccgccgcgcgagaaccctcgtctcgtagacagccctaaagccctcgcggcaggatggtcggagcgcgtaggtcagccttctcttcttctccttcttcttctccctggaatttcggtttcttggatttgcggttgcttcctccagggtttcgagctccgattttggggggatttgatttttttttctttttgtcgatctcatcttttgtgattaggggagttttcacatccagatcttgcttcgtgttactgaaaaaagaataaacatggttcgttcgtttgtttgatttgcaggcaaatcgacggggaggaatcaagaatcggggccttcgatcgctgcagaaaccgccatggacagctccagcaagctcgcgcgaatgcgcctgtgatagaagacttgtagttggagagcttgcagagccagattgtggaggagaagcagcgatgccaccgatcccatctctgtggatccgcgtcttcttctcctggctgctgctgtcgctgcccgccgcggctgccgccgatttcagccactgcggcggctgcgacgacggcgacggcggcggcggcatatggagcacggacaacatcctgcaatgccagagggtgagcgacttcctcatcgccatggcctacttctccatcccgctcgagctgctctacttcgccacctgctccgacctcttcccgctcaagtggatcgtcctgcagttcggcgccttcatcgtgctctgcggcctcacccacctcatcaccatgttcacctacgagccgcactcgttccacgtcgtgctcgcgctcaccgtcgccaagttcctgaccgccctggtgtcgttcgccaccgcgatcacgctgctcacgctcataccgcagctgctcagggtcaaggtcagggagaacttcctcaggatcaaggcgcgggagctggaccgggaggtggggatgatgaagaggcaagaggaagcgagttggcacgtgcggatgctcacgcacgagatccgcaagtcgctcgatcgccacacgatcctgtacaccaccatggttgagctctccaagacgctcgagctgcagaactgcgccgtctggatgcctagcgagagcgggagcgagatgatcctgacacatcagctgaggcagatggagacggaggactcgaatagcctgtccattgcgatggacaacccggatgtacttgaaataaaggcaacaaaggatgcaaaagttctcgcggcagactcagcgcttgggattgcaagcagaggcaagcttgaagcaggtcctgttgctgcaatacggatgccgatgttgaaggcgtcgaatttcaaaggagggactccagaagtgatggaaacaagctatgctattttggtcttggtactacccgaggatggttcactaggatggggtgaagaggagttggagattgttgaagtggttgctgatcaagtcgcagtcgccctatcacatgctgcagttctggaggaatctcaattgatgcgagagaagctcgccgcgcaacacagggacttgctgagagcaaagcatgaaaccacgatggccactgaagctaggaactcctttcagactgccatgtatgatggaatgcgacggccaatgcactcgatccttggtctagtctcaatgatgcagcaagaaaatatgaaccctgagcaaaggcttgtaatggatgccattgtcaagacaagtagcgttgcgtcaacattgatgaatgatgtcatgcaaacatcaaccgtaaatcgtgagtatttgtctttggtgaggagggcattcaaccttcattcgttggttaaggaggcaatcagtgttgtaagatgcctaactggctgcaaggggattgattttgagtttgaagtggataattctttgcccgaaagggtcgtcggtgatgagaagagggttttccacatcgtcctgcacatggtaggtactctaatacagaggtgtaatgcaggctgtctatccttgtatgtgaatacttacaatgagaaggaagagaggcacaatcaggattggatgctgcgaagagcaaacttctctggcagctatgtgtgtgttaagtttgagattaggattagagagtccagaggtaatcttttgagttcgtcatccagtcggagacttcaagggcccaactctaccagttctgagatggggcttagcttcaacatgtgcaagaaaattgtgcaggtatactataaactctttaatgttctatgtctgcaacaaagcaaaatgtatcaacattgcttgattgttttttttttctcatcttgtattacttataatggatcgagatgtacattgctacatgatcacatagccagactactcttgctttgctactattattcccaattcaaggatgtgcatatatgtttacaaacgctgtcagattgccaaaaccaggacagatttttctataaaagatgcgattaattgtttctcgataagtctaatttcttaatcatcaaattatgcaagttgcaatgtcttgtctgatgaataaactgaaagagttctttttttctgatatgagccccctttttttctgctgcagatgatgaatggtaatatttggtcagtctctgattcaaaaggccttggagaaactatcatgcttgcccttcagttccagctgcagcatgtgactccggtctctggagcatcctcggacttgttccgatcagcgccaattcccaattttaatggactccaagtcattcttgtggacagtgatgacaccaatcgggccgtaactcacaagctcctggagaagcttggttgcctagtcctctcggttacttccggcatccaatgcatcaactcctttgccagtgctgagtcatctttccagctggtggttcttgacctcaccatgcgtacaatggatggatttgatgtagctcttgcaatcaggaagttcagggggaattgttggccaccgttgatagttgctcttgcggcaagcaccgatgacaccgttcgggatcggtgccagcaggcaggaataaacggtctgatccaaaaaccagtcactttagcagcactgggagatgaactgtatagagtccttcaaaacaattgaaagagcctcatggttctcatttctttcaatctcaatagattgctgtagcttgattaatagttactacgctactagtttctgccaggttaggtccatacaatcacaaaacatttgcacaaacaaaatgtatagggagatattaaaacatcctgcctttaccttggttccttggtgaaggaaagaaggtagaaattttgaagaggtcatacagttagaacttacttattcatttgtaaaccctatttagattattaatcatttgtcaggtaaattattggtggcaatttgctgatgatagtttaggttcatgaactagactaggtaatgtgtttggacaaaatccatggagctgctgatttggtagttgcacttttgaaatggatcatggatagacatggattcagtgaatgaaatataaaaatcaaaagggacataacctgaaaggtagatggaaataagactacagacaagttgcaagcctatactattgctgctgactttgtatcttgaaattaagaactcttgttgtcccaatcttaatttggtggccaatgtcctagatgcaatgcatctgtgcattcattctggtgattgcctataagactaggaaaaggttttaacttgccatttctttcgcagtgacctctgtggctatatctgaatcctcttttttcgttttccctctattgtcaacaaaagcatgctatgttagcacttcgggacttgattgggatatcagcaacttcctaattgttgaactgtccaatcacaaaaaatcaggtagattgagtgcacatttttctgatgttatttcagttctcaatggctgttaatgtgaaaaacatgtaaacacttttgaaattctcaaatctggtgttgctctacaaacctgttcatggcaggcaagtggttgccattttccagctttattccacatgcaagatccaaacatacaagtgatttcagaaaaactaaaaataagaagtaaaatgtaagtttgattttctggggacagtcttcgacagatgtaacttttccttggggaaatcaaactgatagacgacaggttccttctttttaatgtgcatgaaatttttcaatcccttggtattgtcattttgaccccttataattaaacttgggactatattattctgagatgtaagacaaattctgccgccgccacgtattcttcaaacccaagcgttcatttcacctggactatggtcatctggtattttattgagaaattggcaagctgcctagctaaa

SEQ ID NO: 515 - DNA, 3956 bp, Oryza sativa
cgaaaaaatatactccctccgtctcataatataagaaattttgagtttttgcttgcactgtttgaccactcgttttattcaaaaaattttgaaattattattattatttgtgacttactttattatctaaagtactataaacataacttttttaaaattttttttaaataagacgagtgatcaaacaaagaaaaaaaatcaaaatctagcaagtagaaacggcaaccagattatcagagatggccgggtcacccacagccacatatgggcaccagtaacactacaacacaagcagttagcattaaacgatgccaccgagttggaatcgacatgcacgtgcacgcgcccccagcggatgccgatcacatcgttatcaggcaaggcaacagcatatcacgtcgcgtgggcgtggtggtagcagcagcagtactcgcccaccggacaccaccccatgccgcgcggccgtgcggcgccccgcgcgcgcgcgacaccacccgagccgatcgatcgttcgagccgcgcgcccaagcgcaccgcgcaccgcgcagcggcgcgggcgcccatctgcttatggtccacacgcgccgcggcgccagttgcaggcttgcagcgcatggttcccgtctgcggctagcgagagccatgtgggcggggcccccgcacgcgcgccacttcaccaagcagttggtggctctgttacgtactacatgcgcgcgcgcgcgcgcgcgcccgcggccgcgccggtgcggggaggacactcgcatgtgcgcctgatttgtatgtattaactgccggtggccaccgtggccggccgtggtcactcgcaacagagctggctggctactactcctaccagttatacgagtagcttttttactttctctcaccaaatcggggggaaggaaaagatgtgcacggctccgagacgagagtatccaaccgccaccggcactagcttggcttttggcttgctggctataaataccttaggcctggagggccaacctcttcacactgccaagctccgcttcaagtgagctagtctagccagcgtttagacaccatcaccagcaatggcgatcgctggcgttctcttcctcctcttcttggcacggcaagcctccgccgccgggtacggcgggtggcagagcgcccacgccacgttctacggcggcggcgatgcttccggcaccatgggtgagtagtagaatctcatgcgcagccggcgaatgcagcgtgttgctgtagctcaacggcgagaatgacgatcgaaatggtctttaatttgcaggcggggcttgcggttacggcaacctgtacagccaagggtatggcacgaacaccgcggcgctgagcacggcgctgttcaacgacggcgcggcgtgcgggtcgtgctacgagctgcggtgcgacaacgccgggagttcgtgcctgccgggctccatcaccgtgacggccaccaacttctgcccgcccaactacggcctccccagcgacgacggcggctggtgcaacccgccccgccctcacttcgacatggccgagccggcattcctccacatcgcccagtaccgcgccggcatcgtccccgtctccttccgcaggtcacattctcttcgccttcacagactctcagctggtttctaccgtagtagtagaatcgaacaagtttaaacaaccttgagaaaaaaaaacacgttaaaacttaaaacgtaccaatagtggtcagttatgacttgcgactttagtcctgtactaccgccacgtcctggcacgatcggccggatcaattaaacacgcgacgtcggtcggtttcaactttacgccgggccccacattaggctcggccgcgtgccatgagtgaccattagtttccgctgggaccagcctgcggatttgatacgttgcatgcagataggccgctgctgctgctgcagcagcaactgcgccacgtacagtggctacgcatgtgcatgctgcgtcgtgccattgtcacgtactgcctcacaccgattcggtcgcgggattcacctcaccgcgagatcgagcaagaaagaaaaaaaacatatgtactccagtattaaccgcgcggtctcgtgtgattttcctttttgctgcagggtgccgtgcgtgaagaagggtggggtcaggttcaccgtgaacgggcactcctacttcaacctggtgctggtgaccaacgtggccggcgccggcgacgtccgctccgtctccatcaaggggtcgcgcaccgggtggcagcccatgtcgcggaactggggccagaactggcagagcaacgcgttcctcgacggccagagcctctccttccaggtcaccgccagcgacggccgcaccgtcaccagcaacaacgtcgcccaccccggctggcagttcggccagaccttcgagggtggccagttctagccgccaccgacatcgccgtctccgacacccacatataatagcacggtgtccttcttcgtcttcgttctcgtcgtcgtctttcttccttgagagattatttattttgagcaagagagaaagaaaagcctcttcgttatagtggagaagaggttttgggctatgctgaggctgctaattagcacccgcttagacgttttccttctctggacttcgtccaataatgactggaccggtccaccatcatcaagtgtagtggtagtagtaaaggggagtactaagcttagtactacttgaagaaaaaatcaataataattgtattgattaaatttctacttttgagcgttttcttgtaccggagtgatggccttgcaacggaattaaaaaccgcgaggccgtgttttatttatcaaggggactattgatgttgtactttgtcgtagctagcggctgtagcttctctgttcctgtattgtttgggtgtaatggaggagtaatcaattaaggtgtacttattcctttgtgagggatttaattgatgcgtacttaatccccccggccgtacgtatcttctcgtcacatgggatggatgggcaccgggccggcgatgttcgtgggggcatgcttgtcgtgcctttctgcagccacgagcattgtcggttttgccgtgtgtgaagctgtggacgataagcttgtgagtatcctttgcttgcgtccacacgcttgaccccgttcttcgatagtatttttagcagtgtgatgaacagctagctaattaaacggctattgctttgctttgctcccgtgcaaactttttgaagcttcggggcgtcgtggctgcgtgcagtgaagcgtggcggtggagactggagtgtgctgtgctgctgttgttttagtcggtgccgtgcagtgctcggactccggcgctttaccgcttttgtcatcctgtcgggcatacgtacgttcgccgcggcgaccgctctcagcttgagctctcgcgtgcgcgcggcggagcgtagcggttggcgagcgcgcgacggcgacgcggatcggggctcgtcaccagcttaggaagaagcatcaacagcatcacgtacgacacggcacacacacctcgtcacttcgtcagctcgatcgctcgccgccgctacggacgacgaccgggagggcagggtgcgggggcggtttctagcgtggttcaccggccagtgtccagcgggttcaccggccagtgtccagcggcaacgtttggtctggtcctgacccgagaggcgagcgtgacacatcgttgacagcgacacggaaccgttccctaactcatcgttttttttttttttggaagcggttctctaactcatcgttggattcgctagaaaggggagtaacgtctttgcgtgcaccttgcatgcagggtttggtgggttggtgagtggtgactggacgttggaaaagctctcaggcccagcatctggttttgataaggccgatatcctcgagtgggctcgtcattaattggaggcccattacaggggaaa

SEQ ID NO: 516 - DNA, 3889 bp, Oryza sativa
tcaccctatcaaaactcttttcatattagactacctcagtttatggtcaattatatagatcctattcgaagccaaccctcaatccatttttttcgcaaatttgtgtgaagctggatttaaaatatataattcttgaattaaatataaacaactctcttatttctattagcctgttataatttatatacaactatatctattaatttataatctagaccaaccacaatctaggaatgtaaatctttctgtttttcttattaatgtagtaataatttctaggtttttgtgaacgcgcaataatttctaggtctctctagagtaacatgaccttattgcggagttgtttgtccagtcatcaatctggtggtggcacaggcgctggggtgttttgtagtttctacttgagtaaattgcataaacgtgaatttcacgttttaaaaatcaaacatgtgaagtggttgtctaaatctcgacatagcgtcatgtcgcagtacaacaacacttctgcaacgccagccaaagaaaaaaaaacttgcatttagataacccttgcatgtccaagataaaattggcccaagtgaaaaactcagaactacataaataattttcgcaaatggccaaaactcatttttggatgtggtattttgacgtgtgggcatcacaggtgcacgtgaaaacccattttcacatatggatctgttgaggaggctgcttgcaaaactgatttttgcaggcaggcaagtaaggactttcgactagaacgatttttttttttaaaaaaaagaataaacactacagatccaagaccctatagctagggtaagccgcatgtggccgcggccgtgtggtccgttggctgggtacaaagagcagagtgggctaagcaaataccgggttgtggcaccatccctttcacattcactcgctcttgatatctttctctctcatggaaaagaagagataagtaattttaattgatgccgggatagagagagagagagagttaagaaggtagctaggggagagagcgaggttgatgccgtgatcgatcgatcgatctgttggcgcagcgtgtatataagggcgggaaggggagtgagagagagcagcagctagctagccgcggtcggtcgatccagctgctggggatgagtacttagttagctcggagctagctactaatggatgatatacttatgctagttagttaaatacagttattagttagttgtaggttgcatctatcatatctccatcggttaattaattgattgatagctagattatcaacaattaatgagcatggtggtgcagcaggagcaggaggtggtgttcgacgcggcggtgctgagcgggcagacggagatcccgtcgcagttcatatggccggcggaggagagccccgggtcggtggcggtggaggagctggaggtggcgctgatcgacgtgggggcgggggcggagaggtcgtcggtggtccggcaggtgggggaggcgtgcgagaggcacggcttcttcctggtggttaaccacggcatcgaggcggcgctgctggaggaggcgcaccggtgcatggacgccttcttcacgctgccgctgggggagaagcagcgggcgcagcggcgcgcgggggagagctgcggctacgccagcagcttcacggggcgcttcgcgtccaagctgccgtggaaggagacgctgtcgttccggtactcatcggctggagatgaagagggcgaggagggcgtgggtgagtacctggtgcggaagctcggggcggagcacgggcggcggctgggcgaggtgtactcgcgctactgccacgagatgagccgcctgtcgctggagctgatggaggtgctcggggagagcctgggcatcgtcggagaccggcgccactacttccggcgattcttccagcgcaacgactccatcatgcgcctcaactactacccggcgtgccagaggccactcgacacgctgggcaccggtccgcactgcgaccccacctcgctcaccatcctccaccaggaccacgtcggcggcctggaggtgtgggcggaggggcggtggcgcgccatccgccctcgccccggggcgctcgtcgtcaacgtcggcgacaccttcatggcgctctccaacgccaggtaccgcagctgcctgcaccgggcggtcgtcaacagcacggcgcctcgccgctcgctggccttcttcctctgcccggagatggacacggtggtgcgcccgccggaggagctggtcgacgaccaccacccgagggtgtacccggacttcacgtggcgggcgctgctggacttcacgcagcgccactacagggccgacatgcgcacgcttcaggccttctccgactggcttaatcatcatcgtcacctgcaaccaacaatatactcctagctcctagtcctagctatatactcctattatccatccatccatccatcttacactactataccattagcatcgatcgatcatccattaattaattaattaattactagttccggcttagatatatatctggcgattatttcagttcctagctactcctacatgcatgctttgcttaattagatctatctatctaatctatcccggccggcctgttttaattccatatatcatttggtttgcacgtacccatctatgatctatatatacatgcatgtcgactattgttggtcgtacgatattatattatatatagatgtaatacatatgttgaaaatatattgatttcttcttgctgtaggagtaattaattactccagttgttgctgtcactcgatcaatccatgggatatggggatcgatcggacgatatgcaggaagctcaaggacgatatgaatgatgcatgcatgtgtaaatgtgttgttgtgtttggtttctcttttgtcgtttcccctgcccgtccgttcgtccctcagctttttacctatatactatagctacctacacaaacaaacaaacaaagaaagagagacatatgaatcgattactagtaacatcgatctatcaatggttgcttcaatttctacttctcaaaagaaaatggctggctaaaccttgggtggggcgggtgacgccatgtgatgaagtagataggaacctcttcgccgcctcaacaaacataacaatatgggacggaaacacggtgcgatcttgggagtccgcgtggattggtgggcgaagacccaaagacctcatgccgcttgtctatgcgatctcaaaaaacagaggaaaatcccttcggcaaggaaaggaggaggacgcctgggtgcaagatttgaagcttgattcacaatcatctatcacagtcgacctcgtcgaacagctagtcgcactgtgggaagcggtccgaaatgtgcacttagacgttggagaaccggatcagattatttggaagttcacaaacaacgggcattacacggcctcctcggcttaccatgtgcagtgctgcgggacgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacaccaagaggatctggcacctcatctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctaggaaatttggaaagagaggaatcggcggatttttgatca

SEQ ID NO: 517 - DNA, 4449 bp, Oryza sativa
gttggttagtttaatttttagctaaccaacgtcaaacaaaaaaatggagggagtataaaacaaactaactaattttgaatgctgaaattcaccatacgttatacaagttgtttctaaaatttaaattttaaacttgattactattttctccatcgaaatattttttttagcatttgacatttaaatcactaaaggcatgtgtttcatccattctattgctaattactcatgcagcttataattagcattagccaatggcaggggcggatccagcatgggggcggcggggtctcgagcccccactactggcgtgaagactatgagagaccccacaaagaccccactaaaaatttttaccatatatagatgggagggggactgtaactctatctagtttgctcagaccccactgctatttttttctggatccgccaatagccaatggagtcttaatagttttgaagatcaaaattaaaaaaatataaagttgttctcccaagttgctgtattttaaaatatccaaaatatttagcataaccacaatattgacaacaaatatcccgtaccatactcgaccaaagatatttcttttgcgtgttcgcgtacactgtggctagtgggtttttcacgtgaggaagatgtgcgtgcctggatagcatatgcgatcaccttatatgcacctatgcagccatgggccggccgtttccccggtggatcgtgttcggacacgtcgcggcccctccacgacggccttggctccattgccaccaccagataaagtaggcgtgcatgcgccccacccccaggcgagtcagagcagcgcgcgcgcgcgcgcgagcgagcgacgccgtgagaaaccagagcaccaaaccgaaccgccgtttctcgcgtctcgccctctccgtgactctgcccgcggggacccgcgctgcagggggagaggcccacccaaccggcaggtgccctcccccgctctatatatacgcccgacctctcccacttctcccccacatgcacttgcagtcagtggtacaacaccacagcaacgcaccaccggccatcaacctcctctcccctgcttctcgctcgctctcctgccctgtttcttggagaagtgagcttaagtgagagcctctgtccctcgcacacgctattggccatggtggttctcgctggcccgcccgccgtcgatcacatcccgctgctgaggtcgccggaccccggcgacgtcttctccggcgtgccggtcgtcgacctcggcagccccggcgcggcgagggccgtggtggacgcctgcgagcggtacgggttcttcaaggtcgtcaaccacggcgtggccacggacacgatggacaaggccgagtcggaggccgtcaggttcttctcccagacgcagcccgacaaggaccgctccggcccggcctacccgttcgggtacggcagcaagcggatcgggttcaatggcgacatggggtggctcgagtacctcctcctcgccctcgacgacgcgtcgctcgccgacgcctgcaccgtcccgtcctgcgcggtcttccggtgagccctcaaaaccgacggcgatatataatatcagccccgtccgtttctctcggttttttacctagtgtttgacatggtgcgcgcgcgtcatgcatgcagggccgctctgaacgagtacatctcgggggtgcggaaggtggcggtgcgggtgatggaggcgatgtcggaggggctgggcattgcgcaggcggacgcgctgagcgcgctggtgacggcggaagggagcgaccaggtgttccgcgtgaaccactacccgccgtgccgcgcgctgcaggggctcggctgcagcgtcaccggcttcggcgagcacaccgacccgcagctcgtctccgtgctccgctcaaacggcacgtccggcctgcagatcgcgctccgcgacggccagtgggtgtccgtgccctccgaccgcgactccttcttcgtcaacgtcggcgactcgttgcaggtacgtacgcggtacagccccgacccttggcgctgccacgtgacaccaattccatcaacgcgctaccttcctctttctttaccatactttttcctttttccagaataattcccattaaactagatggtgtagattaaattactaaattaaatgacgtggacacggctgaaatggctgcgcctagtgagcgggtcaaccgggacatcgttccagttcacatcggtattaaaaagaaagaatcatcatctggacgaatatactaacccaattaagacgagacaagcaagaaaaggaaaggggttcacctgcatgatagcatatggtacgatggccacagcccacacggcagggactgggtttcgtagataactacgacactcgagacccaataactgccgccactaacgagcagattcagtacatgaacatatatatgtgtgtgtgttaggcatgaacacttctgttatgcctgcgtggcatctcattgcgtcatcatgcacacactcttaaacactttgtgcacttcccatatacagatggacaatatttctttatccgttagcacaagaagcacagatacgtttgattaatttttcgtgctgactattaccgtattacgcatgctgattataaccgtattacacatatgctgatagatatacatgtggtttcttggtcctgtacaggttctgaccaatgggaggttcaagagcgtgaagcacagggtggtggccaacagcctaaagtctagggtttccttcatctactttggagggccaccgttagcacagaggattgcaccattgccacagctgctgggggagggagagcagagcctgtacaaggagttcacatgggatgagtacaagaaggctgcctacaaatcaaggcttggagacaacaggctggcccagtttgagaagaagtagctagctagatgcctagcaacagaactggccggtcaagcaacaacgactttactgcatggcagctagctaccttagctatgtctcacgcacacgtacggtacaccatgaccacgagaagatgaagctgcttaagagagaaaaagaaaagaaaataaaaacaggaagaagataataacttcaagatgcacaatgtacagccaggttggatggatagctagatttttctcgtgtggctaatcaccgtgtgtggtgaggtgggctcctttcctgtttcggaatactgatcgatggatgaacagcctccaatagttaatgttaaccaaatatagcacaacaaaggggttcttttcttcctttggttgtttcttttttcctcttgcctttgattttctcgtcatgctttctgagcattaattatgtgtgcgtgtatttcggtatacgtaacgtacttttacctatgtgtgtatagtacgtggcttgtgttaacaagtaaatattatagtctctctctttcgttatgcaactgacttctgcgcggtccaaatgcattgatggagatatatctattggtgtacaatgtcaccttcaagattaatgaattttcatcactcaggatatccctttattattacatgtcatctaaatagttatcaaaaaattactaaaatagattaatatgaaatatatcactccactaacatgcaagaccaaatttgatttgtacaagttacaataaaaagaacaagttaaactgaaaatagttaccgtacattcacatatatatttgttatttttgttgtaacttgtgagagaaaacctagattggatgaacgccgtgcgtgcaactgaacaataacaaacttaccagccatcttaatccgtttgcatatgtgataagttcaaagtagtttagctaatctaacactgcccctcaatctaaacatcttatattaagataacaacttgtagaagttaaattttaacttacatatttgtatagtgatatatttcatattaatctatcttgtcttttttttaatttttttaagactatttaggtgacatgcacgaaacgagttaatatcccctccatggatgaaatcatttcccagatttcaagggcttcattcttatcaaattttgttttgctttttttcccctatcctgcttggtgcaagtgcatcgatcagctaatttctaggattctccatcggagcctagtagcttttatcttctctaactgtcgtgcgtgcaactgaacatgaggtgcataggagtcgtcttgagcaatttatggttatcttgtggtattctcttgttcaccaccacaatagacgttgtccgggtcccccatgcatgcgtccttttaagttgaatcaaatttttgcatcctccctcccttaatctccaaccatgagctatataacacccacactttggaattaaaaaatgattttcaacttacatctcgtgcattttatggttgtcttatgggaaaacaatcaattttgcatgcac

SEQ ID NO: 518 - DNA, 5647 bp, Oryza sativa; identical to SEQ ID NO: 225

SEQ ID NO: 519 - DNA, 4247 bp, Oryza sativa
gctccatattccgacgtcgattcctcttctcgatattactctatacacatccatgacttttcatcttctacatttcctttctcaccctaaaccctcattctaatccccttcgtctcctatccataccaatcagttaagattaatcagaatttttttttgcggcaaccgcaacagagtattcaggttgaagctaacagaaggtattttaggctctgattttctaggccccatgaacaattctattaatcttttatctcaattcgtttttcaacatctcttgtttttccatgcttgcaaacatatacatggccatatttgatttttcaactgattttggtcataaatatggaaattgaagccatggtgccttgtttttctatcaagtctggtcaatcattttttcttgcatgttatggtttttttaagaggacttgcatgttatggctgtgaaaatatattggtttcatatcctgaaggcctaaactaatctaacatctggagtgaatccttttaatagcaacctaagctatatcgatacatgtctcagccggactagcctctggcctcagtgtatagaaagcacagtacgcaagcaaacaacaacgaggctcagcgacgcgtagtcatatctgacgctgtcattgctcgttttttctgccgtttcagtcgtacatgcgtcggacacatgagttggacgtatagcaaagttgataaactttaggccatgaccaacgcaggaagcacccccaccattggtgagtgaagctaatgcctacgaaaggtgaaaaatccattcgactttggacgctagatcagacgtcgattcagtcgtttttcagtgccgggagtacagtcagtcgtcgtactcgcgctagttcgttcggttgttactggactcaacgcaaagaacggccgcgcctcttcgtactgtcttgcacatgagcatgcaaacgcacgtcacgttaaccctggtcacctcctaaccgcaccaccaccccctctctacctaacccgagcgcccccctctcctctcctctcctctctcttggtctctctcgcctttattaatacacacagggtacagcgcgccgtcttgcgaaaacagaaaggaaaccgagaaagagagagagagagagagaggtagggagggaagaagagtcactccacactccacactctcatcccctggtccctttcttggatcatgagaaaccgcgcaacaaaattgcaattctaggcagcatttggaccggggacttggctacgtggtgtttggccatggatcgcagcgtggaattaagaccggcgaggactcagcgacggaggcacccgcgtcattcctacgcttctgtgcccgtcgtcttctcgcagtgagagagagagagagatcgaccaggcgttcactgaattttactagaactcggcatgaagcgacccggcggtgccggcggcggcggaggcagcccatcgctcgtcacgatggctaattctagtggtaatctttgttctttggttttccttttgtggcaattcattctttggaggtgatggtgtagtgtgatatgtgcgggaaattgagtgttttgtaattgtacatgcgtgttttgattagatgatggatatggaggggttgggatggaggcggagggggacgtggaggaggagatgatggcgtgcggcggcggcggggagaagaagcggcggctgagcgtggagcaggttcgcgcgctggagcggagcttcgaggtggagaacaagcttgagcctgagcggaaggcgcggctggcgcgcgacctcggcctgcagccgcgccaggtcgccgtctggttccagaaccgccgcgcgcggtggaagaccaagcagctcgagcgcgactacgccgcgctccgccattcctacgactccctgcgcctcgatcacgacgcgctccgccgcgacaaggacgccctcctcgccgaggtacgtgccgactgagtcgctgccctgccgtgccgcctgagctgttgctctgcgtgactgcgtcgagcagtcgttcgtttgcgcgcataatgtctgatggcttcttggtcgcgcgaattgtggcagatcaaggagctgaaggcgaagctcggggacgaggaggcggcggcgagcttcacgtcggtgaaggaggagccggcggcctccgacgggccaccggcggcgggatttgggtcgtccgacagcgactcaagcgcggtgctgaacgacgtggacgcggccggcgccgcgcccgcggcgacggacgcgctggctccggaggcgtgcacgtttctcggcgcgccgcccgccgcgggcgcgggcgcgggcgcagcggcggcggcgagccacgaggaggtgttcttccacggcaatttcctcaaggtggaggaggacgagacggggttcctcgacgacgacgagccgtgcggcgggttcttcgccgacgatcagcccccgccgctgtcgtcgtggtgggccgagcccacggagcactggaactgaagcaaatccggcgtaaccgcagccgagagagagagttggaaaacactatgcctgggggaataaagaattctgcaggaaagcagggtcttatctgcaattttgtaaaaaaaatggacctctacgtacttctctagtctcttttgccaattctcgcgcacattagctgtagcactgcagtgtagtaaaatcctactactccattacctctccaatttctagctctcacttccctacttaaactcatctgagctctaatgtaagcatatgccatccaaaatggaccataaatatgtcactagcagtaggatggtaattaggactttttgaggaagtctggctgagcaaggaaggggacgactcaacgaacggcccacggcctgaacagtgtcgctgttcggtgggcccggcggccacgaggagcagccgttggcttcttcctcactgaccgggactctcgcctcgcggacagcgatccgacgacgtcgacctgctttggcttcgcgctttccacggccacggcgccgcctgctccggccgcctccgcgaaagcgtcgttccctttcggaacttggaacaaaagcttgtgatttcaccatggcgatgtgatgggatcagagcacaaccagagtttcccaaaccgccgggactagagttaccgcgccccggcggtaaggacggtaacagcacgaaaccgtgtaaaatttatcattaattattttttaaatttatttgaatttaagaaggttactacggtttttcttttaccttttaccgtacttaacccatgataagcacggtaaccatgctgttatcgggggttttacaaaccctgtgcacaactcccagtagatttcaatactactgcagctggttgtagtaggagtactacgcaggaacaaccggtacggtgagctagttattgtgagccggaacaccagagagtacgacataaactgcctgtgtttacagcagctcgtgcagcgttcagtgccatctgtttcgatgattcgtcagggttgttgtataagctttgctgcttgcatgccattgaagtgcatggagaaggttgatgaatgtgttgcgatgtgttctacttgctactgctactctgctagtggtaggtggtgcagtggaaaactgaaaaaatcatcgatatggttgccggaatattctctcgcgacttttgccttggtgctcctgaccaccgaccacaccgagtggaatattccggtgacgattgttgctgctactgcctggctttgtaattgtagcaggtagaatgtactgcggttgtcggcataattatcggcagagagagtaaaatagactcgctgatctgaacgtcactgcgtttgttcgtttctcgaagcagatcctcccggttctgtaacagcatggagtaataatcagacttactagtaccgtactgtggtttcggcctgctttattcctaaattttttttctagtaacatcacagcgaatttttgtatacatgagcattaaatataaataaaaaaactaactgcacagtttggatagaaatcgcgaaacgaatcttttaaacctaattagtcaataattagctataagtgctacagtaacccacatgtattaatgatggcttaattaggctcaaaagattcgtctcgtggtttccaggcgagttatgaaattagttttttcattcgtgtccgaaaacactttccgacatccggtcaaacgttcgatatgacaaaaaaaattt

SEQ ID NO: 520 - DNA, 4629 bp, Oryza sativa
aaaaaatatagttataaaaaataaggtacattcttatgtttatccggtattaaagtcaaactgattttctctgtagcctttgctatgactacttttgacctctgcttctcaattttaatttttttacaagaaatctgtaattggaaaaaaaacatgtacaattcaacttaatgttgctctcattgttcaagagggtgcggctcctccaatattactttaacaattgttatatgtagcatgaacatgaaataaaaataaaaaaaaactccctttggtttccataaataaataccaccattgattaacacgactttaacttagactatcaataaaatctgaatgattagatcataatgtatgaaagtattatgaatagtttaggatgcaacatacttcgttaatatagaataattttgaagtatttaaatattttttttataaaaaagacgagcaaccaaatatttaagatgaaaagcgtccaacgacaagtatttgaaggcagagggatgatacaatatggaaattgtttttttttgacaaatattttttaaggtgtgtttgtttgacaaatatatgtttttgaatacgtttgaaaaaaaaactctaattgcaagcttccagaagtcatatatttatgcacattgggtgtagctaggagcagttactaaccacagctacaattatggcacaggaacactttacaaatcctgaacaaccatccaatggaacttcactagttacacaccttgctctctagcctcctaaccttgattacttgatacttgtaagttgtaatagagaatccaaccggaggaaacatggatgcaaaaattattgtctactaacctccaagtggcctcactcatgctctaactaactgatctctttctcttcccctccaaaataaaaaataaaaaataaaataaaactcatatttcttctctctctctaccaccctacctagcttagaatatttaccatgcattctctctcctctcctcttctcttccctctctctatatatatactcatctccaagctgttcttggctcctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaagtatgtactggacctagcatgattttattattttttcatatataaatctggcattaatatgttacagtagttccaatttgatccttcgtatatatagttgcatcgtctaattactagtttacttaataattagtgagaatttagtgggattagtattgttaatttttgctaaagggataaaagatgaattatttggtgtgctgtttggaggaactttatgcatgtttagttttgatttatggaaaaagatccacatatagtagcagcataatggcatttggtgaaaaggtgtatgcatgtttaggttattagttagttctccccccccccccccccccctcttctcttcctttcttttgtttggatttatatatttgggagcttgctgcataaacttgagatgcccatgaagcaacacctttaaaagaagcacaaattatccatataaaagagatcctctggcagaaagtgcatatggcgacaccatcgtgtatgttctttgtcgcttgcaaagtgctgagcagataattatcaccatttttaatcaccattggctcatctgatgcctgctttgtgcagcaggtgtcagaaattgctggcgatgtagtggtactactattgtttttggtttattttttccttcatctcctggcagattccatctgaaaaaggagttgttttcgtattgttttgatttattttttttcctgaaaagaagataggatcacaacaaaatatttagaacgatcagaaaaggagtacatctgtatacaattaattcctgaaataatcatggtggccatgattcatgtggcaataactaaagttgatggcattttcattatacacacagtactaccataaagttgctgcaggcatacacacataatacattagttaacacagagttggtcgccagcaagaatattgtaacatgcatgatctagctggatggaacttccagtcacgaaagtaaatcatctcagttttttcacagcgccaataagttagaacaagatgtgaaaaaactgagcaaaagaaaaaaaaatcgatgtagtagctaatttccaatgttacacatcagggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactggtaaatcgctggccacgggaacctgcagaaacagattatcaactagtaattaatttgaatgcaaagtttgatccggaattgatgaaaacactgtgcatgaacctctctgtcagggaacaatatgaatgaggtgaatggctctgatgctgttacaacttatgaagacaaggatggtgactggatgcttgttggagatgtcccgtggcagtatgttactacttcattcttgtgcccccttaactgttttccttattttccacctcatgattagaatgcggtttagcgataccacgttcaagtttctcgcattagctgattggttactctgcaggatgtttgtcgagtcatgcaaacgcttgaggatcatgaagggttccgaagccattggtcttggtcagtatcttcagctaaaatttgctttcgtgtcaagatttatatcttaattcacaccccttgtgtgtgtggtttttcttccagcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtatctggtaagttaacatgtttgttaatcatcagcacaatatttttgtaacctggtgtgatcaagtggggggaacaagccatgtgcttggtgatggggaatccattactataactctagcctatctgtcttttgagttattaagaaggttgggtcttgacacatgatggtatgatcatagcatgaagcttccttgctctttctagagctgtggtgatacctaagctaagtacattgcataaacaaactaaaccataatctattcagcacacatttatgacagggaaatgcttccagcatataaagatgcctatgttatgtttggtctataatatgtcaaacatcatatgataaactctaggggcagtattaaataacagacgttcttgaagaatcacacaagcaacacagtagtgaaagtgtgaaaccgcaaccaaaagaattgtggatatcaaaattttaagtgtttacagagaattaaacggctgcgcttaagggcgtatgatgccaacagaagagtgacttaaaatcctcaatccaccagaaaacaacataacggtcctattgcattaccagaattggaaggcaaagggtgttttactgctcagaaattagcaaatgtctcaagagaactccagcacttgtagagcataaataatagacattatagcattctatacaaaaatattaagtgatggcttacatcaaactggagctggtgaaatgtacaacaactcgaggagatcccatccttccaagcagtaaagctctcccggaactttcaagataacagaagaccagaaagtaacatataaacagtccacatgatccatcaatcctgcacagcaaattacttcaagtgttcaataaacttgcaagcaaacatcatctgtgaatatgacattcaatccttctgaaagctatatcttcaggatcagaggtgggtccaactgcaaaagtggaaacatcgccaggctccatgcctcactaaccctgaacagcc

SEQ ID NO: 521 - DNA, 4084 bp, Oryza sativa; identical to SEQ ID NO: 368

SEQ ID NO: 522 - DNA, 10422 bp, Oryza sativa
gtaattatgtatatgatactatagttgttaaagctcaaccctttgtatgagcaggttaaggttgaaataacgggaagcgttttattcatttttattctcttttgtagagtatgtaataatgtaaattaagggtaaaaggatatttttctaatacaaccaatgactaggatcagccatttggcacaccaagtggtccaaatgatgatttagggcctgttttaaactacattttggattggttaaatcctcgattttcgttagtcacttaatatgaaaactttttatatagaaattattttttaaaaatcaagtaaatctagtttttaagtttataataattaatactcctgtacgcctgatcatccaaattatgttacttgttttcttttctgtacgcctgatcatccaaaacacaaaccaccttgaaacgtacgcagccctaagctaaaaacaaatatttaaaggatatgtgtggatacaataaaaagataaaaccgatcaaattaagtttactagattagttattcacccttcattcttcattaaactttgataatgtaagagctattggtagtcaaatcaacatcattacgaagtaaggatagctcaattagttaggttttttttaaaaaaaatcaacctatcctgatttaaatcgtagatttgatatgagtgctcgtatttatggttaatttttttagtggtacctgttgataaataggatgtgtgtatttatagggacgagtatgcgaacgtgtgtttagaaaaattaaaacatcatcgaccaatagtgttgggcaaactctaggccagcagtatggtggtggtgaccggtgcgcggcaatgcacccgtctctactcccccacttggccccttttatgggcgtgggccctacgcgtgtgcgcacgaggaggtgaggtgagacttagagagagagagatagaagggactcctctgctctgctctcctctcctatatccatccataatccattcctccccgccgtggccgtcaccgtcgcccctcgccggaggacgacgacgagacgaacaccaagagactgttccaccatacgcaatcattacacagacgtggggactatactatactatactcctatttaggtgcggatcaacactataatcatcggtgtttaactttcggtaaaacctatagcaaaattgtttatctatatactataacatcatgttctaagcataattagcatattatgacacctataaacacgttatgacaccaacaaaccaattttctgatccaccactgctcctatactcctatactatactggagtattactaccccttcctcctcgtgtactttgcacttgccaattccattccattattatataatcctcccctccaaacccatgcccctcctcctcctctcgtaacctcgctgctgcactgcacttgcgtaggagcctagctagctagctgctgcaggggctcgaggggtagaaaaggatggtgtcggcggccgccggttgggcggcgccggcgtttgcggtcgccgccgtggttatttgggtggtgctgtgtagtgagctcctgcggaggcggcggcgtggtgcaggcagcggcaagggggacgcggcggcggcggcgcgcctcccgccggggagcttcgggtggccagtggtgggcgagacgctggagttcgtgtcgtgcgcctactcgccgcgccccgaggcgttcgtcgacaagcgccggaagctgtaagcctagccacctccgccgccgccgccgtcccgaggcgttcggctctgactgacgggcatgggtgtgcatgcatggtgcaggcacgggagcgcggtgttcaggtcgcacctgttcgggtcggcgacggtggtgacggcggacgcggaggtgagccggttcgtgctgcagagcgacgcgcgggcgttcgtgccgtggtacccgcggtcgctgacggagctgatgggcaagtcctccatcctcctcatcaacggcgcgctccagcgacgcgtccacggcctcgtcggcgccttcttcaagtcctcccacctcaagtcccagctcaccgccgacatgcgccgccgcctctcccccgccctctcctccttccccgactcctccctcctccacgtccagcacctcgccaagtcggtacgtcctccttcttctccctctccggcgagctcctcgacgagatagagtgggtggatgaattggaggaggagcagagtgggtgggcgtgggcgagcgccggcgtgcgtgcacacgtgcgcgcccgtgtcaccacatggaagtaacttacacaaggccgggaaagggaaggcccaaaaggagtgggcccaatcacacacactctctctctctctctctctctctctctctcatctcatattctgactctagagagagagagagtggctcacctccatgtgggccccaccccatcggagtagagttaccactaccagcagccgaaaatccacgttcctgttcgccaccagagcgtgtgtttgtgcactcgtaaatgtttattttttctctgcgtattcctctggaagagatgcaaatacagtcttgaacatttgtaatttttagagatgaggatggaacgaaatgtaattgcaagaaatggtgatgaaatgcaaatgcaggtggtgttcgaaatcctggtgaggggcctgatcgggctggaggcaggggaggagatgcagcagctgaagcagcaattccaggaatttattgtcggcctcatgtccctccccattaagctgcctggcactaggctctacagatcactccaggtactctctctctctctctctccctctcatctaagttctctttctctctctacctgtagtactccatgtaaacctgcactgcaccacacattgatctctactactctcttctgtcagccactctgtctctcctttatgtctgatgttgctcagccctactccatgcagcatcagcagcagcatgatcagtgtctcagctgccatcaccattaacctctcttaatatgttctctctgtttcacaatcttggattaaatgtatacaattgcactcgatccattgcacatttttgacacattattgtgtgtgtggtcatcaggccaagaagaagatggcgaggctgatacagaggatcatccgggagaagagggcaaggagggccgccgcctcgccgccgcgggacgccatcgacgtgctcatcggagacggcagcgatgagctcaccgacgagctcatctccgacaacatgatcgacctcatgatccccgccgaggactccgtcccggtgctcatcacgctcgccgtcaagttcctcagcgagtgccctctcgccctgcaccaactggaagtaagcctgtatacctgaaacctctcttacaacacagtaagctcttaattggatcaatacctgcatataattagatgctagagatgaatcctgaacagaaaagaaaaataaaaccataccctaggaagtaattaaggatcctctgttgctgggcatgggcagtcagcaaaaagggtccagaactgaaaagagttggattttctttcttttttgtctgaaaggaacatgatcaactattcattttgtcagagccatgtgttgtgcatgatatactactatcactattgtctactacacacaatggcagaggatctgtgtccccaaacaaaaactagatcataaaaagcctacgaataagggagagatacgtaggtgggcagaagggatcagcagcatataaagggttgtgccaaccttggtccatccctttcttgttggcatcttagagctatcattattatttgttatctaatgtgccatctgaaaagaaatactactactacttgtgtttggaccaatctttgcaagatgacgtgcgttgcatcattgtcaatgtcaggtcgggtacatacatatcattagaacagagtcgccttctcacaaaagaaaaggcttactatcatgatgtatcatctacttacatatcattagtttgtgctattatgcgttttttttttctaaccggctataaacgcatgtgcaaggaatagtttttttggttgaagtatggagggttttttatcaactggggaaaaaagaaggttacataatttggctatttattctatggagattagaaggcagcagtaatatttcctagctagcatgtcctattacaccagtagcattgtgtcatatgctagattccatttacatcactacagtgctaagaaattactcgcgtgtcgactgtgtttctgttttgatgccatgtgagcaataaactcattgaaacctctgcatgtctaccactgttagagaacatgcatatcgcggctgaagataaaatccaccgtcagtaattacttgttgtaacaatgatgaataataacaccaatcacattctaatgctaccaggaggagaacatacagctcaagaggcgaaaaaccgacatgggtgagaccttgcaatggacagactacatgtcattgtcattcacacaacatgtaagtatagttcattaacactgtaacataaatttctatagctcaaaatctactggccccgtgtggtttttttcccatgaccccatgcgatttggaaaattggagtgtaggtgataacagagacgctgcggttgggcaacatcatcggtgggatcatgcgcaaggcggtgcgcgacgtcgaggtgaaggggcacctcatccccaaggggtggtgcgtgtttgtgtacttccggtcagtccacctcgatgatacgctctacgatgagccctacaagttcaacccatggaggtggaaggtaagaaagagccccacatttggtagagatgttcatccaattgctacccctttaggcaacaccagcataataaggatttgatgagtgcggttttggtgggactcctaacatgtgggcttacttctatatcagtaatctcatgatggatttgacattgccttgtactaacacttagtattgcagaaaataacagagattccctcaaagttgcattagtgattgatatatacacctaggcagaagtcaattgaatctcccaaaataactggatttggtagttctttgaactggtaaattcagacaacataagcttaagctgtccaggaaaggaatacacaccctttttttccctctattgtgtactttgtgtaagctctgaaaatgatatgcaaataattaatctaggcaaatgatggtgctgtactactgttgaggcatcctatcattatgatttgatttgggaagtctaataatgtgctaattggtcaagaaatcaatcaatctcaacaggagaaggacatgagcaatggcagcttcactccttttggtggtgggcagaggctgtgcccaggcctggatctggccaggctggaagcttccatcttccttcaccacttggtcaccagcttcaggtatggatcaccacatctcaatcttggccattcttagtgcagccattgattccaactccttagctttgtttcatgatcacttggcaacaatagcttttttttctttctagataatggaatacaaactacaacttttgcataattttccatgatcgctcggcaccgatagcatttttttctagataaaagaataaaaatcacgacctctacatcatataatgaatggaataaaaatcacggcctttgcatcatataatgcacgcaaccgggcaccaatggcatgcatctcatgtagtcatgtccctatcatttggccatgccctcttcgcatgcacattcatgttcctagtaataactaatctctgtagaacaatagaagagcggaacagtagatgaattatgcgttgattgacagaataattgtgggggggtatatagatcgggtacgtacatgaggatttgaagatcaagccgaatctttccagagataaaaaaaaaagaaaaaaattatgtcagataataactggtcctaatacgtcactagggatagcatcacgaggctttctcccatgcttatacctcctctgttatcatcttccttgagggagtgatcttactgtgcttaaggaggtatctaaagcggtggtgaagccagcgacatcgtcgagcccggataactaatagtgttttgtagtgatcaatccatttttacacgcgtcaacggtgattggtagtggagacgccgacagcgaagcctagacggtcgttcgacctggagccgtctccacctctgatcgaaagatatagtatggtattttcgcctctcacactgggagatacaactttcggcctacaaaatcaacttctggttttaaatctaagatatagattatttctagattcaagcttagaaattgttttttttaagagacagagatagtaccaaattctatttctataattttcttaaatacagtaaattatttcttctcgcgaggaggattacactgcgtaggaacactaggtcatttttcatgtgaaagaaaaaaatggaagctacgaggaagacaaataatttcggcgcgcggggcgaaaaagaagaagatcaaggaagatacccaaggtgggaggtcggtccagcctctattgcgaatagagcggggtgttgttccgcgcgtggggccacacgtgcgcgcacatgcggcgcatatccatcccttcccccccacacccacatgtgtgcatgcatgcggactacgccgctgtacgcgtgcgtggcttacggcgcccgctgctacagctacagcgcccgcacgtgtcagctaccacgccacgccctgcatgcccaccgccgctgcacctccccttgagacgtggtcgctgggcggtggtgggtctcacatgtcagtacgtctttcgtcaaaaaaaaaattcaactttaatttgtttttttcatggtctcacaaccatgtagcttaccaatgcaaacagactaatctaaaaaaaaaaaaataagcttagctataatgcacgcttcgattaagcaatgttacgatgcgtgtgcttagctcaggatagtgcctatattgacacgaaaatatactacatccatataaaaaaatataagcattttttactataaatttatatatttattcatatttatagctaaaaatacttatattttgggtcggagcgagtatcatattttgattaccagtcgtccatcagctatggagtctgtatagggctacgtcctacgttcgggaggtagaaaatatggtgatttattttatttttttgcggggaaatatggtgatttattaatatatgattaattaagtattagttaaaaacttaaagaataggttaatataaatttaaaaataatttttatataaaaaatcgtattgtttagtagtttagaaaatgtgccggatcgggttgagttgggaaaggaggcgggaagaagcgtggtgtagtaattggcgaagggggtaagaagggggagaccggagacatgggtgtgatggttaggcagccggaatgggctctctatcgactcgaacagttggatgagatgagacgagatgggtgacatgcgtgcgtgcatgcatactttgtgccttgtccggtccgtgactgaactgaatcccaggaacgcgaatataatactgtagcacgcacgcacgcacgcacgcatccagctgatctagccggccgagatgtgccactttgaccggtcgtcagacacgctgcatcaatgtaggagcacgtgccagggtatggtcgctgcatgcctgcctgcaaacaatactatactcctcccataaacaaatcaaactccaacaagagaatccgacttgctagaaaaacatcatatcactttaaacaatggagattggagagtccatcagtccaatgtgtttttctgtcttctttgaccatcttccaattccccattatgcttgtgctgacctctatctaattgatcctaagagaagcgttttgcaacatcttgtaaaaaagcaaatcacataatattactcgtgctttatgtagctaagctacattggatcaggatcctctgcagtcaaagtcacgtgactttgtcactgacattgtgggtccgataatcattgggtccacatgtcttacaaagacaatccggctacatcatcatgccagtttccgtaataaattgaccagtaatttagtactatggactttagaacctggcacatgcatagcacagattcatgcatgcgtgcactgcatctgcacgcatttgcattggttgcacaagcagctagctggcctacatataacatattactgtgttatgcgagcaactggccactgtccacatgaagccagtaaatcaactatcaacattgatagtagtaaagctcttgttcagagttgcaggcatataggtgctccctgcatggtttgctcaaacttaagatagatgatactacattctaaaaatgcaagtatttctggtatgtatctggacaagatggttaggactctagctataacatagaaaatgcttatattagaatacacttcattcgtctcaaaatataaggtattttgatcggatatcgatcccatccggttaaataccttaagtagggagtggcagtggcatcaccatcgatcatgtgttattgataaatgattatgattatgagatctcttatctacaatctctttctgaataatcgacctgctgatccatccattgcatgcatggttgttgcctgacaaggacattgaaatggactgctaattgctgccatggatgcaggtgggtggcggaggaggaccacatcgtcaacttccccaccgtgcggctcaagcggggcatgcccatcagggtcaccgccaaggaggacgacgactagccactagccaccactactactataccgatcaccatactcaactagtagaggagatccatcagatgcatgcatggatcgatgcagatcggtcggtcgagtacgagtagcccacacgagtcgacacatgcatgcaacaagccaagttgcacacaccaagatgcacatatatatcatctatatgtcgatctatactgctacctacctatatatatatatatatatatatatatatatatatatatatatatatatatatatatatatcacacgtgtactagtactactctagcaagggatatgatcaggaggggcaagctctgagcaatggtccctgcaagatggccagttgctctagccattgatagaggtgcttacgtatggtgtaattatacaggaagggtaggccagcattagctaggaggcagctttgttaatttagccaacatgtattgatgtataagctactgatcgattaattaacagtactactattgtagaactactgctcattggcctttgatttgatgctggtgctcatactatattagtggtgaccactcatactatagtagggttaatatgtgtacatggaggcattggtccacaaggagcaagtgaaatgaatcaatgggcacaggaaaagggaccctatgcaagcagcaagctgataggactttgaccactgagaagctgggggcctggggcagtgtggtgcagctgcggctgcatgcatctgctttgctttggagtgggggaaggaagagaagaagagataagcatatagggcctagagagagaaatccagcatggaacatactgcactgtagtatacatacgaatacaggacaggagaaagagagaatggactggtgaattgagtttcccttgatgtagcccagctttttgtgtgatcttttctgcaaggttcagctgcagacttgcagggggggtaaaagccactggatccttttgggagatatgccttcatcataaggctgatggttaaggcaccacacaacaaatgaagagcaacctaggggaaccaaactcaggttgccaaacataaaacgtcgtggctaatgattcgtctcaagagtcaagatcagatcagctgccctacttgtttgtttccctttcttgagctagattttcccggctttggaacatttataccactgaacatgtatcaccgcctttgtcttcctcgtgtcagatgctattggaaccctcatcttctctcacgaggatgatggtaagcatgatagctcgatgtcctacggcacgaaaatatgggtgacccaagatcaaatagcggcagcacaacgatctaacataatatctggactggacctcccttctgcagttccttccaaggtatgcccagtagagaggctaatgagcccagcttttggggagcaagggaggcaggcacgcacacacgcttgccctgccctgccttttcaattaactctcatgtggcctaatggtccaattaccatgggctccttactttcattaactctcctgtggcataatggtcca

SEQ ID NO: 523 - DNA, 5907 bp, Oryza sativa
gcatattggggaagcggagcaccctgaaaaaaaggtcgcacgccgcagcctccaccgcacgcttcttcggctcccggatcggatctaccaccccacttcggaaattaaagacaaaaaacccttcgcgaagcaacgcaagcccacgcgtccggttccctccacgagtccacgcccgcccagggattccgcacgctcggaacgcgacccgagcccatccgcgcgaggccacaccacaggcgtgaaatccccgcgctgcccacgagcccgccgcagcgccgcgcgagggcagtccggtcaatccggcgcgcaaccctccccctcgcgacggcacgtgaccgcgcctcgagcagaccaccggctgtccccggccgtcggatcggatcgggatttaacctcgccgtaagccgcggataagcgcgggggattagaatacttaacctctcctctgctctcctcctcacccggcttaagcgcgcgggggggctgcgattcgcaggcgagagcacatgccatgtgaccccaccccaccactcctccctcacctacagctgttaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgctctccccctctactgtgtttgcgtctttcttcttcgcttctctttctctctctctccatctcctcctcatcacttcccactctcccccttctgtctctctactttctctctctaccgccgctctcgcagcaggccaggttctctctaatggtcgtgaggcagtgagctcgctcgtacatggattccttgtgggcagcgatagcggcactgtttgtggcggcggcggtggtggtgaggggggcggcggcggccgacgacgcccagctgctcgaggagttcaggcaggcggtgccgaaccaggcggcgctcaaggggtggagcggcggcgacggcgcgtgcaggttcccgggggccgggtgccggaacgggaggctcacgtcgctgtcgctcgccggcgtgccgctcaatgccgagttccgcgccgtcgcggccaccctgctgcagctcggcagcgtcgaggtgctgagcctccgcggcgccaacgtcagcggcgcgctctcggcggctggcggcgcgaggtgcgggagcaagctgcaggcgctcgatttgtccgggaatgccgcgctccggggctccgtcgccgacgtggcggccctggccagcgcctgcggcggcctcaagacgctgaatctctccggcgatgcggttggtgcggcgaaggtcggtggcggtggtggcccgggctttgccgggctggactcgcttgatttgtccaacaacaagatcaccgacgatagcgacctccggtggatggtggatgccggagtcggggcagtacggtggttggaccttgccctgaacaggatctccggtgtcccggagttcaccaactgctccgggcttcagtaccttgacctctccggcaacctcatcgtcggtgaggtgcccggcggggcactttccgactgccgcggtctgaaagtgctcaacctctccttcaaccacctcgccggcgtgttccctccggacatcgccggcctcacgtcgctcaacgccctcaacctctccaacaacaacttctccggcgagctccccggcgaggctttcgcaaagctgcagcagcttacggcgctctccctctccttcaaccacttcaacggctccatcccggacaccgtagcctcgctgccggagctccagcagctcgacctcagctccaacaccttctccggcaccatcccgtcgtccctctgccaagatcccaactccaagctccatctgctgtaccttcagaacaactacctcaccggcggcatcccagacgccgtctccaactgcaccagcctcgtctccctcgacctcagcctcaactacatcaatgggtccatcccggcatccctcggcgaccttggcaacctgcaggacctcatcctgtggcagaacgagctggagggcgagataccggcgtccctgtcgcgcattcagggcctcgagcatctcatcctcgactacaacgggctcacgggtagcatcccgccggagctagccaagtgcaccaagctgaactggatttctttggcgagcaaccggctgtccgggccaatcccttcatggcttgggaagctcagctacttggctatcttgaagctcagcaacaattccttctcggggcctataccgccagagctcggtgactgccagagcttggtgtggctggacctgaatagcaatcagctgaatggatcaatacccaaagagctggccaaacagtctgggaagatgaatgttggcctcatagttggacggccttacgtttatcttcgcaacgacgagctgagcagcgagtgccgtggcaaggggagcttgctggagtttaccagcatccgacctgatgacctcagtcggatgccgagcaagaagctgtgcaacttcacaagaatgtatgtggggagcacggagtacaccttcaacaagaatggttcgatgatatttctcgatttgtcatataatcagctggactcggcgattcctggcgagctgggggacatgttctacctcatgatcatgaatcttgggcacaacctactgtcaggtaccatcccatcgcggctagcagaggccaagaagcttgcggtgcttgacctgtcgtataaccagttggaagggccaatacccaactctttctcggcactttccttgtcggagatcaatctgtcaaataatcagctgaatggaacaattccagagcttggttcccttgccacatttccgaagagccagtatgagaataacactggtttatgtggcttcccactgccaccatgtgaccatagttccccaagatcttccaatgaccaccaatcccaccggaggcaggcatcgatggcaagcagtatcgctatgggactgttattctcactgttctgtataattgtgatcatcatagccattgggagcaagcggcggaggctgaagaatgaggaggcgagtacctctcgtgatatatatattgatagcaggtcacattctgcaactatgaattctgattggaggcaaaatctctccggtacaaatcttcttagcatcaacctggctgcattcgagaagccattgcagaatctcaccctggctgatcttgttgaggccacaaatggcttccacatcgcatgccaaattgggtctggtgggtttggtgatgtctacaaggcacagctcaaggatgggaaggttgttgcaatcaagaagctaatacatgtgagcgggcagggtgaccgggagttcactgcagaaatggagaccattggcaagatcaaacaccgtaaccttgttccacttcttggctattgcaaggctggtgaggagcggttgttggtgtatgattacatgaagtttggcagcttggaggatgtgttgcatgaccgcaaaaagatcggtaaaaagctgaattgggaggcaagacggaaaatcgctgttggagcagcaaggggtttggcattcctccaccacaattgcattcctcacatcattcaccgagacatgaagtcgagcaatgtgcttatcgatgaacaactggaagcaagggtatctgatttcggtatggcgaggctgatgagcgtggtggatacacaccttagcgtgtccactcttgctggaacgccagggtatgtaccaccggagtactaccagagcttcagatgcaccaccaagggtgatgtttatagctatggtgttgtgttgctggagctgctcaccgggaaaccgccgacggactcggcagactttggcgaggacaataaccttgtggggtgggtcaagcagcacaccaaattgaagatcacggatgtcttcgaccctgagctactcaaggaggatccatccgtcgagcttgagctgctggagcatttgaaaatcgcctgtgcgtgcttggatgaccggccgtcgaggcggccgacgatgctgaaggtgatggcaatgttcaaggagatccaagctgggtcgacggtcgactcgaagacctcgtcggcggcagcgggctcgatcgatgagggaggctatggggtccttgacatgcccctcagggaagccaaggaggagaaggattagaaacaacaaccaccgacacacaggagaaacagccggcggtgagtggccaccaacgaggccagtcggcggcgaaatgcccgtagaaacaacagtcattcagaatcagatggatgccattttgaactctccacacaagcttagcaatcgcttctgatggtgctacaagataagaattttccagctgtaggttgatcagtcgaagttgttatgtacctataggagtagatcttttcttctttcttttttcgcagctttcttcgtctccctgtttgtttttcccgtcgcgtcgcagtaagagctgtgtatgtacatatataaatgttgaattttctttggcgcaaaatcaaaatccgcctaggttgctcctcgtcattttttccccttctcttgtctcttgacaatggtttaaatgtgcatgagttcatcaaacatgcaatgaatatttattgcagatggatattattgcagggtggtcattgcaagtaaatggcatccgaatctgagaagaagcaccactggagggggtggtggaggagggtggtggtgtgggagagagaaacatgacaggttgaacagcaaatggccagtcaagaggctgacacagctcctgtttccatgtgaggtagagcatggctttgcttgcgtggggtcaggtgcagtgagccagtgacacacccacgcaagaagacgcactcacgcagcacaagcacctttctttaatttcggggggctagcttgctttgtcttcaaatcatttcataagaggggcttagcttagcctttagttggtcaaaggttcccctaagcattttttgtcctctctgattatcctaatcgcctaggtaacatggctcccaatcttataataaccaccctcactattatacttgcatggtgctgtgtccgatgcttgggcgttgtcaaactaatgatgtgtgtgtccgcaaagtgagcggcacactggcatgcatgcagattcccccagatttcaagatggttgttcaaacgtatggttgctttcaagttcaggatttgagcttgcagtgtgctccttgtcttggtttgcccattccttttactgtgagagaatttagtgcagagcagagctagtcacattgggtaaaaattcatgaacttgctgaaaggcattctggttttggtctttatatctccacaagtagcttctccaatctccacagtctagacaggtcgttttctctaggccaaatgagtttttctttttcttcagtttttttttacctttgaggcttcgaggagctcaaaaaaagtccccatggagtctgtcccctgggtgcaactatagtggaacacatacacatccaacacaaacacaaagcctggaaaagctaca

SEQ ID NO: 524 - DNA, 14552 bp, Oryza sativa
tgtggctaccaatgcacaatttctctctgttttttttcccttgagaatcatgcgtgtgatagatgttgtacaagaactcaaccccaccacacttgattgaacgatgatgcctacactatagcaagcaaaaaccacagtgatttcccctgagatatcaaatcaatcatgtggcgaactcattaacgcgatatcaagtaaaatcaaatcgatcattcacgtgaaacaaatactacctccgtcccaaaataagtgcagctgtgggtatcaatgtccaacgtttgactatctgtcttatttgaaaaaaattttaatatgaccgtgtccaatgtttgacgtttatccatctttcttttttgggactgaggaaagtaatagctagagtttttcgagaatttaatatgagcaagaaaaaaaaagagtactatattttttttccacagaacaagatgaacctctagattgcaccccctttaatttaattacacatggaccacagataaaatccaaatggtcacacacaccattacttcctttccagaaaaaggaaaagtatggggagcaaaatttcccctcaaaggagagcatatactccctcattccctaaatgtttgacgccgttgactttttaaatatgtttgaccgttcgtcttattcaaaaacttttgtgaaatgtgtaaaactatatgtatacatagaagtatatttaacaataaatcaaatgatagaaaaaattaataattacttaattttttttgaatatgacaaatggtcaaatattttttaaaaaaattaacggcgtcaaacattttgggatggagagagtattatgcacaaggcagtcttaaacaaatgatagtacgatcccatctgattgggtgttgggggggggggtgtaaaaacgaggatgaaaagcgaattccagaattggtggagggggtggaggcaagaatccgtcgtgggaggccgagaaatccacaagaaaagatagtggctgagatttctccccggcgctcgccgcgagagagcgacccccacctctctctcctctctcctcttccccctcgcggccgcgcagcagcagcagcagcggaagcatccaggtagcagcagccgcgagcgagcagcgaaccgagccccccacatccatccatctcgcttggtttggtttggtttgcagtgttagtggcagcgagatccctttgctgttgttgtagcttcgggaggaggaggaggaggagttgtgacggcggcggaggagagagaaggaggaggggcttgtggtggtggtggtggtggtgatcgatgcagctgctgagccggcggcggcgaggccggtgacgcccgccgtggcggtcgcctgaggtagggtggttccggtttcttcggctcgccgttggttcgtcatctggttggtttgattcgcttcgcttgtgggtgggggcgcaacgcaggccgccgtgtggagggctggggcttgcaggcggagcgaggcggcgagcttggttgggattgctttgcttgctctcgaggtaatctgaatttttctaccggtttttacgagcaatatcgcgatgctctgctctagttaggattattattttgttctatactgtttgttttttcttcccgtttgattttggagcggtgtagtttttaccactggaattgctgttctgctttgtaattttgtactatggaatttatcgctgttctgctcggaatggatcacggatatgcagtagccgatgctatttggggataactgatttctgctgcttttgtcgcggtgttctctgcagggcgacggcgcggttgggcattcgttcggtggtggtggtgctcggttgcttcgctgaggcgagttctctctttcttctccgtgtgcgagttgagagagcggtgtgctcaattttttagcactcgtgcgaaactattgctttgttgcgtttagttcgtgggcactcgatgcgaatgagctctcttctcgctgatttcgatctccgtactggtttccatgtggctcggattaatcagatttgtggggacctcctcagggtagtggagttttttggtagagtagattggttgcaggtctaatactaactttctttcttctcttgttctggtggttatgtgtggcgatttttttttttttggcctcagtttcgatgattatgggagtgactaaggttgcatcttctccgcttagcatggctgttaaggaaactttttcctgggattggtttgttcaagcagagctagtatatctagttgtgtttcttgtggttacttgtttgggtttgctgttctagttgattgctgtaactgtaagtaccttttttggtctgggggcatatgctctttccgtgctgttgtcagaagtcagtacgaagtggtgcataaaaggcttcaaaactcttatgtacttttttgttgtggttatagaaagacaatatgactattgttaacttggtaccctgatttgcaggtagaaaattgttggtacacgagttaattcaggtgcaggctttttgtgacttcttgggtttcagctactctttagtaaaaatcgcggaatctaatgtggtaccatgaatgctctaaatttgtttttcagaggaaaaaagagtgtaatttgtgttcctcaatttgctatgcagggagagagcaacttgatatagtcgtttaaggaggtgagttaaagatagtttaactcagttgctgctcccctcgatctttgattattttgttgttattgacttttcaaggtttatgggatgtgaatttgatagttatttttttataacttcatattaacatctactaataaaaccattcctccgttcccttttacttgacacagttgaccagtgtgattttatctttgactggtaaaaacttctaaattatgacgttttcgtgaacacaagtagtatagttatatttagcatgcaagatactttgataatatggcatctttttaaatatttgtaatttttttcaaaaaggacgagcggtcagatttgtatatgaatagtatccggtgtcaagtaaaggaacagatggagtatagtattatgcataacgaattccataaaacggcatttatggtcatcatgagtccatgtttacgcaaactaggaaggcactggttcctatgcatcctgctctaccctgtggcctccattgcaattatttggtcatcacagctgaagttgctgtcttcagctgccagcagaatttcatttcaaatactgctataaattgccgcaacaatcctacaagccttgtagcttgatattaatcaatggaattctgagggaaatcttttgccaatgtaaagcttaaagatattaatgaatggttgcgtttgtcttctaggagtttcatttgaagctagtgcaaaatacaggcatatggtgtcttctaggaatggttgcatttaccatagtggaaatttttaagtgcttcaagcactgatgtttcatgagcaatatacatcttatttttgatttgtactttttttctagagtcaagtttataaaaaattgaaatagttctatgagaatacaaactcctgtaagctatctcaacatgttatgcattggcttgtactgtaccaataacctagcctcctaggtctccagacctgtatctgaaccaatccacaacaaacagttttacttatgatccattgatattgtgctactcaatgcaatggtagatcttggttaccttgttcgtgcatatttcttgtggaccccagttttggagttggtattttttttagataatgttaaatgttttggactgtttttattttttccaataatgaaagtaacttccgaagtgttcaaactagttacaataaaacactgcatatttcatttccatttcagtattgattattgaaccatgattttttagtcgaaaattagttaagggccaaaggcatgtattataggaagtggcactgttcagataaaccattacaaattcctttcccactgctgccttgcaatccatcttttttttttcgaggaaccgacggcaggagtttctcctgccggaatatatagaagaagaggaattggcccagttaataagggaaaccgggcccaaaaaccgaaccttgcaatccatctttattgtggccttacaatttgttgtccatttcattgatgaatttcttctgtgccaagaccaacctagaagcaaagtggcaatcttgtaccattgtattctttttcatcgtggaactcacccatattacagtgagatggtgcagtttatttttccactacccaaaaaaaaaactgcttcacccatgcacaactaggaaaggtaccatacatatccagagtgatctaagggttagtgctaacaagactttgagaatattggaattaataacgagatgcactattgcaaatgctgaacgcccacctagttttgacaaaatacacctcacagtccacatgctatgttggcaaaggtggagagttgaagtttcttggatggtgatagtgatacactggtgtttgtagctgctacatcaaactgaatgaaactgaatttgaagtaacaattcaaataggaatgtgattccttatgactcttcagctgtataagataattcattgttgaaaccctattaagtgttattgccttttagcgacctcacctcacttcaatttgtttgattgtgaacttcaaatatttgcctaatctagaataatcttttcacttcatcctgagtagtgaattccaactattttaggtccttagcttaaagtggaactgttgttggtggggaatgcgttgacatgatgttaaagttacacagaaattcaaatggttgagatatttagtttcgcgccactagagatttggtcattttgactttagcatgttaggttgttgccaccactaagaaagtggatgtgagaatgccattattgcttcacatatatattttaaaaatctaattcaatcactaggtcttactcccagtaacaacaattacgttgagactatcactgtttgcacaagcatatggatgttggccttgcttgcaactaatacagcttacaaccaagctcatggccaactgaacacgatttctcgccagtattgaatcttatatcagcatatgcaaaatttggaaccagggcgtaccattgaacctcataacagtagaattttgtcctgagtgattgtgctcgctacgatttgactgggtatagattgagaatcacatactcaatatttaagttagaaaaaaaagggctgtacagccagagaggccaaatatgtagtcagccaataaaagacggtcatgcaccagaatggtgccccacacatgagtgtgttagctactccctctattccataatataaggcacaactacttttttgagatgtttcataatataagacatgcatgaatgcatgccattaactagcacttctttcccactaaattattatgttttttgagttttccatcctcaatatctttaattctattgggtgcatgcattatatttattagggtgattcaaactatgaggtgataataattatttcttggtctttgggttgaaggtggttgagccttatattttggaatagagggagtacatcttaggagtcggagacaattttaaaattagacttaattaatccacgcattattaaactgccaaacccttggagttaaccccaaaattcagatatcaccttgatgttctttccatgaatctgttggctgattttggtcagcagctttgttaaattttccatttcttttgtaaagcaatcaatttggcttttctggtgatgaatgtggttagaagctgtaaactaatataactatgtactgattgtgtattttgttgttctggcaggatcaaggaagtgtttggccttcgtaggtgagcctgattactgtttgcattgctgcttcatatatttttcatacttctaattggttttatgtttctaattaattcttctttttttaatggttgcataatttgagaactgcgagttttaatctgattctagagttgaagataacgaaaggagcaagggtgaactctgctgacttggtttttgtgtgcacagaccaactgcagctgaggatttagtaggtgagtggagtggtgctgtactgcgctgtccctggatttttgtctcgagtaattgttgtagttgtggaaccctttagttttatcaaattaagtgatgccttcttttggggaaataaatgtttttttcttggtggagttcagtttgaccatttggagatgcttatgaatttaaaatgatgtggccccttattgcattttttttttcagattgactgcaattggatcaattcaagtaggtgagtggaattgatcctcttgaagattttgacccaagtccaattcacaagtagaattgtgaattctttaggttctaccttgggtttgtaacactaatttggctgctcttttgtggttggccgcacaaatttgaaatactgggagtgttggcgtgatatagaggtctaggaggaggtatgaggtactacttgcgtcaggtccagcgtttggttggagatatggaaggaggagtgcttttgtttgtggaagacctcaactctaactgacaaagcgaccaattgccaacacttctgttatatttcttctttttcttgaattgggaatggagattaattcctctggtgaggaagcggtggtaaaggtgagttgttctttgatgtgcatgttgattcgtgttaaaagggagcagcattttattaggggttatttgtaggtgaggaagccatacacaatcacaaagcagagggagcgttggactgaggcagagcacaacaggttccttgaagccttgaaactgtatgggagagcctggcagcgcatagaaggtgaattctccacatatatatgtcatatcacaaatagttctatgctattactttctgaatttactttttgtactcactgtgattattagctggttaataaatacggctttaattgagttattgatatggatcttgcatcttttttttttcgttttcttgtttgccgtctgatttattctatagagcatgttgggacaaagacagctgtgcagatcagaagtcatgctcaaaagttcttcaccaaggttcttcctctatcttattggccagtgctcctttttttggtttagcgctatctccttagctttctggtttccttgtctttacctttgggataaaaacggctggcttttgtgcttactttcttattattttttcttactttctgcagtattatttctttctttccttcttttattttacatatgagtacagcaattatgtacatagagtctgaactgtgtgtgatcagttcctttcgattattatgagaaatacacttatggcttttgtgctctgttagttggatgaaacgttaactaaacagtgctgagatggaaaagaagcactaggaagtgtttgtctcgtagtaaaaaaaaaataatgttgcaaaattgatgctattaaacattctgtttgcatgttcctttatttacatatccatcctatcactgagattttgagcatgcacagatgcacttatgacaaaaaaaaaagcattttggtactgttatatttacatactaagtcaagtcaaattgtatatctggactatcatcaagattagtaataaagatttagttaaacatgttccagtgcctacgtggtgttcataactaataaggattcttaaaaaaaaaaagaactagggcagccatttgagacaatttattaaaataagaaaaatgtaaaatgatttgcaagttgaccaaggtatcaccttccattagaaatagccactcaatcgcgcatttgcgcgactttgactgacagcatataatatgtaggagtagttataacagtcacgagtggattaagtttcttttatttatacattaggcttattttttaatgaaattctaatttacgcggtagaattgtatctttatttttgaaaagggttgtctattattaatgatttttttaatcaaggtgtaatattggaattcacagttatttgttcggcaaacattgtaataattgtctgtagattcactaaagtaaaggtcggaataatttttgccatgctggctttttctttagaaaaaaaaagaagaaaactgttgtccggtttcctccaattttttttctacgtgggctgcctgcaggttctggaggtttctctttggaactctccttgtttgattagggctaatccaacggttgttgttgcttatttctttgcattggacggtcctacatttctttcttatgtggctcaaccagattgtgtgaaagtagttctttcactactttatattgtgtgaaaggtcggaaaacatcaaaaataatactgtacacctattgtttatcagtcaaaacagaaggacctagtccattcccttcttttaaaaaatttactcccaatctaagtcttgttttttttcctgttgcgcaatctacccaaactgtgccttttaggggctttacactgccacctgatggaggtcacgttgccatcactgtgcaacagccactggactgttgcattgttgattgcatcatcatcctctcaaaggtctcattgcaagatctatgaatggggaggaacacaaggttagtaatttaagaaacatgatggctttctggtttctcaactctatatccagccaacatccatgagcatctgaccgtccattgttgtggtgggttggatttttggttgttgattaaagaggtgaataggtctgccctaatctccataaaatatgtaatacagctaataggttttcgtcgctgcaagtacttgccagtaactgttctccatgtctaggctcataaaaaatatagagtgacaagtaacaacgtttaacctgaccaatacttatactgcttaaacaccttctgttttctaacaagtatgcagtaaatgtaatcagtgctacaataacttcttgaacattaaccatgcctagaacttgggaccatacgctcataacattggtttgagaagggtagtggactgggaggatatactctagtcacgtatttcctagtaatcccttggttttgccaaaaaaaaggcaaccaaggcaaattaccactgttcattgaaccctgatagtcaatagttcgaaaagtggtaactaataactgtgaaatgtccattgtggttgatgtcaattaaattagtctttactttgataagatgtccaagagctttttggagccccgaagggttatgagtgatggccattccaggcttcagatgcacagtcgcttttcttttgcaaagacatgcaacaatgtttggttctacatcagcactataccagtaattgcagtagtatagttttggcttgtcgttactggtttctgggctgaagtccaacatgactaggctccatttgtggtcttatctagtgactaggctccatttggttcttgtcataattatccacagagatctggttcattgatcactttttctactgtatcagcgaaaagtttgatgatattaccgcctatacaaatgttatagcatgctgctaatcatacccaccaatgcatactctcccctgtttggtcaatgatgattgatgccatggttgatgttcaaactaaacctcggcaggtcattctgagatcagaaggataatataggcataaaactaaatctatgacaacctgtaatgtggaaatggcctttttcttttatgcaggtgaaaaaaaataaatgcgtactaaattaataataacccaaggggagagacatcccaaaggcattgcatataaggttgagcaaaggccccaaagccagctcataaccgtatgggtactttaggggaacatatagcgaggggtctttttttttgtgagaactaggaagcctcatgactggaggacttaccagttaccaccgtgctacaagcacgttctctctactaaatttataatagcaaagtacttggcttcaatgtgactttttaggtccaggaaaaatgctttcaaatttcttatcaacttatcatcacaatagctagacgatgattttgatcaataaaagagcaggggaatgtctagttgactgaaagtagaagaggaacaattttctttctgcaaatttggcttcaaaataatctgttgaaatattcatcattacatgttttcttttggacaaaggaagtgtaacttccagcctctgcaccaactaaggatgcaaacaaccatatttgtggataccaggatttgaaccctggtggctggagtcattacatgttttctatattccaacttccatgtcaaaccatgttcctgaagtataatgctcattaattatctaatatggcagcaaggcagacataatccggtaagtaaagggtagggctgaccgccctctggtcaagcaggctctccctgcatagcaggaggctctgctcggtgaaatacaaaatccttctctgatattattgcttatttttccttaatacacatactagtccacctttatagcacaagtgctgagatatgtacttggaagtactaaataaactaggaagctctagctagaaagtaccggttcccgaaccgatggcttcatgaaactttttgccaaaggtttttagtaaccttctacatgacactccctctactccacaatatttgtccaagactaccatctgcatagaccaaggaggtgcaagatataagaaatagttaatgataatggactatatataccatctgcataacttttatacctcttttaagcattatataaagtttagtagagagttgggacatcgcaataagtccaaactcctaattttctcgacaaacagacattgtcaaaggggacagccccgagaaaatgaacaaatcttgtggagcagacggagtagcattatgtaaaatatcaatatcatgtagtatggcactttcatatatgtcaaaattactgttagatatgcctgatttgttttctgtttctttatgtaatttaactgtatctaactaattgaaatattacagttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgaggtacatacctttgtagtatttcgttttagttaggtttctatttttgatttatccttttctttaatgtgctatcctgtttctttaacaagaaactcacttacattcagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcaatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggaaaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagaggtggtcgtctaccagcattccgcatattcacatttatcttactcgctgaacatccatcactgcttttctaattcacatttctgctgtcagggtcgtctggcttttgatgcactgttcagtagagaaaggcttccccaaagcttttctcctccgcaagtagaaggatcaaaggagattagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggtaataagtggaattttggttcatttttctgggtcatattttaccaactgcatttttatccatataactttagttcagtccataggggtccatgagggatctgaaccactaatctagttcaaattatttttgaaaattttcatttgtttgccacaaactaattatctcgaatgtttctcaaccataagctttctgcttttgtcatttttgttgacttctatacggtatagtttcaacacggattgttggatttcaattgcatctcctaatgaaataatgagaacttccatccttatctgtacagacttgtgtgcatcctccttccaatttgttttagacaaagattgccagattggactacttgacatatactcttgttaattgtgacacaagtggagaccaaaaggatatgcttttggcttaccctgacttcatcatgcaagtgcatgttcccagttccaacatgtgaccttgaaaaatgatgaattgggagaacaaaatcgccttgtatctgtcaccatatatatatctgagatttgaagattctctggatggaccttgtctggaatccatgtgttcctttttctcaaacaggagcaccagctactgatctgcctctatatttggaattaatctgatctccaactactcttcatttcactttcatgtctgaatataaaaatatttgcaaaggacttgcagatcagtgcatgatcaccacttgctgaatgaagggggaaacagggtgccagagtgggaagaacgtgttcaacgtgcccacttgcaagcatggacagggttactgaactctaaaaagttcagataattcataatcattgtgcctgttgcattacaacttgcaaaaacttatggtaaaatgagcagctggtgctgtgtacaacttcttctctgctacccaacaggggaaaatgcgtgactatgaaaggtaacctagcaccttttgaagtcgccaagagcacatttgatttttctcaagaaaagaagaacagttacgaattcttg

SEQ ID NO: 525 - DNA, 12238 bp, Oryza sativa
tttcccaaacatataatcaacggcaagaaaataatcactcgtgttttgaagcagttgtggatcaggaaaaaataatagagagggtaaactggacaaagctaagacccttgcgcgccatcccatggtaggttcgcccctattttgaagcacgggactctatccaatttcactgtaaatcaaaacatcttctaccaaggcatcctaaaaacacaaataatttatacgcattcatatgaaatctaaactaccaaccatacagaaatcgtggagccttgcgttcaaaaatggctaaaaagaaaatcaccgtgttatggcatggtgaaacgaagaataaactttttttaaagtaaatttcacaaaactacaaatactttaattaaattatcacagaactacagatttaccaataaatttaatataaaactataggtttaaggctaagtatcataaaactacaaatttaataaaaaaaattatcataaaattatagattttgcggtttaaatccttagcactaatgttatgttggacttataagtgttcaagttttgtgattaaattatcattaaatatgtagtttgtgatacttttgttactaaatctatatttttatgatattccaccttaattaatctgtagttttatggtaaatttagtattaaatatatagttttatgatacatcacattaagagtaacgatagttttgcgaaatttactaaactttttttctgtgagatagaaggaagcacaacgattgggccacgtggaggcaggagaggaggggcccatgtcgaggtagcagcaaaggtggcccagaagagccaaaccgaacggtctaaactcaaaaggcgtcgtctccctccatcctccacctacgcttaattctaaatttctaattccccacagaattagggcacaaaaatcaaatcaaatcaaaccaagagcagaggcgacgcgaggagagagaaggcgagctcgtctcgtctcgtctcgcgccattaatgcgagggggagtcggtggatggatggatccagccagcctcaattgccactgcggccatggccagcttcacagtacaacctccataaatcccccaccacctccgctcctccgctgcaaccaccaccaccaccacctgctgctgcggggaggaggaggaggcggagatgtgggcggcggaggcggcgttcgcgaggtcggggtcgtggagggaggaggaggacgagcaggaggcgctgcggtgggcggcgctgcagcggctgccgacggtggcgcgcgcgaggaggggcctgctcaggtcgcccgcgccgggggaggaccgggtccagggcgacgacgcgctctgcgaggtcgacgtcgcgggcctctcccccggcgaccgcaccgccctcgtcgatcgcctcctcgccgactccggcgacgttgaggacttcttccgccgcatccgctcccgcttcgacgcgtcagtaccacactgctctctctctctctccccctgcctctctgctcgcgtggaagcttctagaagcgcaacactcgacactgacatgtggggcccaactggtacgcacgcacaccgggggaagcttctagaagcgctttgctcgccgcgttcttctgtgggcgaagtactcggtttccaaaaacgcagggaagctttgcggccgggagcggctgacacatgggccccacatgccagtcttgcgttttgttcgcttgctagttcagatcctactctaaagctatcgttctgatgaaatgcctagatcatgcggggaaggctacatttggaacgcagtgattttacaaaaaaatttgctgtaattttacgaaacaatttcagctacggcttgtaggatctgtaaatcgctcgtctcctctggttggtttggattttggtgtagaattttgtttgtatgcttgtagtgttggtaaacttgctcatgggctgatctgaagcatctgtgctgctctccatttttttttatttttgttggttgcagagtgcagatagagttccccaagatcgaagtgaggtacgaggatctgacagtggacgcatacgtgcatgtcgggagcagggcgctgccaaccatcccaaacttcatttgcaacatgacagaggttggaccaatccaccactggaatttcccctcctttgtctcagctctgcagcaatgatctactagctgttttgaacagtagcatgatttttaaccacattagtttttttttttactctgggtaaaattgctgtgtaaaaagctgtaaatagtgggttcacaaatgagctctagatgtgcttatttgctgtttttatttttctgaaaggcatttctgaggcatttgaggatctatcgagggggaagagtgaagttgccgatattggataatgttagtgggatcattcgtccatcaaggtacaccacgtgcagaacattttttgtttcctgctggatcaaattgtacgaccttgtaaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgttgttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatatataatgaaggtatatggtgtatccctttcagctgctattattatctactttggagtctcaagtgtttgcttctttgagtgaactgcacaaatattttcgagcaaatttcacgatgcataacgaaaacccccatgttttgggggcaaaatgtttcaaggaaccccagatttttataaaatattcatttgcataataatatatggtatttttagttatattcacatatataatgggcacaaaatgtacattcttcttcctcactctcgctctccatgattgcacaaactcaacacaaacacagtgctcactgttaatgacagattaaccagttacataaacacaaaatggtttatactttcgataattgacatgtgttggaagtgcggctaatatgtatatatcacatactattttttacaattattatgcatggggttccttgagacaaattgcaatacatggggtttgggttacgcatgtcctataaaacctagggttttgtgaaatttactcaatattttcatcaagctgtttaaccaaatggctcacttaattcccatccattcaagacaattttcaattttccctacaatgttattttggcttatcatttttacagcatcaacatgatctacctttgaatcatttggttctggcaagatttctgaattgctaatttttatctagccaagattttagggctggacatttgtgcggacacaattgttggtgatgaaatgatcaaaggaatctctgggggacaaaagaagcgcctgacaacaggttgttgcatgataatttaatctccttcatattattggtgctgatggttgaagaaattgggcaattgcaagttgtatggattgcatgcttattctggtttgcagctgtgctcatatatgttgctcttgcaggtgagctgttagttggttctgctcgtgtgctgttcatggatgagatatctactggacttgacagtgcaaccacatatcagattatcaagtatttaaggcattctactcatgctcttgacggcactacaatcatatccttgttgcaaccagctccagaaacttacgaactatttgacgatgtcatcctcatatctgaagggcaaattgtatatcagggaccacgtgaatatgctgttgatttttttgccggtatgggattcagatgtcctgaaagaaaaaacgtcgctgacttcttgcaagaagtatgcagttgtaatctgtgtttgtgatattatgttaactggactgttcttgcatatagttatttacattttctgtgttgcaggttttgtccaagaaagaccagcaacaatattggtgccactatgattatccttaccagtatgtctctgtatcaaaatttgctgaagcctttaaaacatttgttattggcaagaggctgcacgatgagttagcagttccatacaatagacatcgcaatcatcccgcagctctttcaacatcaaattatggtgtaaggaggcttgagcttctaaagtccaactttcaatggcagcatctgctgatgaaaaggaattcgttcatctatgtcttcaaattcattcaggtattttcaatttcgagatgcatccagcagagtagcagtttgatgtctcaaataaatactgtcacaaggaaatgtaacattgtctaccagttaaaatataaagcacacgtataataaagtcgctaaaccttgctaagaataaaaaaaactaagactgtaaatgccctgttaactcattttacaatttcactgctttaaaagtttagcacactgcaatgatcaatgtgcagttgtcacaaatgcttgcaatttttccctacttggcacacgagagttatcttagcgtgcataaaatgttatagcctagtaagttttccctacgtggtgcgtgaaaatcatcctagtgtgtttatgttattgtgacatcatgctcagaatcttggtcacaactcacaagtttggtcaacatgtacttttacatcttggtgtttttactggattgctgtaaacttgactggatggcatataatccgtcaagtcacaaaaggatctcgttgtggagtttccatagtcaaaaagatagatcttggctatatcatttttcacatgtccaaaaccttcattttaaactatgattggtcaagattaacttgtgttgacttcaaatttcctaatggcactcttctgttttcagttaaacttcacctaagttttattttcaatcatttgagggttttttttaacataatctttatgttgcagcttttacttgttgccctcatcacaatgacagtgtttttccgatcaacaatgcaccgtgactcagttgatgatgggattatttatcttggagccctctattttgcaatagtgatgattctatttaatggctttactgaagtctcactcttggtcacgaagcttccaattctttacaagcacagggatttgcacttctaccctccatgggcttacacacttccgtcttggctcttgagcattccaacctcgcttattgaatcaggaatgtgggtactagtaacatattatgtggtcggctatgatccccaatttacaaggtaattgttaagttctgttcatttgctctctggtccgatgttcagagatttttttccctatctgaagattgatcttaatttatcatctgcagatgtcttggacaatttctcttgctcttttttctacaccaaacatctttggctcttttccgggtcatggcatctttgggtcggaacatgatagtcgctaacacctttggatcgtttgctttgttggttgttatgatccttggaggattcattataaccaaaggttaagcttcttgagtcgactcagtattagcacttgagacttgagagcatctttcaagatcttacatctgacatgctgctacctgttcttgaatatctaacagagagcataccagcctggtggatttggggttattggatatctcctatgatgtatgcacaaaatgctatttccgtaaatgaattccttggccattcttggagccaggtaatacctgatttaaaccccttcttgaggttggtagcaaaggcacattgtggcagcaatctgttagcttagtttggtgtatgaaaaatacttgcataatatggaacatcgtaattgcttaaaattatattaaatttctttgtatgaacctaacgagatatttttttattcagaaaaacttttattagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatctctggttattgtgaacaaaatgatgtgcattcaccttgcttgactgtaattgagtcattgctgtactctgcatgcctccgattgccttctcatgttgatgtgaacactcgaagggtaaagtcttggctgggctgcagtgctatgtttattgtacaagacatcactatttttgtcattctgatccctgatggttcatttcataggtttttgttgaagaggtgatggaacttgttgagctaaatgcattaagtggtgctcttgttggcctaccaggagtgaatggtctgtcaactgaacaacgcaagaggttgacgatagctgtggagcttgtggcaaatccttcaatcgtgttcatggatgaacctacatcaggattggatgctaggtcagcagctattgtgatgagaaccgtacggaatattgttaatacaggacggacaattgtgtgcaccatccatcagccaagcatcgacatattcgagtcatttgatgaggttaatttctttacaaaacctagtagtcaatttatgcatgcatgacaagcaatagttcaaaagtcattattttgagctatccttttcgtgacatattaacaagttgagcacagattttgatattttttcgaagcaacagtacagattttaataatcgttcataatttgatgttaatcagttttcttatcaatgatggatgtgaacagaaactagtcccttttacacttgatctgttgaactttcattgtgctacttagggaaaccgcgaaattttcttatacaagtatgtactaacatttaaccagcaccctttcctaactcattcatatgctggtcagcttttgttcatgaagcgtggggggcaacttatatatgctggtcccttgggctcgaaatcacgcaatctggtcgagttttttgaggtacaatctgcacaatgtgtttcctcagtgatgatagcttatacaagtttctctgtccttacactttgcgttcgcgaaaaaactgtccttacactttcaagtttgtaaacaggcaattccaggagttcctaaaatcagggatggctataatcctgctgcatggatgttggaagtcacaagtactcaaatggagcaaattcttggagtggattttgctgaatactaccggcagtcaaaattatttcagtaaacacaacgacccttttcacctctataaatcttggtctctttttccttaaacatgtttatgttatggcattccaggcagacccaagaaatggttgatatcctgagcagaccaagaagagaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattactgggccaacccggtgtcatggaccctgtacggcctgctaacctcccagttcggcgacctggatcagccgctgctgctcgccgacggcatcaccaccaccaccgccgtcgacttcctccgggaccacttcggcttccgccacgacttcctcggcgtcgtcgccggcatggtcgccggcttctgcgtgctcttcgccgtcgtcttcgccctggccatcaagtacctcaacttccagagaagatgagacgacgacgagcgagaagcgagctatagggagcacgacgtacaccaccattaattctctggccagctatagcgctcaaatgtgtactgcaactactatgcatgcatcaatccatttcgtttcttcagaactgcacgcgtctcttctctctgtcgtcacgatgaattcctcccggtcacgggagatgctggagctagcagagatcagagaccagcagaaaaaaggagacaagtgtatagctaagctacctgttgcaagcctgtttggcagatctccaacaactagatctaactcggagctaaagtgaagctgtggaacagccgaaacctcgcctcattctaatttttttcagattattttagcctgtttgagctgaaactgtttggttggatagagttggagcgggagctctatcaaacaggcaagtgctccttgattggcttgatcgttatactgcgtacgtagtggctggtgcggcagcagtgcaatattcggcgagcattttgcagcagccacggtgagccaatgggaggtcgacacctgcaagccttttgactgctgcaaccggcgtccctccatgggggtactcttttggaagtagcagcagcagcagcagctagctatagcagattctgcgtcccctggcctctgctgctgctgcctccgaggactgcaaaacaacaacctagctagagcagcaactactactaacaagaaagaaagaaaaaaaaaagaaaaggaaaaggaaaggtatgaggagtactgtactgagtactaaccatttggtgatcgatcgatggtgcgtggcgatgagagatggagaagaaacgggattgattgatggattgaagatctaacaccttcaaaaggggggcagtaggagcatcttctacctgcatcgcaggtacgcaacaacacatgcatggatcgatccactcgtcccagctttttattactaccatctttccttcctttttttttccctttagagcaagataataatagagcacactttctattattagctcatcttaaagccaacatatataatagattagctataagattgactataattttcttctcatctctctatctctcacttatatatttaatgcatttgtcttagagctagtgataagctagctcttgcatgagagccaacattcttaatttttcgctacctctctcctccatctaagcttatagtaggcttatagctcactattatacttgctcttagtgagtgtttggcaaatgggaaagggaaatgatttcccacccatctttaaatactaaccattcattctccctcttccatttaatcctaaccctttattcattttccaatcccaatcccaccccctattttccattatccaaacacatccttatatcttctacttctcgagaggaatatatatgcagctactagctatagctagacattcgtgtccggacgtataggaaggtattcccagcatcattcatccgtgccgtgtgcagcatactgttttcttaagcccaaaccaccaatagcgtttcacgatgatcgatcaatttttttatatattgatgacagtttgtaataaagaaagaagcaacgaatcgatcaaattttacatatgttaatggcagttcgtaaatggtaatggtcgagctgtctccaccagtgtgtatacatatacatacgtacagtggtggaggcagcttg

SEQ ID NO: 526 - DNA, 4537 bp, Oryza sativa
tacatgatattgcacaaaacttacttaaatatttatactattttaaaataagatagtgatggtggtagtaaatctgtcatcccacccactttattttaaattacaattacccattaaacttctttgtactaaaactcaaatcactttagatagccatgtataaggtcaaattaagttgaataccggtaaacattggtgatacattccataatcaaaacacgagcaaactatatttttttacacaagagcaagagctctgccttttattcaaggagagcaaactataattcctccagaaataccttttttttattgtaatttttggtacctcaacacgtgagaaaccaagagatactaattaaagtttgcactacaatggtggtaactctgagtacgactgtacgagtacctcctactaatgattattaagcatatgaaattatcccggttgtttgttctttgatatgccttccacttccacgtcagctttcccacactggtctaagttcttggcacaatattctcttctggtttccatgttttttccctaatgattagcctctaaaagacctatatatttagctgttgatagaaaatgttggactaaagaatttatagaagttggcatgcacgagccaaccgtcctacacctcgagcaagtttcctataattgaggcagattaagaacaatagcacttgtacacgctgaatctgaaattctgaatgcattttctatttcttctcaccctcttgcattgacccttcgcgcattctttaatcccaaataacccaaaactagccatcaatcatacatagaaaaatgcatcacaagaaccaaagtaaacaccggccagaatgatgccattcccttgtaaaccaattcaaagtttcaaaccccaaaagccattccctgaaattggagcaagctttcacacagggaatttgatcaattaaaaaaaccatttgagcacctaacttgtgcaactataaaaggggtaggcctcacagccccctatgcaacaacaacttcaagccatctcctcttcattctctcctagctttctcccaacttccagccattgctctcatagctgatccaccaaggagctagaagtaattccagggttcttaattgcggcaatggcgatcccggtcatcgacttctccaagctcgacggcgatgagagcgaggccaccctggcggagctcgctgcggggtttgaggagtgggggttcttccaggtaatcaaacacatgaaaaccatgctgaacaatgcataaattttcttccaccatcagagcactgataggaagagatatatgatgtggatcaattatgatgcagctggtgaacactggcatccctgatgatctgctggaaagggtgaagaaggtgtgcagtgacatctacaagctgcgcgaggatgggttcaaagaatccaaccccgcagtgaaggctctcgcccgcctggtagaccaggaaggcgagggcctcgcaatgaagaaaatcgaggacatggactgggaggacgtcttcaccctccaggacgacctgccctggccctccaaccctccatccttcaagtaagtacgacgagctaccctttttccgcgatctttttacgaggtaccgagaaatatataccatatatcatttcggtaattagatcataatggaaagaaaaaattcaccaataatttctcgaaaggtagaaaaatatagtacctcttcaaggatggaaggaaaaactcgtataaatctccgcgaccatcatcggattaatcgatgacaattgcagggagacgatgatggagtacaggagggagctgaagaagctggcagagaagctgctgggagtgatggaggagcttcttggtctggaggaagggcacatcaggaaggccttcaccaacgacggcgacttcgagcccttctacggcaccaaggtgagccactacccgccgtgcccgcggccggagctcgtcgacggcctccgcgcccacaccgacgccggcggcctcatcctcctcttccaggacgaccgcttcggcggcctccagatgatccccaaccgcggcggcgacggccggtggatcgacgtccagcccgtcgagaacgccatcgtcgtcaacaccggggaccagatcgaggtgagagtcaaccataagcttttggtaatgtacaatggtggacttgtccagcaaaaaaagttaattaaatcacacttaatcaagtagaccacaaacctatgtatatataaactatgatgcttagcagattaagtgcgtgtttagtgctctaatcaggagatgctatgtatacaaaatcatctctagattcggtgaccagcagagttgatacgaattgaatttcacaaaaactacatgttttatggttcaaattgctaaaaaccacatacattttaatacttggcacttaagtaaatatattttggtagtttagtttcacaaaacaacactatcgatgaatggattcactcgtgatatgacgtggttgttccatctaggatgaggacgtggcatcatattaatttcgtgcgatggctggtaataggatgtcatgtcctcgtcctaggtgaaacaaccacatcatcttgcgggtgaatctatacatcgataatgtagttttgtgaaactacacaaccaaaatatatgtactcaagtgccaagtgtcaaagtgtgtgtggttttctgcaactttgactacaaaacgtgtagttttgtgaaatttactctttaaaaaaaactgagattgttttgtgctgttttagtcttgcaagttaccttgaataatttaactaaattatactatcaatctttgctcctatgatgattttaacaggtgcttagcaatggccgcttcaagagcgcatggcacagaatcctggccacccgggacggcaatcgccggagcatcgcctccttctacaacccggcgcgcatggccaacattgctccggcgatccccgccgccgccgccgactacccgagcttcaagttcggcgactacatggaggtgtacgtgaagcagaagttccaggccaaggagcccaggttcgcagccctggcgaacaagtgattcaaattgatgggatgaaattgagctttgcagcaatctgaagtctgaacctgctgcaaagctctctcagccttaagctacatatacagttcgaataagcgtgtgattacaatacggatttgtaagatggataggttgtctaagtatgtgctttgcaatacatatgtgttaattactagtgtctttgcagctatcacaaccatgtaatcattccaatttgtatggtggcatgtaaggttgtcttgtgctgtggtcaacagatgccagagtagtttgtagctagaattaatggcatccgtggggttttttaaattttattcgtttctgtttgaatgtcagtgtgtttgctcaggtggtgtgtacttgtaaattattgagatatttgaggaggtcctgtgtatgaaatatatttttggactatatacaatttcaagttccactttggattacacagctacagtctgtttaaatttcaaacaagtatgatgcaagtataacatttcatttatatagataatgagtacagcttaaatgaagtaacatgagttagtgcctataacatcatcactgctatctgttctgacaggcaaaatttgtccccttcttttttgcctaaaatctattggcaggtagtccaaaagttctggaaaaaacctaagaattgacacctcccctcatcgtaagttagtaacaacaaataatcacctgactattcgaagatcttctccccagttgagaaaatcaagaaaatgaaggagctgaaaatacaaaggtatcctggaacaaagaagactgtcctccaactttccgagcttgtcaggtccatgttagatgccttcgctgcctccagaattcttcctgtgagaccaacaccaactattcctgccaaagtcccagctgtgtttgagatccccatcacaatcccagcaaattttggagccacatccatgtggtttacagcaaatcctgcccttcctagagccagaaaaccaagagatactgatgagcagaatattgcccctgaaggtgttctgaataatggaagggccatgagtgcaatggctgagacgacaaacccgactgtgttcagaagtttccttgtcttggtaacagataatatctttcttgtaatcaggtgatcagcgaggaccccaccaatgttcgagaataaaaacatattcaaataaggaagcatctttgaaaaccccatgtcctggaggcttagttgaagtcctaatttgaagtatgtcggcagccagttcatcagaacatacagtgcatagtggaaggtgaagttgttcacaacaattgcccaaatcggcaagctaaaaagtatccttgcccatggaatcttcacagtgcgaggagccataatcccaccggtttgtaccttcatcttatctttggaggccacctttggaagatcagtgcgaggcg

SEQ ID NO: 527 - DNA, 4615 bp, Oryza sativa
gagatcaacggttcagattattttctactacaagtagaaggcaccggagtggatctcaatcagttaagacttttaagttgccaaatcagttaagacttctgagttaggcagggcgcgcctcggtagttctgttctgtacacgccgagtcgctggaatttttttcatttttaaatttttactttttaatatttacagaaatattgtaccatccaaaatatttacagaaatggcccctgccgctcaagtggagggcgtcaaggtgtgcgcatgttgcactgagatcccttgccgccctctacaagggttgcaagggggcaaatgtaatttcgctatgctaaaaatgtatttttctagtttttttttcatcttatgcgtccctcacgtcaccctgccgccctccccgagggctgcagggtctacttctgtaaatattttcaccggtacaatatttctgtaaatattaaaaaaataaaaatttaaaaatgaaaaaaattcgagtcgctgaccgtctcgtactttcgctcggcctgtttgacatccactggcattctacacgggctcattttccggcccagctaggacggtgcgtttggacgggcccggcttagagttttgggctggcccgtttggcccgcacgagttgtggtccgttttggcacgagggttttgagtttattttctttttcatggtatatatatcttgctggctgaaaaatatgtgctggggtcagccatcggaagaaaagatcaacttggtcgagtaggctgctgcgattgtagtacacgcaagcagcatctctggaaacgaagaaactgtcgtcttacggcggttacagctgaaaaccaactgtttttgaaagaaattcatgagaattcaaacatgaacatgtaacgtttcgtatggttcatagatagagtcaacgcccggactccccaaggttgaacgtattctcactctattacatcgacctaccaactcttttttttattataaaaaaaacaaaaacaaaagcttcgaaacgcaaaagtcgcctctttccttctccgttcaaagcaagcccacctcgttcctcctcctttacaccttcctcttttccatcatctgcacgcgttcgtccaaactccgaaacaagaaagctcaaactcgatttcgaaattttcgaagccccaattctctcctcccacacgcggaatcgatcagcgcagcgcagggtaggctaggcgtcggcgtgctgtgatggcgccggtggtgtcggcgctggccaagtacaagctggtgttcctcggcgaccaggcggtggggaagacggccatcatcacccgcttcatgtacgacaagttcgacgccacctaccaggttcgttgatgtcgcgcgcgtccccgatcgatcgatcttacgcgctggagagagttccagttttttttcttttttgggcaaggtttgttcgatgaatttgacggtgttcatgttgttgcggcggcggcggcggcgtgcaggcgacgatcgggatcgatttcctctccaagacgatgtacctcgaagaccgaaccgtacggctgcagctttggtatctgagattctgaaaactctctctctttgtttttcccctatcatcatactctgcttatcaagcttgtcctgcttacgagaattcagttggtgcagcttagctgctgttacttgtccgatcaccgattttactctgcacaacctgctttattaccatataatcctagtgcctactagtttcgaagtcttgatttttagtctcagttccaccctcaattacgttgatttcgttttgctgatggaggcaatattaatgctcaattgttgccctttttttatcctttcctggtgaactgaaatcacgcgcacaagacaattcagctagtgaaaactgggaggttttcagctagtaaaaaccgggagagttttatggtgatgataatgtgcagggatacagctgggcaggagaggttccggagcttgatcccaagttacatcagggattcttctgtggcagtgattgtttacgatgtgactggcaagttaacttcatctacacccttttctctctgctgttgtaactagaaagaatttgtgatcctttgccctccagtgctcttgtaaactacagtgcttttgctctaacaaggttggcacctattctgaacatgtcactgaatcagggattggcgaattgccgatacccttggaatacaaatttatcagaaaatataatataatccactgtatatttgttttgtggtctcatatcgtccttgttttcagacaggcagtcctttttgagtatatcgaagtggattgaagaggtaaatacacaacgaggcggagatgtgatcatcgtccttgttggaaataaaacagaccttgttgacaagaggttagtatctgtcggtatttagttcttaaatcagcagttcattaagtttacataaaagtaccagctgctcccaaaattaaatagatcctctgttctgttctgatggatagtattcactgatcaaatgaaataacgatataactctgtcttcaatttgacaattttaattcaatcttctggtcttggtaatgtccacacgtcaacaaagtacgaaatatcattttggctaatactccctccatttttaaaatacaaaacactgttgagtttttgacatacgttcaccattagtttattcaaaagaaattatataattatcatttattttataacttgatttatggtcaaatgtttttttaagcataactcgaatttttttatattttcacacaaaaaaatttgaataatgacttgatttatcgttaaatgttctttaagtatgacttaattttttattaaaaatgaataatgacttgatttatggttaaatgttatttaagcatgacttgatttttttattttttaaaaaaaattgaataagacgaaagataattatttttttaaaaaaaaaagtcaacggtgtgatatattaaaaaattgaggtatatcagttaacctactcctttctgtcgattggaatgtcaacaggcaaatatccactgacgaaggagaagccaaggcacaggagcacggcgccatgttcatggaaaccagcgcaaaagctggattcaacatcaaggtctccagcctttactttgtttcactttgacaagcaaatctaccactgttcttgtccatcattgctcaaaacacctgatggtaactgattgaaaacttgaaccacagccactgtttcgcaagatcgctgcatcgctgcctggaatggaggcgctctcatcggcaaagcaggaagacatggtggacataaacctacggcctgctgcctccgggcaaataccttcaggggcagaagcacaagaagaacagaaagcaggcggttgttcctgctgagagttttgtattcagggaaatcgaggtcgcttcagagttcagacttcaaattagtacacacagtgaatttcaggtagcttggattgtcagtgccgattcgagtatagagaatatttatgtgtaatttttaacagcggcatctaggtttgaaacagacaaaaattccctgaagtttctatgttttataccgcataatctatggccaaagcaccccaaaaagggtaaaataaaataaaaatcgccgttgccggggatcgaacccgggtcacccgcgtgacaggcgggaatactcaccactatactacaacgacattatgtgccggacaaagaactgtaattgtccttaattttggaaaaaaataaacatgcttatatagaaaacctatctgtaattctgtactgaagttttttaaaaagtaaatttcagagaacctataagttgtgccaaaagtttaaaataccatatatattaggatatattatgatttgtggcaaccataaacggatagctacatataaaatcaaactaaagtgagtattctctataacaaaaaagtgggcaacaaatttaacataactctaaatggttagttgcgtataaaatcaaactaaagtgagtattctctataacaaaaagaggtcaacaaatttaacattacataccaactaactataaatggatagttacatataaaatcaaactaaggtgagtattctctataacaaaaagacggaaacaaatttcatgaaaattatgattttatttattttaggcaatactatgatatttttttttccttctagtcgtatcaaagcacaagaacttagctttaggattatgaaataatatttcatttaaatctcaattagttttaggatatatgaaacaatactttttaaagtagtgaagagtcgttaaaaaccaactgccttaatcaagaaatgaataattaaaattttcataaacactttatattttcaaattttaagtaaacagctactgtactttacatgtattggggtgggccataatatatagggtcatacaccactagtcataatatttagggtgctatgtaactattgactataaaacatgggttctctaaaatatattcattcattaattaattattttgtgatgtgcttgacttgaaaatatctcactacattttatttattaactatttgtgct

SEQ ID NO: 528 - DNA, 2961 bp, Oryza sativa; identical to SEQ ID NO: 447

SEQ ID NO: 529 - DNA, 7954 bp, Oryza sativa
tgtaacgaatatttgaatatctaaaacatcttaaatgaaaaagttgttaactacaaagttgtagatctccttgagctctactattttgatataaatttttatttcatctgactttatataatataattttaaattgtaaaataatagagctaacaagttgtgctggaaaatttgcatttaggtcccaaagggcggcaggcgattagatttgtaaatttttgaaacaaaaaattatttttgtaaatattttaataaaaaaatgtataaataaaaaaattctttttattatagggaaaaagttaggttaaggatgggattaggactattgattatggtgtcatgtctagctgatggatgactaatttagtttaattaagtccaaatgtccttgacgttttagtttaagataaaaaaaaaatcgatagtatcctgcaaagccagcgaatcaggggagcacattggttcataaaccgtggctatctcgcgtcagcgtgcatgcttaatcagattatgggtgtaggaaaatgctgacttggtgttcttcttatccgataaacgacgaggcaaatccaacaaagataatcgatgtttcagtttcagcaaaaataaaaatgaagaaaagaacaacaaagagccgagtaaaagttgaatttatgggcagatggctgacagtgatagaacaaatcgaagtcaaccttgatttgccgattaaatcgtacacatattcgaatgtcaaactcgtcatcggtggacaaattggccattctctgtcacagcttttctttttaaacatattttttgttcgtaacattagtaaacgctcctttcgaaacggatatccattggattttggcgagaaacggccacaacatagcatacaagaaactaagaaatttcatattaaattcattgaattacataggagtcaaaagaattatgaagagttgcgcctttgctgtttgataaaacgggagacaaacccaaagcacagcgttgcagcgtttgcagtcgttgtgcgcatttcgtcgaacaggtcggcgatggaccacggcggtcaggtctctcccgtgccggcgacggcgacggcgccgcggaaggtcaggagagaacacatgaggctgggggtgtaccacgacgtgctgcagcggctcagggacgccggcgcgcccgaggccctcgcgccggacttcgccgagaagctctggacgcacttccaccgcttcaacgccaggttcttaatacaaccaccctgcgcatcattgctgccaaaaactcgtgtctgcatgtttgatttcgtctctaagattgatctttgatcgaatgcatacggggcactgttcaaactaaaatttaccctctgtgatgattttcaagtgtcaggcctgtgaatccgaatcagggcctgaaatggaagatgaatttggctaacatttctgagtctaagcacactaggagttggctagagtctaaatttcgatgctctactttttgatatgggggcgctcccagtgcctaatttgttcttttcgaattgctggttccaaatatgatcaactctattcttgttcttcgatttgatatggcagttatgccatggatgtcaatgttgagagggcagaagacgttctgatgcacatgaagctgcttgagaaggctatccatcctgaaaatcagcctgccttctcagtgagaattgttcaggtacatttacgccaaaaaggagaacagcttcgattggtttgctcatgttttgcagcagtatatctgtggtatgtttctgaagcaaacattgctgtgcaggttcctctagatattgatgcgagtgaagccgattcacagtcaaacatcactgaagatgacaactgtcctacgccaagaacaccagcgtatgtcctttaagattgctatgtatcatgacatgttgttatatttttctatttgtgcttagtgctagtatttatattctgttttttctccccttatatttctgtttgtttgatttctcagtgaacaccctgcacctatttttggctctaccacagcccttaaggctcttgttcgtcaagcaagcagcaagaacctcctggatgacaaccaagacatagatgctattctcaggtttgcatatttatagttactaggtcctgaaattttctcatttacctatgcacttttttctctttgcactttcggatttttctgttttagacattcatttttaattcaaatatcactaattagctcattttgctgttacttgatgttgtgtttattcctttttttcagtcagagtgtggttatttctttaaaacactaatcagtgagactatgatatttagaaccatttcttctgtttcattgctgtagttctatttaacatgcacatatgttgaagactgtttatgtcagtacatggtattcttctttcatttatcgtctttgtactctgagatttgggaataagtgagtgcaattccacaatctatgcttctctcttttcaaaaaaaaaaaaacattctatgcatctgaataaaaagctggggaggagcataacatgatgcttattcgtttctctcttttcccttggctgcaaatttcttatcttgcagacccatgcatgagatcacctttgcatctgatgacaaaccaaagggccttactcaagtaagttttcttactccaaacttctggaatagcaaaaccgaggattcattactatggaagaatttgttacacatgttttgagagccttcctgatactatcggttgcatattatttcagctgtcttcacttctaggcaatctcaatcttgatatcaaagaagtacatgcactttcaacaaatgatggttacttcttagatattttcatcgtaatcggatgggatcacaaggtattgtttggtccatttctctactcaggaaacatttgattaaaaattcttaaccatattctccctctatcccaaaatataagcactcaggtgcttttcacgaggatcaaggagagacatgaaattaaatgggggatatttgtcactggttgagatgtggaagtaagtagagaaacaaaataagagatggttgtgattggttgagatgagggaataggtggagaagtagctatattttaggacaaaatttgaatgctcaaagtagctctattttgggatggagggagtagttgtctgtcttgcttcctacatgtaaggacatctaagtattcatgatctcaacattcattcatacttttaccattgttttgcatgaattgctatgaatccaactgagtttatatatattctatgacctttgatctactaattttctagtaaaattttatagcacaatgtccataatataggattgtctaagaccatatcccaaaccagttttgaaccagtacatcttatctatgctttgtaatcccaaagcatttgcctaaatgccatttagagtttatttgcctgttcatgaagagctcaagaaaactctgagaaaaaaatgttatttgactactgttaatggttatcagtgaacttataggcacgtagttgcatattattggattgcacaggaatattagaaacagcaaaaaatgatttttgcatattttgggctgacaaaccggaaagctttattgttccctttttagctaccttaaacaattattttgtgaaaatcagccgaaaaattggtgggagttctgttactgtaattttaaattcgcaaggatctgttccctttgctgaataagaatatgcttgttagaaaggaggataattattcttttgattttacaggaaacccaacttctcgaagaagcgttggagaaggaaattcacaattacgaaccacaggtagagtttcattgatattcctctttattttctcactataattaaaatgcattagagctttgtttgctctgttgccagaaatgtttaaaaaaatatgcagaaactagataaaatatagtgctgaagtcaaccgaaaacaaaataaaagaagtttaagattttcctgcccaccatacgatagtactgcacaatcttaaaggtcagtagtttacatcacaagctcttgaaggcgcataagaaaagggggattcagaagtattggaatagtatgctttgttctagatcaagaagatatggttacatcatagaatatgatgttctcttgacaaataacaattcagttcgtttattaagctattgtatttctctctctgccaatactgattacagcatttctatatttcctaatacttactgttttcattgttgaaaattttctgcagatgccctcaaaatcttcttgctggcctcctgaattagcaggcaagcagtctttgattaactcgcaagtcaaccatgttcagatacctaaagataacacagatgaatgggaaattaacttcgacgtattggatattcaagagaaagtggcatctggaacgtatggtgatctgtgagtatcctgttgttgcgttgcatggaaccttcagtctgttagacattgcctcaagagtcattcttcctcccttgaggttgcagctatcgcggtacatattttggtgaagatgtcgcaattaaggtgctcaagtcagatcgtcttaatgagaacatgcaggaggaatttaacgaagaagtattcatcatgaggttagtaataaaataaagatatgggattctcaaaaccaaaaaaaataaaaaggaaaagtaaataaacctgtaatgtcgaatgcctagcaagctcatctagtaactaagccatcgctgtataaggtgtagcgagatgactttcccaatggcttcgagtcattcattgaaatgtacaagtcgtttatgaacacatcatgtgaatcatattatgcaaagttttgtctgaaccatagaaaaacttgcacaaacttaatcatagcatacagcacaatctaagaatttgacaacattacagctatacaaccttaagtaattcagcagtctatttggtaagctgattgaagttacatagacaattctttatcagagccttttccctggaaagtaacacatctctttgaccatgttgccgatggaactgccaaattctaggaagattcgtcataagaacattgttcgatttcttggggcatgcaccaaatccccaaccttatgtattgtcacaggtaaaatgaatacagatgccaattccttttaattatgcagattttgcccatttatatgtgatggtgttatccccttacattttggaatttacatatttcaccagagtttatgaaaaatggaagtgtttacgactaccttcataagcgtaaaggttccttcaaacttcccagtctgcttaaagctgcagttgatatatcaaaagggatgaactatttacaccaaaataaaattattcatcgagacttgaagacagcaaaccttcttatggatgagcacgaggcaagacttttgatcgctctgtagcttaatcctgagtagtcattaacgtaattactttataatgtggcttgatgatcagggataaacatagtttttcatggcctgtagtttgttggtattgctttctttgcagaactgttgttgtcacaattattttcatgattaaactgatatggatgaatctttttcagcttatcaaggttgctgattttggtgttgcacgtgtaaaagctgaatcagggattatgactgccgaaactggtacatatcgttggatggctcctgaggtaatctttttaaattatatattcaagtgaaatcccagttttgcatagaggacatagcaaatgtttcccttttcttctctaatgatgatagtttatccaatttaatggtaaattttccaaaccatcgcacaactttctcaaaagaaattggagagctaagcaacagattgggatacatgtttttcacatctcagatctatgcaacgctttttatgtaggttattgagcataagccatatgattcaaaggctgatgtctttagctttggtgttgttttgtgggagctacttacgggaaaggtattattgattcattggctagtgattttctcttggaaatataagtttttgctgccaacatacttatgttttttttaacatactttactagattcctcacgagtttctaacaccactccaagcagccataggtgttgttcaagaggtcaagagctaagctgaattttttttttcttgttactatttgacataacaaatgcagctccaatatcataatgtggacatcttttctttatgctttcctacttcataaaactacttatgttatagttcacattttttaaaagaggttatcttatggttcacatttcacaatctttcaatcaagtaaacaaacggttgacatggcagggtttaagaccagttattcccaaggccacagatcctaaactcgcgctgttacttgagagttgctggcagcaaaatgctgtcaacagaccagactttgtacaaattttgcaaaagcttgatgaaattgctggggaggtaggcatctgtgacctatttaccatttcatgaaatcccaaattttcatattcttgcttgatggcctgatgggtgtatgtaacgtactgacagcatggcattgatcttacccatccccataaagagaaggagaaaggaggcttctttacttttgggaaggtccattgatgaaattcttgtatcatatctaaagttgcacattgtttttctgcagctactttctcgatagatttctctgaaagatactgtgtattcaggggtttattattgtacagtgtggtagctgactggcagatcacttagccgccatttgtcttttccaccaaatgtaaagcaagtacccgtgtaattttcaattgctgtatagtgtatactacggaaagcagaaaatattagtgaaattgcagtatactacttattttgaaccttattgaaagcttcttttcctattagcactctgcaacagtttttttttttttttggaaaggaatctgcaacagtattttcatcatacatctgcagtcactgcaaggtgccattgtcatgttgccaagaaagtttattaacatgaaaggtaacatggaaggggtgacaggacagcaaattaaacataataaaaccctagtctctaaactagcaccattcatcccttcaaaatccatttattcagtattcttctgatgcctcacatttgagaagaccacatagtgtacaggcgtacagccgtggagcgtgaagtcatctgcagattattaggtttcagaaacgcagaaaatctttcaggccaacgtcacttgttggttgggagttcattctccttccaggcagaaaatccaccggcgatgtcggtgacagcagtaaaaccctgaaaaattgcatgagataaatcatttcgaacgacagaagcccaagaactgataagcggaatacagagttgatgagatgggcattcttacagcagagcagagttcagatgctgccatgagggatctcttgccactttggcatccctagaattaacaggtgaaagtttaagtacattaagaaaagtggttgtaaataacatacgaaatgtttcaaaaccaaggatacatacaacgatgatctcatcctccttcccaaaggtagtcgacactttctcaagaaaatgtgtgttttttgtcagtcctaggaatgagagaataaataatgtttagatgtgaatcagcacttaatgtcttaatcacagtattatatatgaatgcaatctgtcaatattcagcagggctgacattcagtcaaacagacaacttgatgcacagtaatgtatcactagtgtaaagcagcatcctgatgagtcagtttctcaattggatttgatctagctggtaacctcagataataatttttaaaaaccatgtgcgtatggtctatctgtagcagggaccagc

SEQ ID NO: 530 - DNA, 19285 bp, Oryza sativa
tcatcgtttctcgccgttcacacgtttagtcacaagcccggacgtgatttaaaatttctcttcactggttagttctttttttactacacttttttagtgattttttatatgttggattagagggagaaaggaaggaaaataactatgctttttaacatatactcacttcggtttcataattcttatcattttggataatgacatggttttcaaaatatatctttgactgtatttttctattgtaatatatctttgactgtatttttctattgtaatacagttatactttaactgtagtactcccttcatctactttttgatagtcatatttcatattggcacacagaccaaggataagtaattcatcatctatttaaacatgctactagtcattcctcgtaaacaagcgattcattaatatttacattttttaatacccatgtagccaatcatgtgtggaagaatggagagtcacacattaaatccgagaaagtcattaagatgataggttgttggattgaaatatgcctatcaaaaataaatttttcagatttggaaatatgactatcaaaaatagatggaggaaatactttgtaagacaagtctatatattgttctagtgactttaaactaaatattttaaaagttattaatagttaaagttataaaagtttgaccttaatctacagtagaaggccacacgcccacacaggccacatccctcctgtggctgctgttcatccgaccacacgggatcccacctcctccaccgatcccgttccgttgactccgttcccgtcccgccccgcccccactcatctccactaatccccttcgctaatcacctctgactccctctaatccaccattttaattaaaccccaataattaacaaacccctcactctcttaatccgcattaattaattgattaaaaaaatctaatcactctcgctatcccgttctaatcctaaccccacccgtgtctcctacctcatcgacggtataaagcgaggcgacgaactgactcgactcaactcaaccccccccaaaaaaaagaagaaaaaaaagaaaaagaaaaaaaagtcgtcgaaaagcgagagaaggggatcgattcgaagagagaggaggtaaagcggcggcgggagaatcttcgccggatcggcggcggtggcggaggaggaggaggaggaggaggaagagggtggtgctgatttggtgtggaggcggggaaatgcgtgatgtgtgagatctagggcgtggggaggcggatcgcggcaatggcggcgcatcggtgggcggtgtgggcggtgctgctgctgcggctgctcgtgccggcggcgcgggtgctcgccaacatggaaggtgggtggggggggaggtttgcgtttgagttgagcttttgcttgggttttggtcgatctggggtgtgttcttgctgggttggagtggattggtgtcgggagcttggggggtggctgcttgcttggcttggtttgagcagttagtacaagttgccgcggctgctggtttttgctgtgtgtgtaagttgctacgagacgtcgcttgattttggtttgatgcgtggccgctttgtacggatcctaccttttttactctccctcgcggaagaatcggagcattttctcgaatttttctccggtcgaatttggacttctctgcgttccaaattcactccgaattcccctagcctgtgaattgcttcaaaaatctgcgcaaagtcgggagctaaatttgcgctttcaaaatgtgaaacccttgtcggaaaaaagttgccatcgcgtttgatttaatttaatttaattttccatgcatttggatcatgtgttctattgaatgaagatttgaactgtgctgcgccgatgctgcacgtttcggagatttcccctttctatcgggtttctgcgtgcgcttgagagagctactgttgcattaaatcgcgttgctacacgttgcttgctagttgttcatggactaatctgctagagctgtgttaatcgattctttcccgtggttgttaggtcttgattaggacgtctaatgacgtggttttgctatttcgggccattgttagattcgagctgtcggtgcctaagttcgtgacataattgggttaccttttcgcgcgcgcgtgcgggttggtggctaggtgatttttcaagccggactttgtgtctaatcatggtacgaaatgggatggatcgtttcgattgcggattttctcgagcatggcttgtttagtcttgagatcccagttgcttaggcctgcctgggattgattaggacgttgatgcgcgtttgacgacgctagactgctaattttgggggtgggattggttgtatgtgtgtagttctagttggggattcggcaaattgtagtgggggcctgtgagctgtgggtcaaattgtattttccaggacaattggtagttgatgtgtgatcttgaagcttcaagcacctgaagcctgatggtgattgcttgtatttgaaaactttggtagtagtaggatataaagaggccaagttggtgttgtaattttcattttagttcgaccctttgatgctgatctcttacttaggtacttactttggagtgattcataagaaaatttaaaagcttattcacgacttacattctcataattgagatgttctcataattgatgatattttgagtttggctcactggttttaagtctagcgtctaagagttatctttcatgtacttatttgcccctttgtcatatactagagtaacaatttaactttttttaaaaacaaatcatactagctatggctgatgaaatggaatttttttgacatacaagtcagatagaattgtgccagatgcaatacaaacaccacatgaatcatgcatgctagttgaccttttggtttcgctccttttctgcatgatgatttggagtgttttcctttggacaaattctattttcaatctacacaacaattattagctactatttatgcacaatcctcattgattgtttggttaaattttattcacctgttgttgatacatgattctattattggcaggtgatgcattgcatagcttgaggactaatttagttgatcctaataatgttctacaaagttgggacccaactctggtcaatccgtgcacttggtttcatgttacttgcaataacgacaacagtgttatcagagtgtacgtgctaccttttgtctactatgcaatccacgcctcatacatttttattgaaattatctccatttttcagtgatcttgggaatgctgcactatcaggcactttggtcccacaacttgggcaactaaaaaacttgcaatacctgtaagttctcttcctgttgttaagtgttgtgcacatcattaaatgccattcctgctgcacatggtgcaatgttttgtcattgttctgatctttgaatttaggttaataccttgtaatgtgatatacgaattcatataataaatgttccattttgtaaataaatgcctattacctttcttatgtgagtatgtgatgaatgtctcacctatatcatcagaatatctacagtcacgtggagaaatattcctagctagtgtgttgtgctcagatcaactcaagccaatcactgagtattgtagagtattaatgttcattgttttcttctttatgatgcagggagctctacagtaataacataagcggaacgatacctagtgaacttggaaacctcacaaacttggtcagtttggatttgtacttgaacaacttcactggtccaataccagattcacttggaaacctattgaagctacgattcctgtatgcttctactttactagctaaccgcttctacatatttacgtttagtagagatatacatggtcagccatctcatatttttaggacttggaaactatacttaaatacatatgttttagctggtgagtatttttgagctctcaacctaaggatcttgaattttcagaacacatattctcttagcatagtgcattggaatattggatagagatgaaatgaatctgtggtagtatcggttcatggcaatataaagcctatcgttgagaatcatgctgatgtagccaaccatatagctaaattggttttgtcgaccatttaacctgatatcaatggacagttggacacgcaatgcttacatattttggataacagcacttaacatggtaatgccattgttttaccaacatgcacttataagtgggaaaacattgccatgtgtactacaacaaaatgatttggttcgatttgttttcctggtctgaccttttcattcaacttggttgtgcattagtacattgcaattatatttccagactgctgtttatgagatgatggatagcttttgctactttctcactccttttctgatgttttagggcatctcctatgcctcttgattttcgaagtagttttctagagtctctgcattatatttattctctgtcattttctgtcaatgttactaatttggtgacttattttgtatttctgcgaggataggcgtcttaacaataacagcctttcgggttcaattcctaaatcactaactgctatcactgccctacaagttctgtaagttatcccccccccctttattatacacttgtttaatcctttcttttcagtgtagtctttgttttttgttctgtggtttaattagtaaataacccatggtcaatgttttctatttaattaaagagatctttcaaacaacaatttgtctggagaagttccatcaactggttccttttcattattcacccctatcaggtaaaactagatttaataatgattgcagttcactgctcttttccaatacactgctgctatttacacttgcctgtcttttgcagttttgccaacaacccttccttgtgtggtcctgggaccacaaaaccttgccctggtgctccccccttttccccacctcctccatataatcctccaactcctgtgcagtcaccaggtgagatctgttcatattcacagctgtgcaacagccaacactatgatttttttttgttgcactgacgcgtggtacttatgctggtatggactatggaacatattgttgttgttctgacaataataacctcatgttctatagggagttcatctagtactggagcaattgctggtggagtggctgctggagcagccttgctatttgctattcctgctattggttttgcatggtatcggcgcaggaaaccccaagagcatttctttgatgtgcctggtaagcgtccaatagaacaagcgaacttggagaataatattgagccaactttgattgagattcattatttgttacagctgaggaggatccagaggtccatcttggccagcttaaaagattttcactacgagaactacaagttgcaacagataccttcagcaataaaaacattctcggaagaggtgggtttggcaaggtctataaaggaagattagcagatggttctttagtagctgttaagagactaaaggaggagagaacacctggtggggaactacagtttcaaacagaagttgagatgattagcatggctgtacatagaaatctgctgcgtttacgagggttctgtatgacacccacagaaaggttgcttgtgtatccatacatggctaatggaagcgttgcgtcacgtcttagaggtacgttgccttttttttttccaatctgacatccctgtatctttcagataattggagggttgatttgggttttatattatagaacggccaccatcggaacctccacttgattggcgaacaagaagaaggattgcgttgggttccgccagggggctgtcctatttacatgatcattgtgacccaaagattatccatcgtgatgtcaaagctgcaaatattttattagatgaagactttgaagctgtagtaggggactttggtttggccaaactaatggattacaaggatacccatgtaacaactgcagttcgtggaacaattgggcatattgcaccagaatatctttcaacaggaaaatcatctgagaaaactgatgtatttggttatgggattatgcttttggagcttataacaggacaacgtgcctttgaccttgctcgtctagccaatgatgatgatgtcatgctactggactgggtaattgactagcacaatcttcaattcaaattgcagtccatattcatgcccttttgtggcttgatgttgtgttgggagttagataaaattacttttatgtatgtccaaaatcgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaaaggctggagatgttggttgatccagatttacagagcaactacattgatgttgaggtagaatcactaatccaggttgctcttctttgcacacaaggctcccccacagaacgccccaagatggcggaggttgtgaggatgcttgaaggtgatggccttgccgagagatgggaggagtggcagaagatagaagtagtacggcaggaggtagagcttggccctcatcggaactcagagtggattgtcgactcgacggacaaccttcatgcggttgagctatcagggccgaggtgatgacagcgcactggtagtttgctgctaattcttgtccgtcggaagagtgatttttatcagccatcctagtcgaatcgccatttgttcataccaaccaattggcccaatgtagccagctacaactatgttttgatgtatattgcttgatttgctccttgatgtgccgccttggatatcggtgacccgaaaacagcaggagcccaaggaactattgtcctgaagcttgcaagttgcaacaagatcccagtatgttaaagctcacaaggtagcagctaggagtgaggttgctgcggctgtttgctggacctgtgaaaattgtactgactggtgacatctaactattttgtaccaaatgtaaggaaaaaccatggtattattactttggcctcctctgggaaaggttcagaactttcagatgatgcagttggcctcactggtatactctatttggacatttgattatgatgtgtttactgtaaatgatacccagttctgaatcaaatgtaccttctgcatacagatgaaatctttggtagaaattgcttatttctttttattgggtcgattgtgcaatcttgtttccttcgccgtgtccatcacgaaagatgacttgaaggctagctatgtactccctccgtctcataatataagggattttgagttttcgcttgtaacgtttgaccactcgtcttatttaatttttttaaaattattatttattttatttgtgacttactttattatccacattacttaagcataacttttcgtttttttatatgttcatccatttagcacttataaatccgtttgaattcaactattttccaatttcttcacttgctccggccatgggtgcagcaactccaaatggctcgtctttttcttgagaacaccaaatggttcgtcttgttcgtatatttttatggtgcatatgttacgtagcttctcgacataaaacgtcctgttcataaacatactttttcacggttggatatctaccatgaaatccgcagaggatgttcagctcttgtcaaattcttactgcctgtttaatacaataaatctagatagttgtttattacactgtgttggtttgtttattttgaggcagagggagcatgtctcaaacgtgttggttttgcatcaattaaaacagtatttctcagtcttaaaatataagcatttctaagtataaatatgaacgactgtatatctaaattcgtagccaaaagttactatattttgggataaatgtagtatgtaagacaatgcagttctcaagctgccgaattctcacgttccaaattatggctttagtttcaaaatgacagcaaatcctctcacggatcaaggaattgagaaacatttgacttacaaaattcaaaaaagcccaacaaaaacccaaaaacccaccagccagagggtttttcactttgggtatgtttagttcccaaaaagtttttttcaaaaacatcacattgaatctttgggcgcttgcatggagtattgtatatagataaaaagaaaaattaatcacacaattatgtgggaaatcgcgagacgaatcttttgagcctaattagtccatgattagccataagtgctacagtaacccatatgtgctaatgacggcttaattaggctcaaaagatttgtctcgcggttttcgggcgagttctaaaattagttttttcattcgtgtccgatcaaacgtctgatgtgacgttcaaaaattttcttttccccaactaaacaagccctttttctccctttcacccttcccctccaggcctccacctggctcaaagccggtggcatactttcccggtgatggcagcggccggcgagctcgcaaacgacggcggagacgcaagtccggtgaccccatgcccgctagaggtagcggcggcaatgcagcttctcttcctcttcctcccccgccggtctcccctatcctccctcgattgtggcgtcgtcccgcggcagctcgcgagtgcatgcgcggcggaggtccaaaggaccggaggcggggacgaagcgagcaccgccccccgccagatccggaggcggagtgccgcgtgcggcgtcgcccgcggcggcccgccggcgggtgcgcgtccaaggggatcaggcaagctgctgcgctcggcatcggcggatcggcctcgctcgcactagtcgcactcatcgtgggactggtcggggagcaacggctttgcgccgacgagcataggcatgcggcgatccttccttcttttgcctcctattccagtgatttcttgcaaattacccccaaattgttgcagatcagatggatttccttgatttcttgtgcaggcgtgccgccgctcaacatggaaactttccaagtgaaggaaagatggagactatgaaaaacgctagctccacaaagtggtgtgctagttggtctaggttcgaaatctcaccccttttatttatttgatattagtttattctccaatattcgtgtttttttaagatggagaatattataactgaaactaataatagcaatactgaggtttaggataataattgtgcggccagaaaacactattcactgaggtttaggataacaattcactaatattcgcggtttaggataacaattgatattagtttattctctaatattcatgtttttttaagatggagaatattataactgaaaataataataacaagagtgaggtttaggataataattgtgtggccagaaaacaaggtttaggataacaattgtgtggccagaaaactctagttgacttgaccgagtggactaggtgcatcatcttccttgcaaataccatataggcatatgaacacaatgcatttcctcagatcctgaacaattacaagtagcttcctactattacgactagtaccatcaaactacttcatccgactgagagctgagctcagacataagagagtaatggcgacgatgcttgtgggtgtttctacaggagtaatgaacaccctcctgtccaagctctccaagattttggaggacaaatacacaaagctcaaaggagtacgccgtcaaatcgcattctttagaaatgagttgagcagcatgaaggctgccttggagatgcttgaaactgtagaggaacttgatcccctccagaaggaatggagggacacagtgcgtgagctggcttatgatatcgaggactgtattgatcccttcttggttcttgttgatcagaagcaagatgaacaatcaacattctttaaggggttctcctacaaactgaagaagatgaaggctcgccatgagatctctaatgagattgaagaactgaagacacgcgtgatagaggcaagcaagaggcacaagagatataattttgttggtctacaatccagccatggcacttctggtattgaccctaggctgcgagcactctacgttgaggttgatgagcttgtgggaatcaaaggaccaaaggagcatgtcatggagtggtttgccaaggggagaggtgatgtagaagtgaaggtgttgtccgttgtgggttctggaggtctgggtaagactactcttgccaaccaaatcttccgtcaattgaagtgccaatttgaatgcacaggttttgtatctgtgtcacgaagtcctgacataaagagtatttaaagacaaatgcatactgaggtagggatcactgatgacacatctgaagatgagcgacaactgatagacaaaataagggaccacctcaaagataaaaggtaaacccagtaatccacttataacaactaatgattttctgcattttgttaagcacagaaaccaaacatggaagcatacaataaacaataattagtggcataactacatgcattttctttgtttataaagtgcatactgcatatacatatgctaaaaacaagaagtctagtcttgactgctataactgtcatgagtaaattgcataaactttctaaaccatttttgtataacaacattaatgaaaaactaacttcttgatggcaaatgacaaagacgtgtgtaaatttgtactgcttgactttttttcaacaaaatccaaatttacaaataggatttcttttctcagagtgcaaaattgtactgcttgatggcaaatggcaacacatatgtgagcatttggaaaggaaggtatttttctccattcctactagaacaaaactaccacctgtggaatatctgcattccaaacaattttttttctcaaaagcgcaggactgcatttcatttcatcaagaagaaaggaaataaatacaaaaagagggggctaaactaacaccagcctacactaacaacacctaagggcaacacacaacctcaacaagcaaacacaaactaattgcccggggtaagcaaacctacagtgaaactcatggagtgcgtaagctccagcaaaactacactcatttattttatagcctgcaaactcccgcgcccccccccccccaaaaaaaaaaaacgtttggattagcactattgaaaacacaatcgttgcgatgcttccaaatctcccaagcaactaggatgatcaacgagttcaatcagttgtgcaactctagataccccttgatggctttgccccaccatgctgagaatcaagtttatgatggttgaggtgcagcaccagccagccgtagcctcaagaggagtggggcaagagaaaacacatgatacgaggatatgctgaaatagtcatcaccactttggtcgcttattgggcaggcaacaaaatgtgacaaccctcgcttagcaagtcgatcagaagtcaacatatgacgttgattgctaaccaaataaaaaacttgcaacataaaggagctcagcttttccaaatccgcttccatggagcaaacttgatagatcccaggaaataagacttgtaggctgatttacttgtgtgggaaccagaccctgtgagcttccaaatatgctggtcctgaactccatgctgcaagaccaccccatcaaccaaatcccagatcagcaaatacttagagagaacatggacagacaagccaccttttataccagccacccaccgcctatttactagtgcttgtgccacagtacgttgcttcgttgatcttttggtgattaaataaaaaagattgggaaagggcatgtagcctagtggttgcagtaatctgagtagcactccaaggtcctaagttcaaatctctataggagcgaatttcggattgggttatttgagggctaagttccctgtttgataggctaagttcataatttaaaaaggctgcatatatccagttggatgtagagatcgggtaaaaaaatacccttctctaaaaaaaaaagattgggagcctattcagttatcgttcttccttgccaccatctatcactccagtacatggtattttccccgttgccaactatagtttccacacccactctgaacacagagcgaacactgcgatgtacttgtataggtaacacgttacaaggcctagtggagtcagtttttttaagtctaagccacctcaagattatgaatgccaagccccccttaaagagaggccaacaaacacgatcccaggagacaaggcagttatcactattggccttctcctgacccttccaaaggaagcccttgcgccttttatcaatagccctggacacccatttgggaagattcattgccatgaccgaatagataagtatagctgtcaagaccacacagaccatcacaagccggccagcctggttcataagggaagctttccacactggtaggccatccgccactttgtcaaccaatggcaacaaatcatccttaatggtttgcgagttgtgacggaagggcaagataagagcaaggaaagctcttcacttcacaagaaagctcagtggagagaacttccaagtcttcctcggaacattggataggggtgcacaaactccttgtcattttggtcttaagacctgaaatacagccaaaaaaatctaggatcacccttgtaggtcagaggaacatcattgttatgtggagggatgaattggggtgctcgacgggagggcaaggttgctgcagcttcgctgccccggagcctaggtgaggccgaacagagaagaggggagactagagataggtttaacttctttcttgattaattccacatgactgtggtgcctctccttatatagagccggctcctaacaaacatcctaacaaccttatcaaataaagcctaacaaacctcctaacaaccttatctaataaagcctaataaccttatctaataatgagaggggctgagttctgcccataacaatcaccacattatctgtgcgtatagagaaatccgatgtgccatctttggaacagcatggggccgacgaagattattgtggatgcatgaaccacgataaattcagcaaattcataactaaaaaaaaacatggggatggaggctccgaagatgaagtgttatttgccccggttccctattaatcaaagctcctgtggaagaagtggagagcggtaggcatagcaagttacaataccaccttccaaaccccaagtattttagtacctcaattaggaaggaccaatcaagcgaatcaaaggcctttgatatgtcaagtttaaacaaaacatggggctctttcttactgtgtaattttcttgccacctgttggacaagcagacaattgtcctgtatacttcttcccttgatgaatgcactttgatttatggaaaccatccccggaagcaaaggtgctaggcgatgtgccaaccaacttagcaaaatttgaataagactaatggaacgataatactttacttgaatcgcatcaattttttttttggcaacaaggcaatgaaagctgttttaagaagtttgaacttagccacatgaccacactgaattgctgagaaggccaaagatcacatcattttttgataatgtcccaagtcccaacacgatgtagaaccgaaagttccaacttccgaacaattgaatgtccacaataaatccatgcattaagatacattgccacatactcccctcaataagtgtatttttagcctaacaatttgtccctaatagagtgtagttttatagtggtccactagacctctttaatactacatccttttcttctcattttagtcattgaacaaatagtactccctcctcctcgttttctccccctccttgttttctctccattttaatgaagggcatattagtcttttgacctcgtccttaatatgtctttgactagctaaaactacagttatttagggacggagggttttatgtgtgcaaaatctgaccatatatatgctttgagaagacatatccatttccctaactaggttcctcattgatatttataaaactgggacctgagctctagagtaagcatgcatactagtatataaccctgattgcagtagggtggtaagcatacttgaatgatatataactaaataaccctgttaaaatcatggaacaggtactttgttgtaattgatgatgtatgggatgttgaagcatgggaagctgtgaaacttgccttgttcaataatagatgtggtagcagaatcgtcatgacaacacgtaatgcagcagttgcatcgcattgctcacgtggtggtgtttgtgtctatcaaatggaaccccttagttttgctgactccaaaatgttgttttgccaaagagcatttcgttcccaggaattatactatccccatttggaagaagtttgtgatgagatactggcaaagtgtggtggattaccattggcaattattactgtatctagcttgttagccggcaagcatgcaaaagatgaatgggacaggatgctaactgctattggccatgcacttgctaagaatcctgatgctgctaacatgacaaagatattatctctcagttactttgatcttccccaccatctaagaacttgtttcttatatttgagtgtatttccagaagattacaagatcagcaagcaacacttgataaatagatggattgccgaaggatttgttcatgaagaacaaggatggaggacctatgaagttggcgggaactattttaatgatctcatcaatagaagtttgatcgaaccagttgatataaatgatggccaggcgaaggcatgtcaagttcatgacatcattcttgatttcatcacatgcaaggctgccgaggaaaatttcgtcacctcagtgaattctgtggagcatgggaacatttcagaatgcagagttcataggctctgtgtcaagaatcacaataatgaaaaggttagcaaaccaacaagcctgaatgtcactcatgtccggtcacttaccatgtttgggcatgtcgatggaatttccttgtttgctttcccaattttgcgtgtgttggacttatcatattcactgttaaaagacaaacatcttaaaaatattgaaaagttgcattttctcaagtatttatctctccggtcaacattaataactaagctcccaagaaagattggacaactgaactgtctagaaacactggacatatcttatactgaaattctagaactgccgctaagtattgcaaaacttgagtgcctggccaatctatatgttggaagagggactagatttccggacagattaattggtaagatgcatagcctggtagaactagaggaatttggcgtgtcatgtgaactaggcaagtctctgcaaggattcagtcagctatcaaagcttaggacgttgaaagttcatcttttttggtggtcagatgctgaggagtgtcaaaattacgtgtcagctttgctatctagcaaccttcatcatctatatttgaccggtggcccactgatcatggagaagtggtaccctcctagtccttgcatcatccggaagcttcatatcataggctgttacatccgtaaggtcccaaactggatgagctcgcttggaagcctcactgaattacaactctggatccatagaatgggaccgaatgatattgagatccttggcgcaatacccagcttgtgttttctcaaacttaaaactatgtgtggcatcaatggaaggatcatcatatgtagcaacaaaggattcagaagtctgacatatttctcattacgaatcaagagatgtgggaccttgctagagtttgaaccagaatcaatgccaaagcttgataacttccaagtggaattccgtttacatggaatggattgcctgaatggtgcttctgatttcggcatccagcacctctccgcccttaccaaagtcaagatcggtatttggggcaacatttgctctgatggtatttatgatccagaacaagatatgaacaatagcatcaccaggtctgttgttagcctaatcaaagctgccatcgagaagcttcccaatcatccaactagcagattccatttagagtatgatcatggaagttgtttattggtaagttcttgaccagacctggagacattgattgttaattcatcgtcttagtttcaaatcctattattgttattattactatttgtttcttggatgctgcaaaagtgcaatatcttatcgtttaattggacaattaattcgctcctggcttgtcgctctctttcttgagctgtggctctgtgcctgtttccttccaacatttgcaggacgtacctcacctgatgcttttaataagtaaaaaatgtgagattggatcatacaaagcaatcagtagctgccaagaagggattactggaagcgaagttccgctatctgttttctcaataataatcatcctcacattcatttttctttttgtgccatgtgtaacagggtgagacaagtcaagagtttgagggtcagggtccagatgaggcctatcctcgccagcataaaattttttcactacgggaactagaagatgcaacaaattgctttagcgatagcaatgttcttcaacgtggtcgattcgacggcagcatgtacaaaggaagactaggagatggctcattagtagctgttaaaaaggattatataagccgggctttaagcatgggttatccaaacattgattggagaacatggcactttcaaacacaagttgagatgcctgtgcatagaaacctgatgcgtcttcatggattctgcataacgccaacaaaaaggttccttgtctatccatacatgtctaatggaaccgttgcatcacgtcttagagttacgttgccttttttttttctagtctgacatccctgtatctttcagataattagagggttgatttgggttttatattatagaacggccgccatatgaacctccacttgattggcgaacaaggaggaggattgcattgggttccgccaggggactgtcctatttacatgatcattgtgacccaaagattatccatcgtgatgtcaaagctgcaaatatttcattagatgaagactttgaagccttagtggggggttttggtttggccaaactaatggatcacatggataccgatgaaccaaatgcagtacgtggaacaattgggcatatcgcaccagaatatctttcaactggaattatctctgagaaaactgatgtatttggttatgggattatgcttttggagcttattacaggacaacgtgcctttgaccttgctcgtctagccaatgatgatgacgtcatgctactggactgggtaattgactagcacaatcttcaattcgaattgcagtccatattcatgtccttttgtggcttgatgttgtgttgggagttagataaaattacttttatgtatgtccaaaattgtatcatataaaaaatagtagttacagtaaggtcttaaaagtagtcctttttttaatcattatggcattagctaagctaagcataggattgaacatcatcgtctgagaaatacactgttatatggtaagccaatattcatgtgctgtgctttgtgcaggtaaaaggattactcaaggagaaacggctggagatgttggttgatccagatctacagagcaactacattgatgttgaggtagaatcactaatccaggttgctcttctttgcacacaaggctcccccacagaacgccctaagatggcggaggtggtgaggatgcttgaaggtgatggccttgccgagagatgggaggagtggcagaagatagaagtagtacggcaggaggtagagcttgttgggaatagtcacacattgtttatttagagagagttgaactaacttaaaagtggggggagtcactcacctcttgatgtagcttttggggtgtagcaaggctttctcccttttgggatgtagcaagactttcttccggttgagccaacgtctcctgattttgggccctcagagcttggccctcattgaaactcagagtggattgttgacttgaccatcggaactcagagtggattgttgacttgacggacatgattgttgcgcactggtagtttgctgctaattcttgtctggtagttgctagttcttgtccgtcggaagagtgatttttatcataccaaccaattggcccaatgtagccagctacaactatgttttgatgtatattgcttgattggttccttgatgtgctgccttggatatcagtgctccgaaaacggcatgatcccaaggaactagtgtcctgagcagggtttcacaaaccgccgcggccggggttaccgtgccctggcggtaagcacagttaccgcggtaactgtgaaaaaccgtacgaaaccatgcaaaatatattaaaaattcaaattatttttaaaatttatttaaatttaaggaggttaccgtggtttttctattaccataccccgcggtaaggccggtaaccgcggtaaccgcgcggttacagatggtaagtcaaaccctggtcctgagtggctgctgcaagcttgcaagttgcaacaagatcccagtatgttaaagctcacaaggtagcagctaggattaaggttgctgcggctgtttgctggacctgtgataattgtactgactggtggtgacatctaactattttgtaccaaatgtaaggaaaaaccatggtattattactttggcctcctctttgaaaggttcagaactttcggatgatgcagttggcctcactggtatactctatttggacatttgattatgattgtgtttactgcaaatgatacccagttctgaatcaaatgtaccttctgcatacagatgaaatctttggtagaaattacttatttctttctcttgggtcgattgtgcaatcttgtttccttcgccgtgtctatcacgaaagatgacttctaggctagctatgtagtagcattcagatatgttcatccatttagcacttataaatccgtttgaattcaactattttcctatttcttcacttgctccggccatgggtgcagcaactccaaatggctcgtctctcttcttttttttttcttttttttttgagaacacca

SEQ ID NO: 531 - DNA, 6465 bp, Oryza sativa
tctatttttaaactttaaatagttaatacccattttctttaatggcttatctcgtattctgtacttcacaatcttctcattttccttctctcaaatactccatccgtccaaaaaaaaaacccacttctgggtttgaatatggacataagtggtttttttttgggagagttacatgttgacctaggacgacgagattgtgcatgcatggggagacgtttgacttttgagcatagctcggcaaaggccggccagattgctagggagaaacagggccaggggagacatgacatatgttgtacactatacaacatcttcagaattatgacaaagcacacacaagtcaccataaaaaacacagacaaactgaagtgaacaaggccaaatcgacccctgttgctgtaatttttgtcatgaaaaagaagggctttaggaaatgacacagatatgagtcatcgaagcaggggatccccaagaacagattgcaaaggcaaggtgtgtgcgcgcgcgcgcataagcttcatcagattcagagagagcttaattatcaccgatgtcccatgcatcgatctgcacctggctgtgcatgtactaccccaatgcatttctctctctacctgcgtgtttgactgcaccttgagcagcagcagcagcctagatgctagctactctgcattggaccatcctcctagtcctaggctgtaggctcatagccctccttgataaaagctactactggcacagtatatgcatgcagccaattcacttcactgcagtaaaaaaaaaaagaaaacagagagaaacagagatcaaacaatgcaagaaagaaatacccctacttctactttaaaacaaggccaaagcaaggaaacaaaaggcagcctctattttttttccctcccccccctgctcatcacccctttccatcactccctccctttgcaaagatccttcctgcctttgcttctactgctatatagcctcccccctcaccttccattccagagaaaaatagagggagggagagggagagaagcagagtgttgagcacaagctagtgaaagggttagatagaaacttggtagaatagacagataggcagagagagagagagagcttagcaagctaaggcttagctgctgcaaggctccatccatgcttcttgttgtgagatgagattgagataagatgagcagggggtggtggtgcctggtgtgaggctataggtaagatggtgggaggagagcttgtgctggctgctctggtgatcctgcttgctttgctgctgaccctggtgctgagccacttcctgcctttgctcctgaatcccaaggctcccaagggaagctttgggtggcctctccttggtgagacgctgaggttcctcagtcctcatgctagcaacaccctgggcagcttcctggaggatcactgctccaggtaaattaaaatcatatgcagtaaacatttctatcagtatcaccaccacaaccacacaggagcaacaagtgtcatcttaccatgcaattaagtactgtaccattatttcatgtgacagcacaaggtaatgctgctgtcctgtcccagcagctttatcacgcccttttttttcctccctgatgaggggggtgctgtaacatgaattggacagtgtttagcatcttgttaaagagttgtgcaaaccttttcttccgatgaacaagcgagagaaaaggaatgtaaaggttgcacaacacttaactagctagcatgcatggtggtagtaacactgatgatggtgtgatgatgatgatgcaggtatgggagggtgtttaagtcccatctgttctgcacccccaccatagtgtcctgtgaccaggagctgaaccacttcatccttcagaatgaggagaggctgtttcagtgcagctaccccaggccaattcatggcattctgggcaagtcctccatgttagtggtcctaggggaggaccacaagaggctcaggaaccttgctctagcactggtcacctccacaaagctcaagcccagctaccttggcgacattgagaagattgcactgcatatagttgggtcatggcatggcaagagcaaggacaaggggatggtcaatgtcatcgccttctgcgaggaggcaagaaaggttagcaagtgtactaacttgaaaccagagccatatcaccacaaggacatgatcccttgaaacaagggagggaaaactttgcacatgttagctacataccatcatcatcatgttgttacttgctgctgcatgaatctttgtcccaaggtcactttgacttaccatggtcttttttaccttttctttttttttctctctctggtgtgctctctttccttgagaaccacagtttgcattcagtgtaatagtgaagcaggtgctggggctatcaccagaggagccggtcactgccatgatacttgaagatttcctcgccttcatgaagggtctcatctctttccctctctacatcccagggacgccctatgccaaagctgtgcaggcatgcaactcaacatctcatttacacaagtcgttaaactgtcaataaaattttcaggccattttatttttgtatacttaccataataacttcatccttttgtccgcgaatcctcacaggccagagcgaggatatcaagcactgtgaagggtattattgaggagaggaggaatgctggctccagcaacaagggtgatttccttgatgtgctgctttcaagcaatgagctctctgatgaggagaaagtgagctttgtgctggattccttactgggaggatatgagaccacctcactcttgatctccatggttgtgtatttccttgggcagtcagctcaagatctggaactagtgaaggtatacagacttctcatgctgaaaaagacagagcagtactggtaaataagtacttaattaagtggccatcaataaaatatatattaacatgtttgcatgcagagggagcatgaaggcataagatcgaagaaagagaaggacgagttcttgagctctgaagactataagaagatggaatatacccaacatgtaagatgatcgttcaatacatgctttaggattagttagtaagccaggggtacctttttttcctattatcagcaactacacaaatatgtgaccctccgaatatgaggtttactcatattcagaacgattctcctatgcctacccatatatgcaatttttgaattaagcaaaaaaaagaaaaagaaacagagagagaaagaatctcattacaatagagtgaaaagggcggaagggacatgttcttcaataatggaaactgtatgatgatgcatatgctatgcccttacaggttatcaatgaggcactgagatgtggcaacattgtcaagtttgtccacaggaaggctctcaaagatgtcagatacaaaggtaattaaccctacttgaggctttccttgaagattccattgtgctcatcacatgataatggatcaggcaaagtggatggttgcacctttattactgatttttaagcattgttattcctaaaatacctcagcttttcatagaagatgctcaaaagcaagtggctcttttttctttgctctgttgcagagtatctgattccttctggttggaaggtcctacctgttttcagtgctgttcatttgaaccccttacttcatggaaatgcccaacaatttcagccctgcagatgggaggtacgtttgtttccataatctgtgaatgctccgcaatacttactaaatgtttattgttaatgacctaatgaaaaatgttttggaccagctaggccacgaagcttagctttcacgtagtatacttttctataatacaaatttataaaatgaaaagttcagagcacctatcaagagagcttatctggagccttgaaagaatcttctttaaagggtgttctctaactaattgctacctttaattagtgagcgcccaactatgacataattactcgcaactattctggtgtcttcagatgccaaacaagctccctgtggctgcaatgccttttgtgcatggtcctaaccatgattcctctcattcaaagccagcattcttggctttgcttccttttcttagtttctgtgatgaagctaatggtctgattcatgtgtgttcctaatctgattgatgcaacagggtgcaagccaagggacaagcaagaagtttacgccgttcggcggtggcccccggctctgccctggatcagagcttgcaaaagtagaggctgctttcttcctccatcaccttgtgctcaattataggtaaaacaaaagggtatatttgtcctacccgagtagaagatgcatggatcaaagttgactggcttaaacagcaatgaacaaaatacgttcagaagtaatatttaagaagctggtgcagagtagttggtgtttaaataggccatagaaaactgttgaggcaaacatgaacaggaaaacatactgatgcagttaccactctcatactgataatacacactacactagaccactagtaagtaatggcaagaaggccatgacagcaactaggcaaattatttatgcttttgtctgtaaggaccgcaagtctgaactcagctatcttgtgcattttcataagtggcactgtagagcatagaatcagacgacaacacacagaacaaacatgacagcatggagttttcgataggtaggctatgcaagttgagttgagggctgccatacaagataaaatatactaccacgatatgatcaaactcttttttttaaaaaaaaaactaggttcattagcaacaatctatacgtgacaactgacaagaacaggcagatttatgtaaattatgcggttgtttcagagtagagtctacatgtacttactgaatatccatgccagagaaaggctgatcatcgttcttcgtttctttcgtttcttgaaaacctgtgcagatggagaatcgatggcgatgacattccgatggcatacccgtacgtggagttccagagaggtctgcccatagaaatcgagccactttgctctgaatcctgacaggtttgcagttgcagccacggtgagcgagttcatcaaatcatccccgcaagcgagggggagatgcgggcgagaacgacggactgagaggattagtcagtgaaacaaaaaaaaggagagaaaatatttcaagaactgaagaatgcactgagcattagctagtagtacctatcaatgagccaagctgagattgtaatttgctgtacatggtgtagatatattttgtccatgccgattgcttgcggtggtggtggtgcggtgcttcaccctgtaacatcctccactgtttcaactttcatctgctattctatagaagaaaaaaaaaagaagaaaattgggctattgggctattgaaaagattttggatgaagccaaagatcttcaaaaacaaatcattgaaactttgaaagagtactcctatcctttaataatatgaacatgaacatgaacatgtatggactgtactctgcactacttctcagggaatttcggagcagacaaattcgatcgtggataatccctatcaatcggagatggctggtcccgtttggattggaggaatttctgaaggaatcctttcctgcaggggaaatcttagtttcagtgtttctggactgaaggaaaaaaccggacgaacagcagcattattccataagagtgggagttcccccccccccccccctcacatcgctagacgatttcacgggataacagtccccgaatccaccacgcgtaacctcgcccaggatcgaggccgaattccagccgaagccgcgccgcgccgtcgtccccgtatccaatccaccgcggcgtcgactctcccgccgttgcgcccggcccaacgccggcggcggtcccgcctctagcggcgcccgcaggatcatctgcacacccccgcgcgacaccgccgcccgccatgcccgccgctcgagctcaacgtgagaaggggaaggggagagagatcatagtatgagaggtttactggagaggataagttaaagagaaaaaaggtataaaaaagaaagaaagagaaagatcataatatgatttttctatgttttttttaccaaaattttcgatgtttattttttaccagaattttctatgtttattttttaccagaattttctatgtttattttttaccaaaattttctatgtttggtggagtaatcctcagtttttgcagtcgtgttgctgtgttttcttttttgcgcctatattcctgtgtaatttgtatagggcataaagtttgtcggaacttgggattatgtggaacatagcatcgcattgttcaggaatgaggactgcaattttgatcttcggggatttgatcttgaaaaacatacgcacatacaaaattgtatcacattgttcaggactcaggattgca

SEQ ID NO: 532 - DNA, 7372 bp, Oryza sativa
tagttgagaaaagaatgtaagttgagttcattttgttgtgtctactattccaaagtaagtttgcttctagcgcaagtatcatcaatttgtaaatcgttaagttttactccctcctttctaatataggtgcaacctaatatagatgtgacatatctaatttttttttcacgaacgcgtataagaattgcacgttaatataatatattagatatatccaatgttacatttatatttttttaaccagatgttacatttatatttatattgagacagatgagtattcatttagtcctcttatcgacctaccatcaatgctattttcttattaatgatgggcactttgatattttcttctttcacgaacacataggactaaaaagtaggagcaagttattttgtaatgaagggatctaaaacatacctaaggcgtgagtatatcaataactataaattcagcactgaattgcaagttttctgtttaccctgcttcttattattttttctgaattgatctaattatggcataagtgcgagttattgggattgacttagtaataaaaagtaattgacatataataaataatcatctaagacgacatattaattaattactccctttgctttatattgtaaggtgttctaagttcatcttaagtcaaactttgtttaactactatcaaaatatagaaaaacttagcaacatctctaacactatattaattttattaaaaccgccattaaataggagcagatctttatagtattttattaaaaattgacttgcatcaacttaattaatatactactagcagtttcaaaaattgatacgctatctgtaaccaatgtaatttctacccatataacagctactaatataggagtatatactactccgtccgtcccataatacaagagatcatggccttcaaatttatcccgaaacgttagagatcttggtatcccgagacaatacttatttattcctcacccctaacttaaagcgagcagccaagctactgtagctaatggtagggcgcgtgcgacagtggagtaaagtgaagcagcagcagagaagcagagaccatttccctcctccctcctctctcgccaaacacgacgacgtcgcctcggtttagtcgtcgtcggccggcagccggatgacgggcagtagttgtccggccgattcttcccagctgctgtaccctcgccggggtgcccccaccaccaccaccacctcccgtcctcctctccatccgctcatcgctcatgcgccctacgacgtcgtcctccaccgatctgtcgtcctctccatcagctcagctcgtgatcaggctgagctcgcgagcttctggtgctatataaggctgggtggtggtgcaagtgcgaagcgagcggccggtgaggacgatcgatcgagatcgagcttgacggcggcgagaggaggaggaggggagacgatgagcgggcgggggaggggggacccgctggtgctggggagggtggtgggggacgtggtggacccgttcgtgaggagggtggcgctgcgggtggcgtacggagcgcgggaggtggccaacggctgcgagctccgcccctccgccgtcgccgaccagccccgcgtcgccgtcggcggccccgacatgcgcaccttctacaccctggtacgtacgtacgcacgcctccgccgccatcgccgccggcgcggcagctagctgagctgacacactgctcgatcgattcttgtggcctctgcaggtgatggtggatccggacgcgccgagcccgagcgatccaaacctcagggagtacctgcactggtgagtcatcgatcgagtcagcacagcagcagctgttgtagctgacgcgccctgtgacgactgatctgattcagattcagagtccagattcagctccctgcaccgcaccctcgtcgtctcgtgtcgtctcgtctatcgtgtcgtacgagatagagcgtatagctatagccagccaagtgcccgtgttggtgttgcacttgccgccacgagatcgatcgagccctttttgcctcttttttttttaaaaaaaaaagagagaatatttttgcatccgggtagcagccagtgaatacagttacgaaacatgaacgtttgatcgttgactgcatgctagctagctgcttttcaaaagaaaaagggcacacatttcttttaatttagatgaaaaacaatatatatggatcgatcacacattaatctctctctgcaaattctgctatagtgatgtgccgagcactgtttgattgggccttctagctagttttcctcgagataataacacactcatatgtataatatactgtatataatatatgatcatgatctctggaatgatcattacgtcgtctttgggagaaaaacacatgattttacacaaactgagatatagcaaagcaggaacgacattgagtagaacgatcttaagatagtatatattcaatcgatcgtacgtaggcaaataaactaattaattaatcaactgactgagatactagctttattacagaaacaacaccaaatttatcagcattcaaacattattttatttattattaatttccatggaatgtctcaaacaatgtcagaaaatcaggtgatgttttaagtgcagtatagtagttttttatgtgtacaaaagttcaatatatatttttcagaatcatttcaataaatacatcatagctaggattatcggtaaaatattgtcacatataattcctagctaggaaaaatatataaaacaatttgcctgtatctacagtagttgcacatgctaaggaattgtatatatggattggtagatattatatttgtattgcacatccatgaagagataagaggtttaattttactcttccattatctaaaaggcaggtaaaacatttccattaattatctacaaaaagtctaaaaggtaaatatcatgttggatatatgtatcaaacgatagggttttctaaaacattctgtccaacaatttaaaatgtgcttagtttctttttttccccttgtttagaaaatagtttttatgaagttattttgagtggcattttccctcaaatgtggtgtgtatgaaatttactaaacaatttaacatttgagcttaaatgcatacacatcacatgaaattaatagcaaaacaagttgatttcttctcttcctagcttggttcaactaaagtaattaagagatgataaaatattatttggataaaagatggtgtaaattaaagtatctatatctgaaactagagaatagattttgatttttcttgataaatttattagagaagaatttgcagtacacataaaaacaagccaagaaagtaaaagtaattaaggagggaattaatgtaatgtgcacaattgctagaggaacatttgaaaagtaatccatatttatttgatgtcttttgcatggttgcatttccgattaatgttcatatatatgtgaggccttcgaagtaatttaccaattaaaatgataatttgcatgcacattttgtattgtatatagtgatgacataaaatgattttgattggcattgctacaaaaatgattttggcattgctgtatatgatcatacggccggggatattgattgcaatcagttgcttttgtcaatagttaattagaattttcgagtgtgaagggagcttatagacgaactgaccgaaacaataaaattaagaatcctcccaacacaaaaccctcatgtgcactgtacgtagatgtgtccaaagatcatgtgcaaaatttgtacaatcaatgaaaataggaccggatgtttcacatatatagttaattaaattccaggccataattttttaacaaaacaaggttgattatactaaatataagaaatgattataagtctattgttacaataaaggacataaaatttgccaagacaaaccaatatactccatatatagctcaaaaagtcacaagctagagatgcgagcagaagagcgcaaccacaatccttttgagttatttgtgcaacaaaaactctatttcttaatatattgacgtgcaatccttttgcgcgttcgcgaaaaagaagagcgcaaccacaacattgttgacgtcaccaactccagcacatgcaaaagtatatatgaatgtgtatatgtcaccatcttcgatcctttgacaaatctgtaagtcaacgtcatcaaacaaattggagacccagattttaaaatccgcaccaccgattgaatcgtcggtaacttagcatacaaatcttcctagatcttcatcgatgatcccagaaatacagaagacattgtcaaagatatacaaaagacaaaaagaaaaaaaactctagacaatcctaattccatggacttcctaaaagacaaatctcatctatctagaatatctaaaattccttttttttaagaaaccctaactaaaaacttactggataaagacaagacacgggtccccttcctccttgtcaccggcgaggatacaggagacgaggagggtacctgatgacggtggcacatgaggtacccttggcagaggtgagtcatgagcatacgatgctgctatgtgtataactgaagaatttttgttgagagaattccaggcaataatttacagaaaaccccattaatgctggttttaatccggctaggctagtgccggtagtgatagtcagtatctctctagttatgagctagttccaaaggccatttctatttgttgaaaccctacaataaaattaataaccggttcatcctagctagtaaaaagagaattccattatatatctaggtaaaatttattccaagacactaatgaaatttgtggcctttttctctagtacactagttttatggttatttgttaaaagacacttgaccgttagttaatatatattcttccaacagagagataaaacttaatttgcaaaagacaataatccttgaaccaccttcaatataaatttgaatattttttaagctgaatttaaacttgtcatacaaaattcaggaataatatattgtcccaaattacggaaatgagaattgccaaaaaaaaatgcaaaatcagaaaaatgaaaaaatattggatgaatttaaacgactttttaaaatgtttttatttccacaattttagtgcacattttctacaaagggaaggagcatataattacgcagattaatcattctacaagtacttagataaattcttaggaaaactaattgcccagttctcactatatatattatatgagtagaaaatacaacgtacactcctagaaatattttcatgccaaattaagcaaagctagttcctcattttgcgaccttcacatggttagttattggttaatatatactccacttgattccaaataatgtcagtcatttcatacttgctcacaagaatcaagaaaacatttcaaattacttcattggaaaattaatgtgaaccgatttacgcgacattctttcaccctattcaaaactgatcaacggaacttcaagttccatgtgctacctatgctgaaaatataatggaactgatcagaattaacgatctatcaatgcaggctggtcaccgacatcccggctaccacaggagtctcttttggtactgaacaactatagcactctctgaacaatcttgcaacagttacattcatatgtgtgcacatcaacacatgcatgaaatcagatcactctgatgtgaagaagagtacaattgcttgctaattttgcagggacagaggtggtgtgctacgagagcccgcggccggtgctggggatccacaggctggtgttcctgctgttcgagcagctggggcggcagacggtgtacgcaccggggtggcgccagaacttcagcacccgcgacttcgccgagctctacaacctcggcctccctgtcgccgccgtctacttcaactgccagagggagtctggaaccggaggaagaagaatgtgagctagctctcccctctctatctctcactccctgaatttgggacaagtcctgaattttgcatgacaaatcctatactcggaacgatttgaaatggtaaaatttgatcatatgtatttttagctccctatcctctctctctgtacgttagttacataaatgctcccaccgattctaaatgtaatttatttatatttctctatttttctcgaaatttaagttgttataggacgttgaggaactttgtcccccatttttcctttcatacccttcattgttaagggaaatgctaccactctgatatatataaaaatgatgtaccattttcaatatataataaccatgcacagggaatatagtcatgttaacactttgttaattcttaagcacagctctaagacgacctacatttggagtcagatgaggtattctctcttttagaaatagaggggaacactctctcccatttaattagaaagccctcttcattatcagaaatggcaaaaatgtacgtctatgttatatcggtatgatttaatacgattgaattgatattagatggatggacagatatatgtctcaaaatgggattgaactaataggcttacagtggcggatccagaaaatcgattcgttggtgtcataacgtgtctatcggcgtcatagtatgctaattatgcttagatcatggtgttactataatatatggattagcagttttgctatagattttaccgaaagtcgtcggtgtcgtctgacacagacacttatatccgtccctataggctaacccgctaatctatttatagaccaaataagtgggtaacccgttggtcaacccacttaattagtctataggtgggtccatggtcaacccgcctacactctacgattacgattgaagtgtacaatatgagctactattggttaatcaattgaaggcatttttctctgaatgatgtgttcgggtttttcatagatttttggaagtgcatttgatgatatttggcaagactacatatatggtcttcaataccgtggaggtgtctctccttgagtcccgttttagtgcaccttgtagctagctacaacttgcgtggttccatgtgtttgtttgcaaggagtaaggaaattgaataccaactgacgattgcaaaagttggcctgtttgatcagctgctatgcagaattatgccactgttactaactgcggcaatgaagcggcctccccatgcattgcgtgtacgtgacgaaccagctcaagccatttggtcggagtctgcacacactgcatgtatataagagctgtaattcccagtatagttacaaggacacaccacacacgtaataacaaagagacagtttcagatatt

SEQ ID NO: 533 - DNA, 2612 bp, Oryza sativa
tcttcctcgacgtcgacggcggtttcgtccccgtggtggtggccgacgcggaggatgatgcatgcgcggcgaggtggcaacgacggcggcggtggtggtggaggaggagactcgccggctccctctctctcccaggagcactccctcctcatctccaccgccctcccccttctcctcctctagattcggttatgagggcggtggagaagatcaatgcgggcaaccctgtgtttgtcagagaggaggagatgcaatctagaccaggttctatgttttttgtgtgtttcagctagtgtactcgtaatgttcattgtgtttggatcaaatgttgcaatggatattttgatagggtttcatatttctattttcgacattcaggtttcgttgatatttcgatggttcaaaagcaatgttcagctaatatactcatgatgtttctttatgtgtagatcaaatgttgtagtggattttagatagtgtttaatatttttatcttgatgtacactgggtttgttttgttgtacatagggtttaagtatttcaatggcttagatcgttttgttgcatatgttaaaccaaattgtttcatctagtgatctcaccgtgtttcaatttttttaagaactgaaacattctttcgctaagtgctgaaacattgtttttataaataatggtgaaacaacacactgatttttttggaaaaatctggcgcccaatttgtagacgcctccaattaataagtgcctgaataagattttccactatccaagaaatcataaactaagtaaatttatatatgctggctagctagctagcaactccggcctatatatacataagcagcttatcagatagctctaccagctgcaacgactcgatctcatcatatcgtgtcactcgcgctagtcacgctagatcgagtgctagtgatccatcgatattcgatacatatatatagagagagagagagaaatcgtgtgtaggtacgtagctgaggaggatgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaattactagcagagagtaatcctacttccactctaagctagctagctgctaatcacttagatctatcgatttaatttgtttctgcggccatatgcgttaattcgtacgtacgtacgtgtgtgccactgccaatatgcatgccacatgtgtgtcggcatatcgttcgtttcgttatcgcttcctcgatcgattacatatttgatattgttcttaaattagttttagctatctaggttagtcaatttccctcgactctttatgtaatctgatgagctagcttagcttctttgtgtaccaatggactttgctgatcaattatctatatatcgcttgctgttgattgacttttcgttttcgacacctaagggcctgtttacttcgcgaaccaaaatttttgacgtgtcacatcaaatatacgaacgcatttgaaatattaaacatagattaataacaaaacaaattacaaattctgcctagaaactgcaagacgaatttattaatcctaattaatctgccattagcaaatgtttactgtagcaccatattatcaaatcatggcgcaattaggcttaaaagatttgtctcgcaatttacacgtaatctttgtaattagtttttttctatatttaatactccatgcatgtgtccaaacactactaagtgatctttgccgagtggggaaaaaccacaattgtcccggtttggataggaactagtactaaagatcatttttcgtcccggtttaaaactttgatgatttttagtcccggttggcaacaccaaccgggactaaaaatcatctttagtcccggtttattcaatgtgacaggaaactaaacaggctgacagagtgaaaaatttttgtttgaaaactaaacaggatttttgccaagtaccatctcgtcattctatagctagtcaattagccgattcatatgacatttcaattgactagctatataaggacgagataagtttctatttgacaaatttattacgtat

SEQ ID NO: 534 - DNA, 4646 bp, Oryza sativa
tcttcctcgacgtcgacggcggtttcgtccccgtggtggtggccgacgcggaggatgatgcatgcgcggcgaggtggcaacgacggcggcggtggtggtggaggaggagactcgccggctccctctctctcccaggagcactccctcctcatctccaccgccctcccccttctcctcctctagattcggttatgagggcggtggagaagatcaatgcgggcaaccctgtgtttgtcagagaggaggagatgcaatctagaccaggttctatgttttttgtgtgtttcagctagtgtactcgtaatgttcattgtgtttggatcaaatgttgcaatggatattttgatagggtttcatatttctattttcgacattcaggtttcgttgatatttcgatggttcaaaagcaatgttcagctaatatactcatgatgtttctttatgtgtagatcaaatgttgtagtggattttagatagtgtttaatatttttatcttgatgtacactgggtttgttttgttgtacatagggtttaagtatttcaatggcttagatcgttttgttgcatatgttaaaccaaattgtttcatctagtgatctcaccgtgtttcaatttttttaagaactgaaacattctttcgctaagtgctgaaacattgtttttataaataatggtgaaacaacacactgatttttttggaaaaatctggcgcccaatttgtagacgcctccaattaataagtgcctgaataagattttccactatccaagaaatcataaactaagtaaatttatatatgctggctagctagctagcaactccggcctatatatacataagcagcttatcagatagctctaccagctgcaacgactcgatctcatcatatcgtgtcactcgcgctagtcacgctagatcgagtgctagtgatccatcgatattcgatacatatatatagagagagagagagaaatcgtgtgtaggtacgtagctgaggaggatgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaattactagcagagagtaatcctacttccactctaagctagctagctgctaatcacttagatctatcgatttaatttgtttctgcggccatatgcgttaattcgtacgtacgtacgtgtgtgccactgccaatatgcatgccacatgtgtgtcggcatatcgttcgtttcgttatcgcttcctcgatcgattacatatttgatattgttcttaaattagttttagctatctaggttagtcaatttccctcgactctttatgtaatctgatgagctagcttagcttctttgtgtaccaatggactttgctgatcaattatctatatatcgcttgctgttgattgacttttcgttttcgacacctaagggcctgtttacttcgcgaaccaaaatttttgacgtgtcacatcaaatatacgaacgcatttgaaatattaaacatagattaataacaaaacaaattacaaattctgcctagaaactgcaagacgaatttattaatcctaattaatctgccattagcaaatgtttactgtagcaccatattatcaaatcatggcgcaattaggcttaaaagatttgtctcgcaatttacacgtaatctttgtaattagtttttttctatatttaatactccatgcatgtgtccaaacactactaagtgatctttgccgagtggggaaaaaccacaattgtcccggtttggataggaactagtactaaagatcatttttcgtcccggtttaaaactttgatgatttttagtcccggttggcaacaccaaccgggactaaaaatcatctttagtcccggtttattcaatgtgacaggaaactaaacaggctgacagagtgaaaaatttttgtttgaaaactaaacaggatttttgccaagtaccatctcgtcattctatagctagtcaattagccgattcatatgacatttcaattgactagctatataaggacgagataagtttctatttgacaaatttattacgtataatcctgactgtttttaaacaaccattagaaataacctatactaatctctaacggttctgaatcgaagactttagagagatcacatggcatctctaatggttattgaccttcatggagaggccaacagtatgatatcacataatcacaaaccttaagcaatacaaatgtatggcaatttgacatcatgcatggatgataaccactcgcagatctaaatcaaaatcatcgcgcgattgaactagaacaattaatatcacactttcaaacataggaagatgaactgtagggcgtatatataattatatatagtaatgtcatatattcatgtatcaaaatataagcttgcacaataacttgacaccaattatatatggatcttaacaaaaaccatgttgcagctatgatcaagcagaacaaccaaactgatgataaataaatgaatagaagttacactactacgaacatagtttttgatggtgacaaaatctggttgtgcaggcggccgagccaccagcctctaacaaattaactaccagttccacaaccgtctatgaaaaatagattttcagaagcgagtactctaaggagaccgcttgtgaattgattttcaaatgcgatagtctaaagagatatgtccatgcaaatgtcttttggtgcaaaagaaaatggaaacttaaatctaatcatagcccgcagaatcccaaattcacaaattcgccaaatccatcacggtgcccctctgcatgcaatagcagctgcagccatgcgacgatgtcctcaccatagtcattgtcgctgtcgttgagtcaaatgcctcgtcgtggttgtcatcaccgagccaccatcgtcgccgagggggttgacgaagaagggtaaggaggcaaagcgagcagatttgccactcccaagaccatgggcgcgctcagtggtcgagtcgctaggagggagggagaggagcagtttggcggtggttgacagtggtggcgacatggatggaatagagcgaaggaggagagaattgggagagaggtaggagactgcgcgactcatggatgggccagcgcattttattaccgctcctcaatttgcataggccttctcgctaggaggctctcacctgtgaaaataaagatattttcaaaaaaataaagatattttcgggcggtcctcttaaatgctcaatagtaaaaatcatttttaaaggtgagtttagaccacaagaccttctcagtattattaccagcgtaattttaatggtagagataaaacccatttgtctgggaaaatcatctttcatattattaactattaaattttgacaagctataggtatatgtcactaaataaatgaaaatcatgttaggactctgtgctgaacacacaaactgataataaataaatagtactccattcgtttataaatttcatacataagtcattttgactttccccaaagtcaatttctttagctttgatcaagtttatagaaaaatatagtaacattttgaatataaaacaaaagaaattatcaaaatatattaaatgttagatttaataaaattaatttgatgctatatgcgttgctatattttttctataaaatttgtagattgatttaaaatagacagaacaatttataatatatatggaacagagggaatggaagtaacatggaggaggcgagatcgctgtgacggttcaaggtagcaattgggcatgtggttggagatggcccacaggcatatggcatggccaattttcacatacatatatatatatatatatatgcatccaaaattcccccatctaggccggtagctagagttgctaccaaccttcctctaggaaaaagtgaactttaaccccctcaactatggtccaaatatgattcatgccctctaaacgtgaaaccgggtatatcgactcctccaactatcaaaaccggtgcaaactatgtccctcggtggttttggctgacgtggaacctacatgacggtgttgatcgggttttcatcctatgttgcgttgacatc

SEQ ID NO: 535 - DNA, 6148 bp, Oryza sativa
aatctaattcaaatcagctcgatttcccatataaacggcaaaaataatcctgcctgcaaacgtgtcctaaagatagtcccaatttgcatatgctcctcatttcatttgctcctacctgaatttctgggactgcaattggcaagatccaagatgccggtcacatgatccaaactggagtaaaacatggacacaccttaggcccgtagctcaggtcttcgtcaatgacaattcgaaggcctcttgtttagttgcttggcacgggcatcaaatacgtttcaaactgctaataagttaatacagtcttcgttcagtgcttatccagtatactgtgcagctgaagtggacctgtcagcaagtaaagccaagaggccaatagggaataattaacaccttactgtaaatgacagttgatactaatgtaatgccataacttctataggatcactaagggtgaaacctcataataaaaaggataatgtagaaatatactagtactaggcaggaggccaatgtgtatcacacccatgaaaactgttcgaatatttttggcagcacacctcaagagccaagagttggtaaggttcacatacagatggttcatttcaatgccaatatgaacccagctcatacgactcaaaaatgtcgaacccttgcctggttctatcaacaagggaataagtattaatattttgacaaggctgtgagacaaggatgaccagctcgatctcttagacttcgaatttacaccctaaaaaattttcaagctaaaatgtgatactcttcaaagtttcaaaacaggagaaatatctctacaattctcgactaaaagaaagcaacttacagtgtgttgtccaagtgaatgggctagttgatgccttggggttcggtcttccacttgacatagtatccacttgcatagtcgcattagtagccaatactcatgggcacactgacatcgcgaacctccctctcccccttctataaaaactcagctgcattgctaagttcttccccatccattgcaacggcaacatacacacaccaccaccaacatagcttcttttgtcactgactacagtatcacagaatgctgggagggctcaaggacaagctgacagggaaaaatggaaataagatcaaaggcttggctgtgctgatgagccgaaaattactggatccaagggacttcactgcctcgctcctcgacaacgtccatgaggtctttggaaacagcatcacctgccagcttgtcagcgccactgttgccgaccaaagtactgatctttctccatttcttcctcgcttactttgcatgagtttgtacatgtttgctatgtagaaagaatcaaggatcagtactcagtactcagcacagattgaacggaaacaaggtgaaaacggccagtgacacaaatgaagtgactaacctattgtcttatatgctatgtgcagacaatgagggcagggggatagttggatcagaggcgaatctggagcaggggttgacagatttaccatcggtatcacaaggggagtccaagctcacagtgaggttcaactgggagatggacaagcatggtgtgccaggggccatcatcatcaagaaccaccacagtaccaagttcttcctcaagaccatcaccctccatgatgtccctggctgtgacactattgtgtttgttgccaactcctggatctaccctgttggaaagtaccactacaatcgtatcttctttgcaaacaatgtaagtcaggagtgattagcaagtctaaataccacaacgcctccctttctgttcttggcagatcttcttatcctgtttaaggttatcgtgagtaatttaacatcttgtaagtgcatagtttaaacgatagtgaatgactatattatatttaattaatcatcgatcatatacttagtaaaaagttctgcaattaagctcctaaactacatgcagaacatccaaagtgaagtagtaatagggagcaacagtttctgtgaaatcacgaacaccaaaattaatgactagacacaaatggaaagtttgtggcaactgcaagagtgcatcagatgcatctattatgccaataattaagagaatgaagtctgtgatgcaaagtgaggacttctctagttctggaatctggatattaattcctacagttttatcttccattggatgcagtcttaccttcccagccaaatgccagaagcactgaggccataccgtgaagacgagctgaggtacctcagaggggaggacaggcaagggccgtatcaagagcatgaccgcatctaccggtacgatgtttacaatgacctcggtgaaccagacagggacaacccacgccctgtcctaggtggctcgcagaagcacccctacccgcgtcgtggccgtactggccgaattccgaccaaaaaaggtacagtgttcctcttggttctgtgcatctagagagcacttcttgacagacaagttcataaactagtaagatctaatttgcgtgaatatccatggctgcagacccaaactcggagagcagattatcactgctggaacaaatttacgtgccaagcgatgagcgcttcgcgcacctcaagatgtcagactttgctgggtactcgatcaaggcaattgttcagggcatcttgcctgccattcgcacatatgttgatctcacacctggtgaatttgactcgttcgaggacatcttgaagctctacaggggaggcctgaagcttcccagcatcccagcactagaggagctgcgcaagagcttccctgtccaacttatcaaggacctgcttccggttggaggcagctacctgctcaagttccccaaacctgatatcatcaaaggtaccatgatttagccattgtgtcaattgccatagtcgatgagcagtggacaattagcgaactgttgtactatgcattgttgcagagaacgaggttgcttggaggacagatgaggaatttgcacgagagattcttgctggtctgaatcccatggtcatcaggcgtctcacggtgaactatccaacattacatagtctttgatgttttgtgctcctagcaagcatgaacaaaacaagctgatgctaatgtataattctctgttcataggaattcccaccaaaaagtactcttgatcctagcaagtacggtgaccagactagcacaatcaccccagctcacattgagaagaacctcgaaggcctcagcgtgcaacaggttaggcagtgatccatttcatttacagtgcaatcgatagtcatttgacaaactgccaaagttgatttgttgtcaattatggctctgcacaggcactggatagcaacaggctctacattctggatcatcatgatcatttcatgccattcctcattgacattaacagccttgatggtatcttcacctatgccacaaggaccctgttgttcttacgtgatgatgataccctgaagccactagcaattgaactgagcttgccacacatcgagggcaacctaacatctgcaaagagcaaggtccatacacctgcatcaagtggcattgagtcttgggtgtggcagctggccaaggcttatgttgctgttaatgactccggttggcaccagcttatcagccactggtacgtactggcagtggcaaactgtagttctttcctgaaagcagtaagctaacctcatcattgatgtaaactcttgtaggctcaacacacatgctgtgatggagcccttcgtgatcgctacaaaccgccagctcagtgtgacacaccctgtgtacaagctcctccagccacactatcgcgacacgatgacaatcaatgcattggcacgccagacactcatcaacggcggtggcattttcgaacaaactgtctttcctggcaaacatgctctggcaatgtcttcagcagtttacaagaactggaacttcacggaacagggccttccggatgatctaataaagaggtaattaaacaccgagagccacatcacaacaagaaccaacaataacataactttgaataacatcctaattttgtaatgcagaggcattgccatcaaggacccatcaagcccatccaaggtgaagctactgatcaaggactacccttatgcaacagatggcctggcgatctggcaagcaatcgagcagtgggtcactgagtactgtgccatctactacccaaacgatggtgtcctccagggagatgtggagctgcaagcatggtggaaggaggtgcgggaagtcgggcatggtgatctcaaggacgcggactggtggcccaagatgcagagcttgcctgagctcaccaaggcctgcaccacaatcatctggattgcatcagcactccacgcagccgtcaatttcgggcagtacccatacgcgggctatcttccaaaccgtccgaccataagccggcggccgatgcccgagccgggttccaaggagtacacagagctggacgagaacccagagaagttcttcatccgcaccatcaccagccaattccaaaccattctcggtgtctcgctcattgagattctatcaaagcactcagcggatgagatctatcttgggcagcgtgacacgccagagtggacatcagaccccaaggcactggaagcattcaagaggttcagcaggcagctggtggagattgagagcaaagtgttgaacatgaacaaggaccccctgctcaagaaccgggtcggtccagccaatttcccctacacactgatgttccccaacacgtcagacaataagggggcggctgaggggatcactgccaggggcatccccaatagcatctcaatatgagactgctgcacgcgtcacgcgctgctgagttggtgtaggtttgtggctgttatcttaggccctagggcacaagcaatgaagctgcatagtactatttgctacaaattatgcaagaataaagttttagtgctaataataaagttactgttgtagtgtttgtcccatttttaagcagcttcacatagcaagctcaaatgaagaggcaatgctgcaatatggatgattaattatgcagctttactcctatgatgttagggaggcagcttctgtggtcaaatttgcagcaataaaattcttcaaatttcctcaaatgtaatgattatatctcattcagtcacagatcgattcttacttgtaaatctagcataaccagtagcggaatcagaaattaaccacaaggcaggaaaacaagggctacgaagtgatttgattgccaatttgccatacagctatatatcgcgcgcgcctaattagttccatggcaacccgcatcgacattttgctcttttgctcacataggttgtagcattcagcaaaacaccaccttcgacacatgtcagaagctcttactagacaacaacacggtcactatccatcgcattgcgcacaaatccatctagtctacgtgcaagcagagagagcatctaactacgtggacattgcaaaatttaaaggggatgagaggggaggggaagggaaggagtggggagatactgaacctggggaagcagagaagagggagccgccgtcgtctcggtccacggcggcgagggcacaccggtggtcgacacgctcaagccccccacgaaaccgccatatcgccgccgccggccggcgccgccgcggggtcatcggagccggaggaaccgatttgtctcccgatcgaactgggctttgtattctcgctcgtttgctccgccgaatccaggagataaatgggccgaaactaggtagtaacagtttagacctgggcttacggcccataagcctggacgtccgggcctggttctctctaacatgtgaacctaccacttacatgcaatgtgattaggcaatgttccatgatataccactccgtgcaaaataaacctaattctagctacgaatctgaacataaatatgtaaataagtaaaacagaacagtacataagtggaacggttaacaagcgtgcacaactttccatatcacttcagcacatagctaataattgcacaaatctagcttgaacggaacactaaccaagcaattagtgtgtgagcatctccatttgcaaattaaacatgcatattcgtactggctggcagcacagagcctc

SEQ ID NO: 536 - DNA, 4486 bp, Oryza sativa
cggtgacggcgaggccgcgggcggcgaacaccttgccgaactcgatcatggagaccaggtggcccatgcacgccgctgcttcatgctcagccgcgtcgccgcgtcgggctccaccatgccgccgaatcatgctctgccgcttcgccttgttcacctctctgccgcgccgccacatcgggtttgtctgttccttctctattccgatcctacccccgcttaatcaacggctggattagttttggtactgcgcggtacctgtacctcacggtacaaaacgcaggatggtaacaacactcttttaaaaattaagggagttcttgtttttgtatgttactacagtatatactagtataaaggtaaatgaaaatttctcatcaaaattaagagtggttgcataattttacgaaaaataagaggggttgctgtcaggtgtgatgcttcatcttactgcttggctggatcatcggagaggaatgaatggttccgtgctttctacttctactgaactcgtattgtgtataagtgcatcacgcacgcaagtaagtaaagtacgtacttacacaggaatatgtacgtacgtacgtacggcagatggagaaggatgcatatgcgatcgatgaggttggcgttcgtgttgaaaaaacgtgccaactggttggttgaggaatatcaaaatccttgtccactttgtaagccagggatagtcgtaccgccaaacagaagtatgatggaaaagcaagtaacagaatctaatgacatcaattataatcacgtcaggtatagagcgagcggtagcagatcgagtatccatgacacgatccatcgatctcgcgttggcctggcctgaccgtaatctatggtattttgacatccaatgatcaccaatttgattgttttattattttaaatcttcagtactaatataaagtgattgatgaagaaaacaaatttgatagtcatatatacatgtcgtcggtggctgcagaggcggtgatcgatcaaacgttgcaactggcggaacagatgccgcgcaccttacacgaacgaaaaattggcaaaatgttccgccgtcgctatcgcaaacacaccctcttctctcctggttcgatcgatgaggtgagcgcgcgagatctccggcgtccctttccctccgtcaccatcaaccacggttgcttcgcccagccgcgatgccgcagccgcaggccgtccaaatcatcagcttcacagaccagccagacgagtgtgcagagcgagcgccatgcccgcatatgcacgggacgaacccaagattcacggcatgttaaccatgtcggagaggtggcgctgagccatcaccccttccgtcatgcaatgagtcctcctcaagaaacccaaccgacgatcaatccatcgaggtgtgacgcgccatctcgccgctcggtggcttcttcttcttctaccttctcctccctcttcctggccagccagtgcacgccttctcattcaattccctgctcacctcgatcgagtagctgctgctgctgtgctagcttgctcgccggccggtgaggtcgacgatggagctgcacagatgctctctcctcgctctgctcctcgccgtgacatgctcggttgcaggttaattacttcttcgatcttcttgcccattattcctaattaaattatacttttgctgttgattaatcaatcatgcatgtgtgtgtgcttgcagtggcgtatgatccgctggacccgaaggggaacatcacgataaagtgggacgtgatatcgtggacgcccgacgggtacgtggcgatggtgacgatgagcaactaccagatgtaccggcagatcctggcgcccgggtggacagtggggtggtcgtgggccaagaaggaggtcatctggtccatcgtgggggcccaggccaccgagcagggcgactgctccaagttcaagggcggcatcccccacagctgcaagcgcaccccggccatcgtcgacctcctccccggcgtcccctacaaccagcagatcgccaactgctgcaaggccggcgtcgtctccgcctacggccaggaccccgccggatccgtctccgccttccaggtctccgtcggcctcgccggcaccaccaacaagaccgtcaagctacccaccaacttcaccctcgccggcccgggacccgggtacacgtgtggcccggccaccatcgtcccttccaccgtctacctcaccccggaccggcgccgccgcacccaggcgctcatgacgtggaccgtcacctgcacctactcccagcagctggcgtcgcgctacccgacctgctgcgtctccttctcctccttctacaacagcaccatcgtgccgtgcgccaggtgcgcctgcgggtgcggccacgacggctaccgcggcaacggcggcggcgggaagaacgcccgcgccggcgacggacgcagcagacgcaacagcggcggcggcggagggcacagcggcggcaccgagtgcatcatgggcgactcgaagcgggcgctgtcggcgggggtgaacacgccgcgcaaggacggggcgccgctgctgcagtgcacgtcgcacatgtgcccgatccgcgtgcactggcacgtcaagctcaactacaaggactactggcgcgccaagatcgccatcacaaacttcaactaccgcatgaactacacccagtggacgctcgtcgcccagcaccccaacctcaacaacgtcaccgaggtcttcagcttccagtacaagcccctcctcccctacggcaacatcagtaagctctctaccacaacctcttattcctcctctccgacatcgttctcgctttcatatctatacctgtactaattggacgacaccacggccatggtatattgcagacgacaccggcatgttctacgggctcaagttctacaacgacctgctcatggaggcagggccgttcggcaacgtgcagtcggaggtgctgatgcgaaaggactacaacaccttcaccttcagccagggctgggcgttcccgcgcaagatctacttcaacggcgacgagtgcaagatgccgccgccggactcctacccctacctacccaactccgctccgatcgggccgccgcgttccgtggccgccgccgcctcggcgatcttggtggtgctcctcctggtggcatgatcagaaaaatgtccccttttgctttgtcttcttgataattcccacatgtttggagagcagtgtaggtaggggcattttggtctattcatactggatattcagtcaaagaggaaatctgtgatattgtgttaactttgaaattgcctgatagatctccataatgtacaacacaatcaggctggaagagttttggtcagtccccagttaggccagccctgagaaatcacaccacaaacttttctgcaaattctgttgtgactacaaatatgtatgcaggtattgaccttgaattgagaggaaaaaagaaacaatttccacatttactgaccaactacaaaatgcaatttcttgcaatcagatgagatggcaaacatttctctagacaattaatgttgggacttggggttctcaattagtcttcacacttcagaccaagaatacacaccatcagaatgtacaacccaaactttaatgatttcgaggaacctaaacttacaacctaaatcaaacgcgaattagcttttcatgcaagagcacaccctaaacttccaaaagactcagtatgtcaacagccaatgcccaatgtggtcagcactttccacagtttttgtctaaaactaggtggttgtgcaagaatgctaatgttccacaaaccaggaatgacatgagaaggaatacagtcctaaatctaggagtagaagaggggggtaaccatgggtacagatctggtgaaggcatgacacaactttcgccattgaagtatatgcgccttggaaaagcccaacccttgtcaaaggtgaaggttgaccggtccttccggaatagaagctcggattggacatttccatctggcccagccaccataagcaggtcgttgtagtacttgacaccccacatcattgcagtgtcatctgaagcaaaagattaatcgttagccaaaatatttcacattaaaattgtcaaacttactcagaagttgaagcaaatactcacttattactccataggggttcaaagatttgtagttgaagctgaaaacagtagagacgttttcaaaatttgggtgttgaactactaagttccactgcgagtagttcatccggtaattccaatttgtgattgtgaccttaaccctccaatagtccctgtaattgagcttaacatgccaatgcactcttattgggcacatgtgtggtgtgcattgaactagaggagtcaagctgcccttgccaggtccattcaccacagacgccaaataaggcgaattacccctaccaacgaaaatacatagaagaaatcagaagtgggaaattagtttgttaa

SEQ ID NO: 537 - DNA, 3953 bp, Oryza sativa
gacctaaagttgtggctccggttggatctgtggtgtagcaggcctaatgtgacctggttggcccacggttgatgggcggtgctgcgtactctaacagtattaagatcttcccaagagaattgtgtggtccttattattacctttgatcaattgcaaattaaataaaaattatgaccctaaccgctccctttgttttcaaatgtaagcatttctagtgtttaaattgtgtacacaatgtaagcttctgattccaattcacatgaataaaactttttcaatccatcaggtgctttggaggggaattcgagcaagtcagaatttggctgatgaggtgtcggaaagagaatcttttccttatcctcaatctttttgctgaacaactggagtagtatagagatgtgtatatctaggaatggagggagtatgttttgttgaacgagtgaacgacactttttttcatcaagggtacctagctagctagggaccatgtggttttgtgccaatatgtatgttgatgttgatgagctttatatcacaactcaccaaggccccacgtcgagtagggttcagaggacttacacaacacatatggcaaatggtccttaccccagagaaacgcagaaatgttcaatgtatgcatatatacacacacgcgatcgatcgaattcctgtgtgctgagctgagactgggagaggatatatatacaaaaatacaagtcagtcgtttcctgaagaagaggattacaaaggaggcagatccgtttccagccccccctcccctcccattcagccaataataaatgccctaggtcacttgtagccaatagcgattcaacatacacacatgtactaccacagcttttgccccaacagtagtgtcctttgccttgtattctcctctcctctcctctcctcttggtgatgactgatcgatgaccaccagctgctgcacatatcatcccctttcactccctctccctctctctctctctataagatggcaacaccctgatctctagcttagctgcagaggggagaggaacctcacatccaaactcctagctacaacttgtactagcatcctaagcaaccaagcacaaccaaagcaagcaagcacgaacaattctttcttcctctctacctctagctgctgcctgcctcctaatcctcctacccaccactccacatgagcccatgctgtgtgcctgtgtctgtgtgtgtgttctactcctaccatgagagaagagaccaagcatcaaccaagctagctagctcgtcctctcctcgatctctacttctctctcccacacaagctgagcgcccaggtaggctgcctgctaggtctcgtgcatggccggacacatctgatcatagcccactacggcactattccccccttccgcctcgcacgctgagaggtggccggagagggagggaggccagcgagcagcagtagcagcagcaacgcggctaggagtaaggagtcccatcagtaaagcatgcttcctttcttcgattccccaagccccatggacataccgctttaccaacagcttcagctcacccctccctctccaaagcccgaccaccaccaccaccaccattccaccttcttctactaccaccaccacccacctccctccccttccttcccctccttcccctcccccgccgccgccacgatcgcctcgccgtcgccggccatgcaccccttcatggacttggagttggagccgcatgggcagcagctggcggcggcggaggaggacggggcaggcgggcaaggcgtcgacgccggggtgcccttcggcgtcgacggagcggcggcggccgcggcggcgaggaaggaccggcacagcaagataagcaccgccggcgggatgagggaccggcggatgcggctgtccctcgacgtcgcccgcaagttcttcgcgctccaggacatgctcggcttcgacaaggccagcaagacggtgcaatggctcctcaacatgtccaaggccgccatccgggagatcatgagcgacgacgcctcctccgtctgcgaggaggacggctccagcagcctctccgtcgacggcaagcagcagcagcacagcaacccggcggatcggggcggcggcgccggggaccacaagggcgccgctcacggccacagcgacgggaagaagccggccaagccgagaagggcagcggccaacccgaagccaccgcggcggctggccaatgcgcaccccgtccccgacaaggagtcgcgcgccaaggcgagggagcgggcgcgggagcggaccaaggagaagaaccggatgcggtgggtcaccctcgcctcggcaatcagcgtcgaggcggccaccgcggcggcggccgcgggggaggacaagtcgccgacgagccccagcaacaacctgaaccactcatcgtccaccaatcttgtgagcaccgaattggaggacggctcctcgtcaacgcgccacaacggcgtcggcgtcagcggcggccggatgcaagaaatctcggcggctagcgaggcgagcgacgtgatcatggcgttcgccaacggcggcgcgtacggcgacagcggcagctactacctgcagcagcagcatcagcaggatcagtgggagctcggcggcgtcgtctacgccaattcgcggcactactgctgatgtgatcatccatccacacacgaacgaacgaacgaacggtacggcactaagatcgaactcctgcagctacataattatcctttgcttctcaagagtaataattcttgacgtgttaattaatccgggtgtgtattaattccctctttattattttttctcgcgtttatccggagttgactgtggtgaagacgaactttggtttggtcatcgcatggtgtgcattgcatatatagctagcactatcgtctgatcgatgattcatcatcaatggagtcgtctagtattaatctgtgtgcatgttcagatgctctctgtaaactgataagctggataccttgatcgcgagcaggtagatatgcctctcctgaatgagtgaaaaacagctggtttatagtttgcaaaagttggagacttgttactgtattagatcagatctgaagctaggacactaactttccaatttcaatcataaataagagggagcatatggtggatacgacccagacttgcagtagtgttttagttcatcatcatcagatgttcataaaataattacacttggcatgcatgtaagatgaatttctgtaccaactccagcttaacaattgatgtgcctctggaaaaggtagttgatcatttcattgattggttcacatggtaagttccacgattcagctagttttttctcctgattcctcactaatttcctgatgagtggtggtaaaattacatcgaattttcttcactactgtaagtaagtaagtaagaatgtttgaaagtaagtaagaatgtttgaaagtaaaggtcatggtactcatatatgtacaactcactagatgcatattccataaagtacattatccattatgcatatatgctattccacgcattgatggacacacatcatatagcatctgtttgctgaaaggtaattaaatattaagctagcacaaacacatcaatgttttgatgtttattttgccaacagatcgatgcagaacacttcaaattgatgtaggaagcacaatggaaactaaaatacttcattggtaattaaaagccaaatggacgtgttttgtaagttgtaactatatacacacaagtcttccagccaacttataatgacaactgaagtgtggtatactataaaactgaagtatggaagtactgcccttaattaaaaaaaagaataaagcttaatacaattgctaatatttttttctaagtcctatagggggaggtcgggagctatatatctcatgtatccactccccagaaaaaaaaact

SEQ ID NO: 538 - DNA, 2643 bp, Oryza sativa
aatggggaggcggcgatggaagcgaggagatgggcaggcggcggaggcagcggtggatttttttttctttttctttttcggaccttttcacctgctcggtgattcttcttttttatacatcacgacggcttctcctattcacgacgcctcggctggaccatggaccgttggccactggagcattctaccatggtctagattttttttttcactcaactttactacttcacatctgatggctggtgttgaattcattgtgcatccaacggtcattattaaattgatgacgtggcgcaatgaggtgacgaaacactttactttttttactactttagatctgtcggcaggagtcccagatctgtatactttagctggattagttgggttttggatggagtaactttctgcagactgcaacattctgaatctaactttttgaacgaacaaaattctgaatctaacatattcagagactgacacacgtagcagcacaaaagagatgcgaacaaacttggactgttaacatgtcaacgcataaaactgaaaaaaaaaacctgtcaaaatgcataataaataaaactgaaaaaaaataagaataaatgttgagagtgggatttgaacccacgccctttcggaccagaaccttaatctggcgccttagaccaactcggccatctcaactttttgctctgtcatccaaacaaaattataagaaatcatataataataaccaagacttgatgcctcagtagtttagttaaactaatttgaatttgttagtacagtttgcatttcaaattgttccaatttggacgccacggctggtttcagttgctcacgacgcctcacacacatattttgcttccttgcttgtgacactagggcacaaaactccaacactcaaacgacacttcacgcatctctcctgaaatcttgcaccccccaactctgcatccgtcgcgtataaaatgcagaccaaaccccagctcaactctgcatcatcatcatcagctcgatagaaaaagaaagaaattaaaaagaaaatcacggcgcgtgagcttgcagagacagcaatggtgagagttggtgccgccgcggcggtgctcgtgctggcggcggcggcggcggccatggccgccgagccgcccaccgatgacggcgcggtccgggtggcggcggggctgacgaagtgcgtgtccgggtgcggtagcaaggtgacctcctgcttgctcggctgctacggcggcggcggcggcgccgccgccgccgcgacggcgatgccgttctgcgtcatcggctgcaccagcgacgtcttgtcctgcgccaccggctgctccacctcgctctgattaagtactaatgaagtaattaaccgcgctaattaataataaatcgcacctacgtatgccacatgtggactcgcttgactaattaaatactgccatgcgaatgcgattagtggattatgaaaagaggaaatgtaagaactcatggctctctctgtgccatgcctgtactgcattgaaatgaatctgcatgcagccatgaactgatatacaaatacgaccatgttacctgtaatctctccatcatgtggggctttcatgctttaataacgtgtgatattgatattatgtgattaattgtatgcatcgttggagtttcaactagtctactcttgccctttccctctatttttaaatatataatgttgttggttttcgtataacatttgaccatttctcttattcaaaacttatgcaaatatacacaaatataagtcacgatcaaagtgtctttgatgataaaaacaacaatctataataaaaataaatagtacttaggtagtttttcagaatgagattaataggtaaacgctatatacaaaattcaaccatgtcatatactccctctgttccctgaaaaaaaaaactctctctctttcatattataagtagattttgattttttagttaaacttttttagtttgaccaaggttatcaaaatatattaaatgttcgttttcattaaactaatccgttttttaaacgttgttgaatttttctataaacttggtcaaattttaactagtaaaaagtcaaagagacttataatacgaaacggagggagtatggttgtataatggatgttgttcttaaaaaaaggaaataaataaataaagaaatgcgaattaacaaaaagagaccgccggggtcatcgtttcgctcggcatatttgtaaacgaaaagtaatttgtgaataaaactttatatatgtgtttttagcgatctaaaagcaaaagctgaaaaataaacttccatgaaaacacctcaaaatctgctctaaatttaaagttaaaaattcaaattttggctgataagtataagcgaaaagataaggccacgcatgtcgtagttgacgtaggcccatcctgaagaagcccagtactcctagttgggccttactgggccggttggcgagagaggccgaggagaatgggccctaatgggtttaactccaagaagcaatcgacgcggcgccgccgccgccgccggaggaggagcggagatggggaagaaggggaaggaggcggcgcgggagcggcgggagcagcggcggcgggaggtcacgctcctccgcgc

SEQ ID NO: 539 - DNA, 5948 bp, Oryza sativa
gctagctgtttgtcctttgtttatagtgcacttgactgtctctgatcttttttcttctgcctcttgtctgcacaagatgcagtcgtctgaagctctttgtgaatcctgtggtgcataagtggatgcaaagagccatcagcagacagcaatataatccccagattttgctgttgagaggttggatgcttttcctttctgtatctctctgttgatccggatcctatttgcaatctggattctggcatggcaccatagctacagggattgctaagtagatatgtcagtgtatgtagcctgtagataaaggcataaagctttgctctaatctccctctcaccctctctcttcttcttcctaaaaaactatggttttgctaaaaaacttggcaccacatttttggcttgattagttgatttcaataacctttttccaccatgtgattgctaactatccttttcctttgtatatagtgagtagtaaggaaaaaaactacagtgtaatatttaaaaattacactgtaaatatatgaagtttatagtactataaagtatgaaatttgcaatgtaaaagtgtattgaaaaatgagtatctgttttcttaacgaaaaaatgtagctcgatatagctagtcccaacaattgaactaggccgcgttcggtagcaacggatagataggaaaacttactcctgctgcgcatgcacacttcctaaactattaagcgatacgttattttaaaaaaagttctataaaaaagttgttttaaaaaatcatattaattatttcctttaaattcgagataattaatactcataacttaataatacatttatagctcatcttgttttgtttatcttctcaatttttacagggaaataagagtttagattaaattagaggcccataaccgagcggcccaatcatgccaaactcctgtggtgatgggccgaccgcctgggcctcggcttcttctcggtctcggcgaggaggaatcggctaccactgaccactccatcagtccaccacccaccttccccgaccttatctgcgacgagacgacggcagcgagctccaccaccaccaccaccaccacctcctcctcctcccggcggcgaccgcctcggctgcgcccactccggcggcgcgcggcgacgaatcaccgggccgcactatccggcaaggatggcgcccgccgcctccgcctccgcctccgccgtcgtcacaccgtcctctttcagatgcgtccccacggcgtcgtgcggtttgggggcccggggtaaagcccccgcgccgcgccggcttctccacgaccacgcgcaaggtacggtgcggtgcggtgcggtgctcccttccgcgttgcagcggataatcacagtatagtagtcgtttggtgcgaataggaattacagacatccaaatgtttaggctaacaatggccggccagggtaggtagatgccaatctagtgtcttgttggatgggattaggaattagtgttccagagtctgcaaataacttgcaacgaactgatgtactgcttaatcgaggaattacagcgtcagtaaacaagtaaagctttgctctggctcctttgtcccatctttccaaacatttggtaagcagcaccattctgcagatcctgcatttcgtgctactgcaactcgctaaattactctggcatttatccgtatgggtcttggtgagaatggtggttcagattatttcttaggtttgcatatagaaatacgccatgtttgatggtttaccggctactagctaccagctagataatcatagactgcacagttgtccaagctccacggcaaaataaacttgtggaccttctctttgttgttttgtcatctgcctaacttctctttggttgattttttttttgttcatgacatgttcatgaagtttagctgttatttgctgaactagtacgtacactcttatcgtgtttacgctgcaggtaaaaaacgggctgcggcaacttggtccttgaaggctggtctgtgggactcccttagatccgggtaaaatacattgtgtcccttgcttaaaccctatgtttatattttcacataaatctacatactatagcatgtagtatgtgttaatatgaaaatggtctcgttagaaattcctacctctatgagaagtgaaagctactaatttctcacattacctgcgacaaagggggaactgaaaaactaaaaaatataaagatgtagtaggaccggaacatcctgggtgtttacagactaggcccttacgtttttttgtttggaagttgcaacttccccattttccggtagcacgcttcccgacccaaactgctaaacggtgcttttttttgcaaaagctttttatatagaagttcctaaaaaaaatcaaatcaacccattttcaagtctgtaataattaatactcaattattcatgcgctaatggcttgcctccacagccaacagccgaaaagaactcagccttacagttcaggtcttgtagagaaactagattgataaaatttctatatctttttcttcaattaacaagggagtatgtagactaactatgtgctgtgtacatttgaagcaacatgcttatatcatgctccttagatctgtcatgtatggtaaagagaatctaatgcttttgctttgcagatttttgaagagtaataacagtacagagacagtagagccaccatcagcaccaattgaagaggaagaacctttgcccgaggaactagtactcctagaaaggacacttgctgatggcagcacagagcagatcatattttcttcagctggagatgttaatgtgtatgatctccaagctttatgcgacaaggtgatctttctccaaaatcatttgatagttcttgcagtcaaggttctaaataagtaaccattattcgttcactaacacacctagtaactattgtatggcctaactgggaccacttatgcagtgtaaactggctattatagctgagtacactcgaaaataccaaatagagctaaatgaaatattattaaaatatttgtcaccttgtagtaacacatcctgttttcataaaggaatatatatcacaattttctccaagttcatgttgttcctcggtagtttcttctttaacagatgtttgtgtttatgatgttcatctcataggtgggatggccacgcagacccctaaccaaaatagcagcatccttaagaaacagttacctggttgctacactacattcagttactatgccttcaaaagcaggtgcttacctcgttgtttcattattagcggctcgtttatgatcctaagcgttagtcaaaccacatcttctaatctgaagattatttgcagaaattcatttttctagatgatgaacatcttagtgtacttgtagaagttatttgacagagggagaagagaggaagcaactaattggtatggcgcgagcaacttcagaccatgcctttaatgctaccatttgggatgttctcgttgacccttcatatcaggtgaattgatgaacttgaattcactgttttggcatgtaaggttacttataatggtttatacctgttttaacattttcagggtcaaggtcttggtaaagcgttaatggagaaagtaatccgaactttgctccagagagacatcagcaatattacgctgtttgcagataacaaaggtagaaaaccacaaccaccaccacagtaccacacacacctcccttttttcacaaaagccatgtctaagtagcactgctagctcgaatttacctttggtttgctgttaagtcatctttgtagtgagtagaaaacaagcaaatattttgatcctttgagtactgcaacaactagactggctaccaaaggtaccacatgatttactcttgtggatgaaaacgtaattgaaaaccataaaagatgaatttgtagaaattttatgctattgaaaaggctgttgtcttcgtttcaacctattcctataaggccattacatcattatccaaatctgagtgattgaatggatatatgcctttggtaagtgcacctgcctggctgcctcaaattttactggtgggtgaactggtggcttactttccttgaagtcattaactcaactgtgccatttatctcgatagcacctttctaaaccaaaatgttgaatattcattactacctccgtccagaatataagcatatttagaggtggacacggttattaagaaaataggtagaagtgaatgatggagagttgtgattggttgagtagtggaggtaggtgggaaaagtgaatggtggaggattgtgattggttgggaagagaatgttggtggagaagttgttatattttgggacaaatcttgagagataaaagttgttatattttgggacggagggagtaacataattttcttgctgtggcgagttattgctgcgacttgcagcagggaaatggaaatggtcgttctgttcatgatatccagaatgtgcagcttatcaatgttgcttcaatgcactaaaaaggtcgtctttctgataattcgttcttattaactgcagttgtagatttctacaagaacttgggattcgaagctgaccctcaaggcatcaagggcatgttctggtaccccagattttagtgccagcggcctgacaccttcctgttcatcagtaatgcctggttctcaccgcccagggaccatagttttgtccagttgagtcgagctcagctgtgtaacagcaactctaactgaatggtggtgatatctgcaatatcttgttgtctgcaccacgagccatacaaattcagctgaattttcgagtcaaccttgtactgaaccaaacaaaacacttcttattgtcactagcaaaactgcaaagatccctgaaaaattcacctacagcaacggtcgcgccatggtgcacattgaacacatacacagcggagagataatgtccacaacttttataaggtttttctactgtaacgcacactgctgcgttcttctgtagaatttccactgcaaaagatgtgtgctgcgcgcgtcttctgtttcagtaaacgcgacatcgtccgtggcagcgtgcatgaccgtgggacaaagcacgtcgccgttgcagttttgtttttgtttgtttgtttttgtttttgtttatttttttttgtctttgaagatgaattcgtgcgtggcgaaatggtcgcggcaacggtggcatcggcatcagccgacacacacggctagcgactgcgacgacgacgacgacgacgatgagcatcgatgtatatccaacacgggatagaagcttcgcgtcaacgattcagtaaaacgtgcacgtcgatcgggttgtaatttgggtctatttttcttcgtttgaggctgccgtggctcatggcgtggagatatttctgccacgccattgaatgctgctgttgtatactccatcgatccatcgctcgctccaatatatagtattagcgtcaacggcaagctcagcaactgcagctgctgatgagtgatagctacgaccaacgcgtgcgtcctccataaatttctcaagcagtggacgagcaagtcctctctgtattaaaatataactacttttaagatattttttaaatgaaactagctactccatccgttctaaaatataacaacttctagcccttaagatttgtcccaaaatataataatttcttcaccaatattttcttctcaattaatcacagcccttcaccattcaattttctcacttagctccgcttctcaaccaataacaactttcacctatttaattctaccgactttcttaatacttgtgttcaaccctaaaactacttatattttgggacgaagggagtacctctttgtcgacctcaatctgaaccaattataattttgcccatttaatttcttcatctattttcccacatcaaaca

SEQ ID NO: 540 - DNA, 13688 bp, Oryza sativa
cgctttacacctgcgcacgcaacgagtacgctatctactagtgcctccagacagacacttgccttttcttaattgttctcgagtaggtgcaaaagccgagggttgcacgagtgcacggcatattcccgtctcattgcaacttgatcacgaaacagggcacaacaatcacaggggaattaatggcttaatgctcgctttcctccccctaacctcctttgcctttgcatgcgattgccggaaattaaccgatgcttttgtgcacggccattgtggcgtgtgactagctaggcgctctatgcgttaaacaaacccctgaatatgtaaagcagatacagtatagtcgtatagataggccatggaattaaggtctccgtaattgtttagttgcaaaaggataagcaccaaaccaaactggccacttgcctctgaaaacaaccaattggtggcgcgaagcggcagagccacataaagcgtcaatccagtgatccgtctctttcctgcgtactatatcacatattcgaggctcgaaaccactcacaacgaccctgataaatagtgacatggagtaccgggctactgtactggaattggccttcctcccgtccagggccccacatgtcattgtcacctcctaattaaccccgaaggcaacgcactgtcctagctagacaactcccggctaataacattaatcatcgccagtttgatcttgctagcaggagcagaaagcatggccaaatcaagctacttcattagccacaatataatctgcagggcaagctagctagctaaggcacagctgcaaatgggtgccaatggcctccctgtttccgaacagtgcgtgtggtgcctcaccattaagtccattgccaccacttcaccagcagcgagataatagctagattagatagcaatctggtttgcaggtagcgaccgtgcgttgctgctgcgtcgtccgccaatactacacatacaccatcgccgattcccccggtgtcgctttctcgcgcgcgagcggccaccacacccaccgccaaatcaaacaccggttctttatctataaggacgcacccctctctctctcgcctccacctcctccaattatttctttgttctcctcctcctgattcgtcgtccgtccctaggaagcaaaaggagaaagtttccactctgtctgcgggatatatcatatatatctcaatcgatccgccattggcgatcgacgaagtgatcaggggctagctcctttgcgctgcggctttgaccgcggtgtcgaagcttcttgcacatggccttccagttggacaacgggtactactcccatcaaggtacgcacgcattcccgcttttagttgcctctccgatcgcgatcgctgtttcttcctcgatcctcgcttcttcagttcttcttcttcctatttgattcttcttcccttctttgcttctgtgaacacagtttttgcctgtcgatcgaactgtacgtacgtgagatgcccattagactgttgcggttggtgttagtgctacagttactaaatagtctcccgtgcatgttgtaacaaagcagttgttttccaacctgttcccctgtcgctggtggatgcagctcccccttttgtcgttcttgatcttgatttgacgtgcaccgggatacggccaaattaggggggcggcctgggccgggagacggattgagaggatcggctgatcgatcaggttagggataatgattgctagcacaggctcttctgccgtcgaatgttcgatcggcggagctgggttaatctggaccgggagtgtcgacatgctgccgttctggcgttctctcggtgagtccagcaaaccttcgcactgccagaacattagccaatcaaatcaatgaacaggagaacgaatttgacagatgaacaatatgcttgcaacttcgatgagaaggattaggaaaaatgaaatgtaccaaatacgacaggtgagcaggaaatttgactcgcgatttggcagataagccaaggacaataatagtggaataaccaatgggaagacaaagcttgtttctaatccacgtgaaaccgaaatagccacggaggttggtggggcccgcgcgatcttgtttaacggaagccacactgaccgaggaagggccccgcgggccaggtcgtgggtgccgcaccaggtgcgtgcggtgggggccttgcaggtggaccccacctgacacgtttcgaggctttagcggtccaggttttttttttccatcagtgggccgaagccgcctctggcccactggctagctgctgacatgtagggaggcgtcagcgggccggcccactccccacttggcatctttcgatgtgtactccattttccttttatttttccctacattatatgtgtactgctcctagtacgcatttcctttaacaacgattattataacacaaccaaatctactagaagcagctgtctatatgtatggacggtttaccagtaaacctggcgattgcttgttcttccttgtgcatagatcaaaccggttgcataaacagatagactagtctaacatgtgcagattgacttgcacatctcaagaaaagtatatcttctacgaggcctcaaaaaaagtttaaccaggagtaaaaaccatccataaaaaagtaccactacgtactggatgacttgaagtagtacgtgttagtacaacagtacatggcagttgtggtcttgagattttcatgtttgtacttcaaacttgtatacgtcgcattcgcttctatacgatgctggagtgactggttttatcctccgaaagctcttgaccatggacttgttgtccttatagacttgataggctacactgtcggcttccacagcaacgtttaggtcaagtttgagagcggattctctacttattataaagataaattattactttttaaataggcttagcaaacagtttattaacgagttatctaaataatggaaaggaagaaaatatttttgggaaaacatatgtttaaacgcgtggaacaaacagtctaataaaatagcgaaaataacagtctaaaatcgtgctttactagcatcgtggctcaatgttataccaagtacctatgcacgttttggtccttgaagttttcaattttacctttttttaagataatagactagatatagttaaaacactcaacttccgctattaaagtgtttaaaaattcaaggacgtttcgctcttaataccaaatcaaaatttgataagtcttaacaaaaatataaaattttggtagtatctattatacataccctccgatccattgttgggtctaactttcatacaagaagtactagaagagtttaactagaataaccttttcgatagatgtatttattttgaaatacgagggtgtagaagcgaacaaattcaagggattaatatcaccaacaatcatcctattttattcccaaaattgatttcgagagatttcagtgaaaaaatccgatccaacagatccaaaaagcactgcagtagttttggattttctatccccatatatcttgctatgtggatttaaaggtaagagagcaactccccatctctagttggtgtgtttctctctccttccccatggattttgagggtgagagagcgactctcaatctctggtacgtgtgcgagcgctgaaaatttatgttgggagcatgctgggtgtggaatgaaaaaaacagaaatttctattggtagtttaacaaaagatccacttttaattttgggattaaatttaggctatctttgagctttttcactccctatttagtttaggaaactaaaaaaatcaaattttgggtatagattatcgctaatgtgctggtgctcttagaaatctatttaggaaagcaattaagattataaaacggatgtttctccttatcaattaccattcggtttttcagactccttaaaatacggaggaaaacagggagaagattgacacgaaaataaagcagaaaggataaaagtgtctccacacgcagcccacgagtgcacgaccgacctcgcccaaaaccgctctcccgtcaccctcgtcctcaccccggttcgctcgcccctcgcctcccctacccctagtccccttcgccgcgcacgcgcacccgcacccgcaccgagccctcgacccccctccgcagccgccgcctccttcctcggctccgctaccgctaggcgctcgcccgccgccgccgcccgtcttcctccatcggcccggcgcgccgcgtcgtgcccgcgctcgtccgcaccggctcttgcgccggcgccggcgccgacgaagggggagagtcaccggttccagcgctctaatcgttcccctacccagcaatccctgtcgggccatccgtctcgatttgtaaggtaggtgccccgaggtaggtgccccgcgtgagtgagacgtgttagtgttggggttgatctgcaatatcctgtaatttgtttgttggttgatgcgatgttgttatatgctattgctacctgatttcctttgtttgttggttgatgcgatgttgttctatgctattgctacctgatttacctcgatgtttacaatgcagattgttatacacgatctgtagtatttatttggaaaagaacctaatcaatgcaatccttccgatatatacctaatccttcgttaaacatagtatttatttggaaaagaacctaatcaatgcaatccttctgatatatacctaatccttcgttaaacatagtatttaggatgcaaagatgatgctggataagcaaccatatatgcaatccatccgatatatacttcgttaaacatagtatttaggatgcaaagaaagatgatgctggataagcaaccatatatgcaatccatccgatatatataaacatagtacttaagttaaagatgcaagatacaagatgatgctggcgtggtctgaaaatggaaaacctaatactttgtataaacatagtacttacatgcaagatgatgctggcgtggtctgaaagtggaaaacctaatactttgtataaacatagtacttacaggcaagatgatgctggcgtggtctgaaagtggaaaacctaatgagtacttaagatgcaagatgatgctgcacccatttatttttcttttcttttgcatttccctattatttacttttcttcctcagcaaaattacttccactacattgctcatcaaacttccatttcatttccaagttcccatctctcccatttcccaaaattactcccacttgatcacgcatgtcatatttgtttgtggctttctaacattgtcaagggatttccaagttcccatctctcccatttccctattatttacttttcttctttagcaaaattactcccacttgatcatgcatgtcatatttgtgtggctttctaacattgtcaagggaattaggatgatgtgacttgtttaattaccttgtcgaatttcgtcctattcagtattcacaatgattctcgctcactttctctgactttttagcatgctgacctgagtattgactactgtcgatcactgcatctcatgtggaaaaagaaaaaagtttatcttgttgcttgtaactcctctttttcttttaatgcatgaatctgggagcagctgcactttgtaaagatactttgaatttttgggggtatttggggacataacaaagatagtatcattaatatggtggcaaagactatgtaatattatgtgctgtaccgccgttgcctgaaagattataaaccatgttgtaattcaggtcattcaatgtggcagatgtagtatcttcgattgtatggcaatgatggatttccctctttctatttattatagtatttgcctggtcattctactttcttatctgttttgcacttgattttgtgccttgggcctccatcactctttagatttgtattagcctatgataataataatactaaagctataactgcaccttgcattgcagctttagccatgatgagaaagaaaaaaactgaaccccgtaatgctggggaaagttctggaactcaacaagccactggagctcctggacggggtccttcacagcgacctgagagagctcaacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactggcccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtaagatcttgtttatgtgttgccttgttatacttatacatatgaagctttgtaacttttgttgtttttcatgagctttcatttaacatgctttcaggtgtctataactcctgaggttccttcacgtggtgtcaatcgtgctgtcattggagaaattgtaacacaatataggcagtctcatttgggtggccgtcttccagtctatgatggaaggaagagcttatacacagctggtccattaccatttacttctaggacctttgacgttattctgcaggatgaggaagagagccttgctgttgggcaaggtgcacagaggtactctctggacatatcaacattcaacaatttgataaattcatcttccaatgattcatctgcttgtcttcaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtaaatttaccctgccatttgttgctatatcattatcatgttagcaagcttttgaacatttctatattttttatatgtaggtactctccagttgcaaggtcattttattcgcctaacttaggaaggcgccaacaacttggcgagggcctggaaagttggcgtggtttttaccaaagcatacgacccacgcagatgggactttctctgaatattggtcagattccaagtcctcgttttcatgttccatgttactactcgaagaaaaataataattccttataatttagaatagctacttttttttgccccctttagactaacctgtaggtctgtgttctcattgaatgatctatttgactgactattgataaatatcatttgtgttttggaaacaataacttaggagatttctatgatacatggaactcttaactgctaattcttttttaatatttcatttcctagtatttttcctacttacaccactttctgttgtaggctgatagtaagaaagtttatctaagctgcataaattacatgcacatctgtggaagttatctacataaattacaaatttcgattaattgagcttgttggttgcaaagcaaattatcataatctaatgttatggtacaatagcagccaatattaggaatcacttgtattgggaaaccttgaatcttagatgttgtattcaatatttatctgtcactggttatggttgataatcatctagaatgtgtgtacattgtcatatattggtaaagatcatcaaaccacgtctcttttctcttgcatctggggggtaacctgatattttgtcctgcagatatgtcatcgacagcattcattgagcctctacctgtgattgactttgttgcacagcttttgaacagagacatctcagttagaccattatctgatgctgatcgtgtgaaggttaggttatcctattgactactttatttgtatatttgtgttctctgtgtttgctttacatgcttccttactgtcccattggtcagatcaagaaggccctaaggggtgtaaaggttgaggtcacacatagaggcaatatgcgcaggaagtatcgcatttctggccttacctcgcaagcaacacgagagttgtcgtacgtagtctgctttgctcatatctgaagcctctctatcatgtggttgcagatgtgtgtctgattggataatttgctgatttcacttgcttggtttgtcctgtatagttttcccattgataatcatggtactgtgaagacggtggtgcaatacttccaggagacatatggatttaacattaagcacacaactttgccttgcttgcaagtgggcaatcaacaaaggccaaattatctaccaatggaggttagtgtcctaaaatgccatctttatgaagtatgaaacctccttttgttcaacacccattaaggtcagaaatgctataggcacctttatgatatcagaaaagtgtttcatatcactcttaactttcaggtctgtaagattgtggagggacagcgttactcaaaaagactaaatgagaagcagataactgctcttcttaaagtgacctgccagcgccctcaagagcgtgagctggacattttgcaggtaattatgggtgcattttgttggcagattacttccaactgccctataacattgttgtactataaaactgtgctatttcattgtttcatgccttggtgatctatttctttattaagccatatgcattttaggccatgcatataagttcttccaatatcatgtaaaatttttatctactctttttggactgagtatttgagtatgtataaacacttgttattgtatctagagtttgtattgccttatgtattggcaagccctttatttgtaaaggttttgtggtttccttatttcaattttttgtgggtctgaactctaaaacaagtttttttagttcttactcaaatatccaatgctttgctattgtacccacagttgagtcctcgttatattttaattttggatttaaactgtttctatatgtttttacatattaaggtggtttgattcatgtcaattgttatgccaaaacacatttcaaatgtagctcaccatctatttgtgttacttggatatataaccattaatcgggttccctattggaacatcagaatcggcttctaagttttataattttattgttttgtctttgatgaccagactgtgcatcacaatgcataccatcaggatccatatgcacaggagtttggcataaggatcgatgagcgacttgcatctgttgaagctcgtgttctaccacccccctgggtaagatcaaagttcaagacatggctgacatttgtcaatatctcatgccttttgtatgttatgcctcaatatttgactaatattctttgcagcttaagtaccacgatagtggcagagagaaggatgtcttgccaagaattggccaatggaatatgatgaataaggtatggttttagaagtgagttattagaaaacaaacctatacgaagcatcccctaaaaacagtattaggctatcctttttttcttttccaacaaaaaaattggttttcttctgttcttcaataactgttgctttgccgtctttcaagatgtctcccaactataattgcgtacagttgcgacaattagttttctttaatgtgcttgttgcagaaaatggtcaatggtggtagagttaacaactggacatgcatcaatttttctcgtcatgtccaagataatgctgctaggagtttctgtcgcgagcttgctattatgtgccaaatatctgggatggtaagtttttcttccatctaatggtgcctccagacatctctttcagtgttgctatttgactctgtatattcttggaccataacatcctttcacatgcttcatatcctctcgttgtaggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggtatgcctttttatttcaaaacaacacttgattgttatctgataaaaaagtctttattaatatgcttgtcaatcctcaggcgatctcaaaaggatatgtgagactgatcttggattggtctcgcaatgctgtcttacgaagcatgtttttaagatgagcaaacagtatttagcaaacgttgcccttaaaatcaatgttaaggttcggaaatgttctaccaattatttttgcccgattttgtagttttttacctttattttgtagtaatttatattcctttaatttataggtgggaggaagaaatacagtacttgttgatgctttgacaaggaggattccccttgtgagtgataggccaacgatcatttttggtgctgatgttacacatccccatcctggagaagattctagcccttccattgcagctgtaagtgcatagcttttcaatgttacgcataccgtctctttattatcatatgatagaacaatgaccttttttatgtcttgcgttgccttctgattgtttttggtgatttcatgcttcatgcaggttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcaggtatatatgtcctagttcgcattgaacctgaatatttcttggtagtagtacatatataaattctattagttaaatatgcagagagcttctcatttctttcaagagggcaactggacagaaaccccagaggattatattttacaggtaattttcttcatttgtgcacaactgcatattcagttggtactgtttttccacatatttaacatctctcatttcagggatggtgtcagtgaaggacagttttatcaggttctgttttatgagcttgatgccattagaaaggtgattttaatttatctacttttcttctcaccatgaagttatctctctagtccccgactaacagttcaataaaaactaggcatgtgcatctttggaagccgattatcagccacccgttacctttgtggtggtccagaagcgtcatcacacaaggctgtttgctaataaccacaaggaccagcgcactgttgacagaagtggaaatatactaccaggtaatttgtcgccttcctgtaattttagttattttgtatatcttgttaaccctatgattgacacctcatttctttacctgaatttaatttctttatgttcatctgatttcaggcaccgtggttgattcaaagatatgccatcctactgagtttgatttctacctgtgtagccatgcgggcattcaggtcagcttttctgcacttacaaatattacttctccgcaacaaaaaaaacattcttttacaagatgaaatggacttgattttactttatgctatttttagggaacaagtcgccctgcacattatcatgttctgtgggatgagaacaagttcactgctgatggtttgcaaactctgacaaacaacttgtgctacacgtaattttctttcatgtcattatatattgctatttaggagtacattattacaagactagtaagctaaccattgtccctgtaaccctattattgcagctatgcaaggtgcacccgttccgtatcaatcggtaagcagatgactcctctatttaacctgattagaaaacgttaaccccttggtccctcggtgtggctacatattcttacaatggatttgatttctgcagttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgtaaggccgcttcctgatctgaaggaaaatgtcaaacgtgtcatgttctactgctaagtttgggaatatttgtgtatgggggaaaacgtctgacggtttgagtcgccccctgttatctaagacggaacgacctatagtgtgtgtacgttaatgattgtggtgctgtgaactatcgaccatgatctggttgtttatctattatcaacactagaagttgaggattctagactctttcagtgtggctactcaaatcatatcgtcgaagaaatgtaataattgacaattacattgctgccatgtttccaggacaagctgatctcagctactgcggttcctttccacttgttggatgcgcaccttgattcgcaaggattattagccttttgtctcggacaaaattattgcttagttggctcctggtacatagaatctagatttgcattaagcagtttagcccacttttgctcaaataatgtcaaggttgaaatagttgtttgatggtagacagctctaagtatgattgctttcatttttattctttttttccaaagacatacattccaaatagtttgtctgagcatgcagagcaactatcctatacagtgccacaggacattttcctagtcaacatgtaatagttctgtacctgagcgctctacactagctatgttgctttgctacatctacctacacggcaaaggcatggtatattctactaatttattccagccgctcgtccagacagacccctacctggtacaaacccaacacctgctttgcacccacggctggaattgtttctgaagttttcatgagcataacaccaaaacggcctacagaagaagccacagcgatcacacagctcccttctcctgcactatgatttgcttactggaaagctatatgttaaccagcatatattcacacattggattctcccggccatatggccctcagaaactagaacacgcccgtgaccgtgggcgatatattatagtagtatagatgcgcaattatcagccggtggctataggcgaaggatctcgccgtgcatccaggccaaggcacgctgcgacaacgctacaaacaaaacaggcgccacatcagcagcagtgcagatgtgtgtgtgcagagttgttaacctggcacaagctaatgacaagtgttaggtgagcaaaagctttctacaggttcatgcagttagtaaaaaggaagtttagcaacagcttaatttgttcccggcagttgggctgggcaatgtaattataatttggttctgtagctctgagagcttccagaacactaacacagaattgcaatcaccataattattgtatagtacattgcgtactgcttctagtacaaaaggtacagcatatccatcattttcctgaagat

SEQ ID NO: 541 - DNA, 17078 bp, Oryza sativa
cggcgacgttaaaccctttcggataatcaatagtggttgtttagacgaggtagatgccaccttagatgatatgcactctagccttgtttctttaataggattaattataaaaattaacacatcatatacttatactttgatagcctatatatacaatagttttatataaatatattatatcattaatatttggctcatctcttatacacacacaacatattgaagcatgtactacaattaactataaatatgtaatagtttgtttttctctctcatttctatatgtgtttgcaggggcggatttatagtgtaacggtcggtgtcagacgacaccgatgattttgggtaaaacctatagtttaactgcttatccatatattataacatcatgaatctaatgataattagtatactatgacatcagtagatatattatgacaccaacgaattattttttctagatctgccactgtgtgtttgtagctacctataacatgttattattgcacttgctctaacttctttcggcatttcaatacatgcataaccagttttgtatagcaaccacgtttttgtttaatcgtccaatcatggacaccatcggcaggagggggatgacccactgctagcgcctcaccaagctatcatacacaacacacacaacaatgaacgaatcatcgaaagcagaagacaagaatacatggcaccattggcacgtattaatcgtgcccgtaccaccatctatcgccacatctcaccggctgcaataattgggcatatcttggcgcacgcatcagcaatatctttcgattacgtgaccagtcccacccaccacctctctctctctctctctctctctctctctccggctcttctcccagttgcttcgcttgccgttgctgcggtgtgcagtggtaacatccagcagctactagctgttgctggcttgcaactactacccgttaagaccacgcgcgcctcagctctctcacacctcccatcacgctactgctcccgcccccatctctcacccttcttcccctagctaccccctgctcacggagaaagacaacccagtcgggtcggtaattccgctccatttccagcgcgcgccgcatgaacgatcggtgatctcgacatggcgctgcagttggagaatggccgtccccatcatcatcaaggtatgcctgcccatgccgtcgcccccccacctccctcggctctctcccgttttcggcaaccctttgccttttgaggcgattctatcgttttcttcccctttttttcctcccctcttcgtcctgtcccatcagatcgtatacagttggcgtcgaggccgcgtccacacacgacgcgtcagtgcttgcgcgcgtgagggcgtgacacgggttttaactgttggtgcctgcgataattgttcgacgcctgtgtgcttctgggtgagttttctcgtcgaccctgtgtttggctgtcaccatgcggccccgggcctgagtgtttagctgacagagtgacagcctacaggggtttagccttggcccctcgagatcttttttcaggttaggttagtttgccatgctgcctctgttaaatagagtcagctcgttacccagcaaggattagatcatcagctctttgccaaacgccccaaaccgctacaacctgtaaacatacaggcctacattgatcagtcagtctggagccacggcacgagcgaagccgatcgcacagtgctccactgcgcgcccatgactgacgccgctggtgctatagctacatggcatgttggcatttgatccttgctgccgttgatttcactccgttgattttactcctcctgagcaagcggccgatcagaatcatggaggaaaacaggagcagccatggcggggcatcgcacgacggctagctaaagtttatggcgcggtgggggccataggaatttgtggaagcaaaaacccatgtgcggggtgcggcggcctccacagcattatggacgaggacgacgacgatatggatgaggaggcagcactgccacagcacggcgcggtgcgtgcgccacagtgcggtgagctcgctcgctgtgcacgcctccctcctccgccatatccaccaccagtcagtcgcctcgtggaggcgtggatcccggcgcctccccccctcgtgtagtgggacacgtttcgagccaccagcggcccgacacacgtcgtaggcccgtgggagccgcgcgacgcgtggtggtggtggtgggaggcggccctcttctctcttggcccgcgctgcagattcacgggcgcttgcactctcggcctgcggggcgtgggggttacgggcccgcgcgtcaggggcgcgggacggcggcgttggctcggctcgctggctggacctcccctgggcgcatgtgcgcgttcgcgaacggtcacgtcgcgcgaccgtgggtgggtccgtccgtccggtatggagaccgagcgggtccctctatagttctgatcatctcagggggaaaaagaacgttttcttcccttgcagtcgcattttcaacgcatgattttctttacggctgaaatggattctgtaaattaaatcatgtggaattctggctgtggtttaggacattaggagatgagtaaactgacttaaaaaggaagcattagtcactgtagttactaccccttgacagatttagaggaaaaatgtcgataggaaatgaaaagttgatactccgtttgaaaaaagtcgatagaaaatgaaaagcattagtcactgtagaccaaataacacttggtctgttcggtgtagctaaactgcagctgcacaacagtagccactaccgtgcatgataaagaaaaatcgatacactggctgtacaacgcaaccggttacagctgcatagcaatgttgccgaatagggccacttatgattgaaggaaaagtacatataatttagcttagagccttagggtgtgttcgctaggagatgtcattaaccaggaacagtagcacgcaaaacatagcggtctattagcgcgtgattaattaagtattagctttttttttaaaatggattattttgactttttaagcaactttcgtatagaaactttttgcaaaagacgtaccgtttagcagtttaaaaagcgtgcacgcggaaaacgagggacagggtttgggaagaggaatacaattgtaaaacagaggattgcaaaacacaggaatggccgtttgattggaccacaggaaaaacgcaggaatcagatgagagagatagactcagaggaaatgttcaaagaggttagacctcttgctaactttcctccaaaatgtgcataggattacccattccataggaattttaaaggattggataggattcaatcctttgtctcaaaggccttcataggatttttttccataggattgaaatcctccaaaattcctatatttttcctacaaatcaaaggggccctaaagtttttcaaatcctatgaaattcctatggaatgtcacattgcatgtgtattttggagaaaatttagcaagagctctaacctcttggaaaatttcctttgagtctatctctctcatccgattcctgcgctccaattaaacgaccattcctgtgtttttcctatgttttgcaatcctctgttttacactttaatccctttcagaatcctgtgttttttctattcctccgttttttctaccctgctattcaaagggacccttaatccttttgaatcaaatgaccaaataggaaaattttctataggatttaaatcctatgaaattcttatataaatcatttgattcaaaggaacccttagaccatggggttgaaagtgttaaggtcgagcttagttcctaatattttcttcaaactttcaacttttctatcacatcaaaacttttctacacatacaaactttttcgtcacatcattccaatttcaatcaaagttttatttttggcgtgaactaaacacaccctaataaacacaccctaagtcctgccattgtaggagcacgaaacacacatttgagttggactttatgtaaccgtaatcaatgcaacggatgtgagagcgcatgtatattacctatgcgtacgtgactccttgtttttttttttttgcagggagagtatgtgaggccgagtttagttttaaactttttcttcaaacttccaacttttccatcacatcaaaattttcctacacataaactttcaacttttccgtcacatcgtttcaatttcaatcaaactttcaattttagcgtgtactaaacacaccctgagtcctttgcattgaccttatagtacgtcttttctttgttgctctgcatattcttttctaaaatttctattagttgcagttgtactccttccatccaaaaaaaatacagttgtataaaaaatgtcccatctactagattaagtttttttaaggacggagagaactgagggagtatgttactagtatgtaaagtaatttgcaaatgccccaaagtattaaggtgttcatggtacgatgcatgaatccacgaccgcgttattgagtgatccacgaatcaacatcttctttttcctagtaaaacattttaatgtacggagtagttacattgattttttttttgggatgtttttctttctacatatagttagacatgatcttttgcctcttgtcgctctgtgttggcttattagctgtaaccaacatttgaatcctaagaattaaaattgattttgaaattgaggcttttgcactatagtctatcttttagctttggcttaaaagacacaaataatacgtacataaaaaaattactcataaatcatacattttactatctattacccccgctttatttctcattgggatagcaaggtacctctacgtgtcctttttttttccctagcagaatgatccagtatttccggactgtgtagtccatcctagcgactgaactattctgcgcatcgctatcctaccaaaagcttctagggtggagtagaacgcttccatcaaacaaaattctatagtacttcatctgtctcaaaataaatgcagcgtcttatttaaaaaagattatgattagtatttttattgttattagatgataaaacatgaatagtactttatgtgtgactaaattttttaatattttttataaattttttaaataagacggatagtcaaaacgctaaacacgaatatctatggcttcacttattttgggacgaggtactactactcctatataagcactggctactttattaatttatcaatgtagcaggagcacaaaaggaggagcatcatacagttggctcgtagtgtacacctccaatactgcctgcagctctgcagctgcattgctgcaagcgagagcgatagccggtatagctgcatcgatggccgaaggggcttttgcctttgtgaaggccggggcgattctagtcggggggaaaaggcccgaggcagcccagcgaccgacctggcgctacgatgcgcgaaaaagggcccccacacccacacacctgcctcgtgggccccacgggccgcaggcctcggtccgcgggcccagcagagcgactcctggctgcgttctcggtacggccctacaggtgggcccctcgcgtctgttcagtgtcctgtatacacagggcaaaacatccggtcacggccgtgcgggcgtggtgtgtgactgagcggtgggccggaggatattgggaggcccagatgtcattcggtgagagcgggggagaagggtgaggccgtgggtgctgggcccacgcactggcgcgtgcgccccataagcggaaccaatctgaaccatcgattccggtagggtgtgtcgctgtgctgccgttggtgcaattgcgagtgctgcacgctgcgtcaccgctgtgacctgtttgctgcatcgagcggcgcccattgacccgtttccctatcctttttacgggtcggagtggcctaaccaaaacgggacggcctcgacagcgacagcgacggcgacccacccgccgtcctcatccgtttgcgccattatttcgtccacctgcacggcttcaccgctttgtagctgtagtagcagtagcacaagggcagccatttccccagccatgttcagccagcccagctcttggattttgatgacggcattggattaggcacgtactaggagtgctgatctgcatggttccggttgatcgcgtggtgcgtacgggacacaaggcgatactgatccaattcacacacacgagagagagagaggaaaaaaaaaaagaaaggcaagagtgatccaatcagcagccgaaacgtccctgggccctgggggaatggggagcaacggagcgcgaggcgcagttaccaaacactctgacatcccgggcccggccgtccgatccttaatggtcgattagtcgccatcttgaacccacccgggccatcagcgacgacgcccgtatccccgcacgggccccacgccgtcatcgacacagccgcgtgccctctcgttccgtacagccactgacgggtccggcgcgacccgacccgcgccccgcgacctgacacgagcgcacccgtccttcctctcctctgcactggcgctcgcttcggctgtttccccagcgtgtgcctcaccgctgctgctaattaaccgcaagcgctcgtcgtctttccccttcctcaaaaaagggggagggggggtggtggaggcggaggcggaggcagcagcagcagtgcggtagtgcaagcgctagtggaggagttgggaggaggccccctagggtttcccgagaccgcctccccccgcgcctgcgccgccgctcgccgagcgcgcgctccggtaatgcctcccgctctctagatctgtgtgtgtctccccccgtctgtcttcgctgattctgccgcgggggcgtgcggccgataagttcgatcggttcaggggagggtccggctctggcatcgccgcgtggttatggtgatggtacggccatgagagagcgcgggttggtttggacggggtttgtcggtggatttgggcggatctagttctcggcgagctgatccgatagggggctttggcgattcgctcgtgttctgtgtgatcgcgtttggatttttggatttagtactaatggtgcgtgcgatacgagttggtgcatcgcatgagaaaactcttttcctttgtgtggtttgaagtgtgtacatttgggcgaaaatattttctgaacatgtttttcccccttctgctgctatagcgtgtgattgcgtgatgacatcacgctaaggtacggtgaaagtttcgttcactctgtttctgtgactgatttaagtttggaagggttgctgcttttcctgtcgtccagcaactaaacgaatgcctgatggtttttcaaatgcatcatggagccaggagtggaattggatccgcactcaagaatgtggttgagttctagcttctttacctacgttcgagctaaatgttcccacttagcttgaactcagcaccttcattggtagctaggaacatatattgacttttgcaaaataaattagtgggattttgatcattacgaaatattgacttttgcaaaataaagtagcgggattttgatcatcatgtgctgtatatgtagtgttccgttttcaagttcttcatatttgtttttgattctatgtagcactgtagcagagtttttttgttgtgctccatacctttctttaggaagcttctgatcttgcgtattgacatgcttttccattttcacctcttcagccatgttaccgagtaatatgtctgctggaagtagttcaattgctcacatgatattctggtgcgggttgcacgtgacctgctcacatacttcaattgctggaagtagtacatgcattttcagtgtctataaccttttctgctcgccacaagggattattgattaattctgtttactgcccattggctcatgctctttaggctatcacatgcaaatgaatgacatataatcatttgtattagctatggaaatgagccagccatcccttatacatgctatgcttttatgttttcattgattgttgattccttccgtttgatcgtgatcatataccatatggtgcttgcgtattagcagttcatgtcttacatttaggttgtctcgcaaatgcataaaatgcttttaggccactacaggaaaatgaaagccaccgtttggaaaatagtcaaatacactttagttctttcataaatgttgcttactgatgtgcttatcaatccttttcttaaacattgtttactaatttacagttgattgccgacatgtgcaaacactttcactttttattagccgtgtcgcagactcgcagtgacttagtttatttcttattgcagaaattctgtgtactctattactcttaccataggttcatgctccactaaaactaccttgatggaacttattacattttctatttacattgaaactcttcctaattttgtgtgcgcgggtgtgaacgtgaagtcctgagcaggtatttttatgctatgctagtcactgtgtgtgtgcgcgtgtgttgcgggctctgttactgttaaccatacataggattattctccattgaaactaccttgatgcaacttattaaaattccaatttacattgaaacactctgttttcctaattctgtatgtggtgatgtgaagtgctgaggagttagttattcaaatttcattgtacattgaaacattgtgtttgtcctaattttatctgcgcagatgtgaagttctgagcagttagccatcttttattttttttaaaaaaaattctctgtggttcttttgcctgtttgtttttacactctgctaacctctgtctgtctgtctgtgttgtatccctccaaatcgtgtctcctctttgcgcaccatttcttcaaatgatttggattggactaattgtttcaattgtgtcattgtttagtaagtttttcttgctactgctgatgatgatggaggttaaaagtaacattatcacttccacaatgagttaaggatgttagaatctactgtaggtcctgcaattctgtggatggattggcctagttttcagtgtggaacaatcccattccttttttttcccttattcagaatattcattttccatttttcttatcaagttttgatagatgtgatttgtggtcttacagttctgtgttcctttctttccagtgcccatcatggtgaagaagaaaagaactgggtctggcagcaccggtgagagttctggagaggctccaggagctcctggccatggttcttcacagcgagctgagagaggtcctcaacagcatgggggaggacgtggttgggtgcctcaacatggtggccgtggtggtgggcaataccagggccgtggtggacattatcagggccgtggagggcaaggttcacaccatccaggtggagggcctcctgagtatcagggtcgtggagggccaggttcacatcatccaggtggtgggcctcctgactatcagggccgtggaggatcaggttcacatcacccaggtggtgggcctcccgagtatcaaccgcgtgactatcaaggacgtggtggtccacgccccagaggtggaatgccacagccatactatggcggacctagggggagtggcggacgtagtgttccttcaggttcatcaagaacagttcccgagctgcaccaagccccacatgtccaataccaagccccgatggtttcaccaaccccatcgggagctggctcatcctctcagcctgcggcggaggtgagcagtggacaagtccaacaacagtttcagcaacttgccacccgtgatcaaagttcgaccagccaagccattcaaatagcaccaccgtcaagcaaatcagttagattcccgttgcgccctggcaagggtacatatggggacaggtgcattgtgaaggcgaaccatttctttgctgaacttcctgataaagaccttcaccaatacgacgtaaggcttttgtaagtcctatttccttgctgtagctttcattttgtgattttgatcacctatcttgttccttcaggtatctattactcctgaggttacttcacgtggcgtgaatcgtgctgttatgtttgagttagtaacgctgtatagatattcccatttgggcgggcgtctacctgcctatgatggaaggaagagtctttacacagctggaccattgccatttgcttctaggacatttgaaattactcttcaagatgaggaagatagtcttggtggtggccaaggcacccaaaggtatgctattgctattttatctttagttaaatatctattaaaaacttgttactgacattccttctattttaaggcgtgagagactatttagggtggtgatcaagtttgctgcccgtgctgatcttcaccatttggctatgtttctagctggaaggcaagcagatgctcctcaagaagcccttcaagtccttgacattgtgttacgtgaattgcctaccacaaggtaatatctgatctagccatctattgtttattgattttcttgtgacaatggctttatttccttttttttttaggtactcaccagttggtcggtcattttattctcccaatttagggagacgccagcaacttggtgagggtttggaaagttggcgtggtttttaccaaagcataaggcctacccagatgggtctctcactgaatattggttagatactgttgcacttctcctgatttgtcattgtgtatctagatgcaaaaaacatttttttggtataatcagattcaccattggtgtcatctggcgtactgaaattgcttatttgttgtttcagatatgtcatcaactgcatttattgagcctctacctgtgattgactttgttgctcagcttctgaacagagacatctcagttagaccattatctgattctgatcgtgtgaaggtttggttatattacctcaccacctttgttgacaatacctccgtatgtgcttaagaaaatgttttttttaaccgtcattgtcctttttctcacagataaagaaagctctaagaggtgtgaaggttgaggtgacgcatagaggaaacatgcgtagaaaatatcgtatatctggactcacttcacaggcaacaagggagttatcgtatgcacttcttccctagcttatatgagaatctattgcactcctgcagatgggtatttgaaaggattgtgcactgatatgatttggtccgttctcctgtgatagattccctgtcgatgatcgtggtactgtgaagactgtggtgcaatattttctggagacatatggttttagtattcagcacaccactttgccttgccttcaagtgggcaatcagcaaaggcccaattatctgcctatggaggtcagtatgtttgctgtgctcaattatagtgatgtatcatgctgtttttgtacgaaaatattttccaaatgctaaatccagcttcagcatgttatcaagtatttaccttgcctttggaattgagttcaggtttgtaagatcgttgagggacagcgttactcgaagcggcttaacgagaaacagattactgcgctattgaaagtgacttgccagcgacctcaagagcgtgaactggatattttgcgggtaactgttgatcatattttgtgatgacatttgttttgatagtgctgtattatcggccccatcttttcacttataaatgcacttatctgaaccacttactactaactaaaaaataatttatgggtaaaacttgtatatatgtgttcttagcaattcaaacgcaaatgttgtaaaataaacttcgatgagaaagccacaaaatcaactccaaaattaagctttaaaattcaaattttggtttataagcataagcataagcgaaacgatggggctgataatctgatgaatccatgagttgtatgtttcatgtccattagcatgctgctgtagttaaaacttctaggatgatctttagccttttgatttctgctctctgtactttcacatttactttgtgtgtttgaagaggaaaatccttggttgtaggcgatctctaagacgcttaattatgttggtttctttctttctttcttcttttttttttaaaaaaaaatattttggctgttgctagacttctgatgttacaacacaaagtcgtccttttttgtatattttgtcgatctaccagaatagtgttatatgttatggttatgtactatgaaaaaacataaatatggtattgcttttggttgtatttattttctccaagattaaaacagctatattgaggggttgattctcatgcattttgccacctcttttgttccagctatttgtgagtgtagtggaatctgtcatgaatgtataagagaatatggcaaacttccgatggagcagtttttgtttattttaattatctacccttcactgagatactgagttcagggatctaaatctttgtttttccttgttttgatcagactgtatctcacaatgcataccatgaagatcagtatgcgcaggaatttggcataaaaattgatgagcgtcttgcatctgttgaagctcgtgttctgcctcccccaagggtaaatcaattttcagatgtggtttgacagactcacagcagttgatttccatattgggcattcgatattcacatctattgattgcttttctatctctttattagcttaaataccatgatagtgggagagaaaaggatgtattgccgagagttggccagtggaacatgatgaataaggtacacctttcaaaaggagaatcattatgaaatgtctcttcctcttaattcctttgggcatatcctatgttcatcttttatattaagaagggtgaactgtaccaaaacagagtcaatattgtacgtaggtatgtgcaaaataaagaacccaatgtttaatgtatcattaaccagtggttttaaaataactgcgagggcgcgatatatggtctagtttttaagctgtacttctgttcatcacatgatcagtacagtaataaaactaatatttatacggtgtacaaacgtcattctcatgatagaatttcattactgttatgaagctccattctcatgtcatgtgtcctacgtacagaaactgttttggagggatttggagtatttaatttgaggatcctttataaaccacagagttctctggcacttccctccaactttcctttgcttctactcccatcttcactgtggtagccataggaccaatattgtcattttggttaggttactaatcttgatataatctttcacctgtagctggaacttgcttactgcctcttttatgtgtgtaattttatattgcttgtttacatatatgtattatttatttggttgtttgttttgtagaaaatggtcaatggtgggagagtcaacaactgggcatgtattaacttctctagaaatgtgcaagatagtgctgccaggggcttctgtcatgagctggctatcatgtgccaaatatctggaatggtatttacaagtcatttcagtagcagttcatttttcagggttttcttttttctattagttgtttcaacctatgcatttttttttctttctataggattttgcactggaacctgtgctgcccccacttactgctagacctgaacatgtggaaagagcactgaaggcacgctatcaagatgcaatgaacatgctcagaccgcagggcagggaacttgatttactgattgtaatactgcctgacaataatggttctctttatggtatgctctgttcctaaagacacttgaccattatgcggtgactaccttttcttaacataattcttttcattcctcaggggatctcaaaagaatctgtgagactgatcttggattggtctcccaatgttgtttgacaaaacatgtttttaaaatgagcaagcagtatcttgcaaatgttgcccttaaaataaacgttaaggtatgtgttgcacgccaactatactttcttgacctttcacctgaactctatttctaactttacattggtcctacttttcaggtggggggaaggaatactgtacttgtggatgctttgacaaggaggattccccttgtcagtgacagaccaactatcatatttggtgcggatgttactcatcctcatcctggagaagattccagtccttccattgcagctgtaagtgcaattacgatgaagattggccagaaattctaccaagttacaatgtaagtttggctagtttgtaactgttctcccttttaggtggttgcttctcaagactggcctgaagtcactaagtatgctggattggtgagtgcccaagcccatcgtcaagaattgatacaagatcttttcaaagtatggcaagacccgcatagaggaactgttactggtggcatgatcaagtatggacttattgagatgatacatttttacttccctatgtttgtacgtcactgtgcataaaatatgttgaatgtgcagggagcttctcatttctttcaagagggctactggacagaaacctcagaggataatattttacaggtttttatccttgtacagaaatcttagaggacaacattttgcaggcttttatccctgtatggacatcttcctgaccataattgtatgtgacttcaacacctgtcatttcagggatggtgtcagcgaggggcagttttatcaagttttgttgtatgagcttgatgccattagaaaggtacacatgttttgacctgaatttgatcttcaaaatttttctctttgatattaacatctactaatttctggatgcaggcttgtgcatccctggaacccaactatcagcctccagttacctttgtggtggtccagaagcggcatcacacaaggttgtttgctaataatcacaacgaccagcgtactgttgatagaagtggaaacattctgcctggttagttgttgatgcacattcattttactttgggcttaggtgatctattctgactgacatttattgtacctgtttttctttttgcctaatttctaggaactgttgttgactcaaagatttgccatccaaccgagtttgatttctacctgtgtagccatgctggcatacaggttggtttaacttgtttgcaatttcttcacttaatggagtggtatggatgtatatgattgctgacttgaattaattttcttttctagggaacaagccgtcctgctcattatcatgttctgtgggatgagaacaaatttactgcagacgagttgcaaaccctcacgaacaacttgtgctacacgtaatttactattccaccagtatggcttttatattcactttttacaggtatattaaatgatatttctactgttgtaggtatgcaaggtgcactcgctctgtatcaattggtaagccatctttgaaatcacccccttcggtttcctggctcctaaatccagtgcattgtacaactcttgtaaatcactatgttaacctacaccacttggtttcttgcagtgcctcctgcgtactatgctcatctggcagccttccgagctcgcttttacatggagccagagacatctgacagtggatcaatggcgagtggagctgcaacgagccgtggccttccaccaggtgtgcgcagcgccagggttgctggaaatgtagccgtcaggcctctacctgctctcaaggaaaacgtgaagcgtgtcatgttttactgctaagagcttgggctgtaccccgtatgcgccaaggaatgtagtactatgttatgttattttagcacttgcactctgtcgttgatcccgttaaaacgggtatgctaccataagctgttggactattctgggtattgtagtactacttgttttgtatttgtgtttgtgacgctgcagagcgtgaacaacgcaagtctggtacttgtatcgttgtgtttgtgggaacctaaatcttgttggacctttgttgtgcttgaagaaccaagttaaataatcctgtcagtatagggatttaattgctgcttggcataacttattacctcgcatagctgatttggttctggtacatgagcaagatgagtttcactggaacctcactccgaatatcaatagacggatttggaaggtgaaagtacccctaaaagttaaaatcttcctttggtatttacgtcggagcgtaattctcaccaaggacaatcttgctaagagaaattagaaatgcagcaagacatgttgttactgtcagtggtctgtaattcatttggcttctaatctgaaacctcctcgcaatgttggtcatatgtttgggagttggctatcatgtgttcccaaagaaatgaggaatctgcttttgatgggtgcaacagctctgtgttggtccatttggctaagtagggatggagtaatttttgataacaagatggtgtcttctcctttacaggttatcaccttagttacccggtggctacgtacctgggctatcctccaccaaccggaactgcgggatactattatggtggtatctcgacgtttggaccaggtggcacaggagttcttttacccagaagcatgggtggcggtctagtctacggattgatagccactaagatatacggtggtatctcgacagttggaccaggtggcacaggagttttttacccaggagcatgggtggcggtctagcctacggattgatagccactaagatatatgtttttatccaacttttgtgcttgggagatgctctaattgtttctttcttcttttttggctgtgtgcattttatgcaaaggccgagggtgacttagtttaattgtatcatcttgatataattaactaagtctaaataaaacttccattatctaaaaatagcaggctcacgcttgttgggtcaattttccctacgtgtccttaagccatttgttaggggctgtgttatggtaattgactagcaggagaactgggatggcagtgcacaatggtcaggtaatgactgtttcaaaagtattagactac

SEQ ID NO: 542 - DNA, 9246 bp, Oryza sativa
tcctctgccggcaccggcttcgacctcaactcgcaagcgccggcggcggaggggttgaaatatgatttgtttgtgtcatttgtgagagggaggaggccacacatgagtctgccacaccaaatctggttggaaaggagccaaatgattggaaaagtatatttattgtcaatctaacccttccatccaaacatctctagggctagagttagttcagggttagttgagagctggaaactaactctaacctctaactctaacccttagatccaaacagggccaatattaccatgccagtcaaattggtgtgacatcgttgttttgtcacatcagttgtgctggtgtggctaaaatgttcaattcttcaaaataagatttgaaaggtttatttttaatattaaaatttttaaaaagttaaaaaaaatcgatggcataggagtatatgtaaaagcagctactcaagtctgatctgatgagagtttttaatactgtagtggatatgttgagtactccagatgagattaaggccgagtttagttctaaactttttcttcaaatttttaactttttcatcacattaaaactttcctacacatcagggtatcccaaaccgttggggccggggttaccgcgccccggtggtaaagcacggttaccgcgcggtaaccgtgaaaaaccgtacaaaatttatcaaaaattcaaattattttttaaatttatttgaatttaaggatgttaccacgatatttatattaccgtacccctcacggtaagcccggtaaccgcgcggttaccggcggtaagagaaaccctgcacgcataaactttcaattttcccgtcacatcgttccaatttcaaccaaacttttaactttagcgtgaactaaacacaccgtaatacaggtgagagaggggggggggggggagggtgaatgacgtggcatgtcgacgatagacaagggaaggaggggtgtgggaccaggttagcatagggtgctctgcctggaacgcctctctgtgctgtgctccactcccctcgtcttcttccttcctcggcccggcctcgctcgctgcctgccagctgcagctgcaactctccatccatcgatcgatctcctcctactcccccgccgccgccccgtccaagacaagccaaggtatgccaatccattcctacctactactacctcctcctcagcttcactcactagtctatctaatctcccctagtgagactgagactcgcttgccatttctgttcctgtgctaaattgctaagctacgggtagtgtcttgtgcagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtgtgttctcttccccggcccccccctcaaacccactcatttttagctggagttttgctctactaatctgtctgattttcgacaggtctccatcactccagaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggtcgcctgctcactttgcctcacctcccgcacttgtacaaaagcaacagtattatgtggccaatcttgctgacttagttgttttcttttcatttaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaaggtacctacgaggttcttatgccacttattatatctaacacaagacatttaagaaacagaggtttgacattttctcattttggtggttcacagatatgcgccatttggacgttccttcttttcgccttacttgggtaggaggcaaccccttggtgagggattggaaagctggcgtggattttaccagagcattcggcctactcagatgggcttatcactgaatattggtaaatctctctctctctctctctctctgatgtgtgcatgcatagctgaaatgtaagtcatattctttgttctattgcatgaacaagtgagcaagaagaaagagatagtgcataggtctcagtactttttagatttgagtgctattttttgtttcacgattgcaattacattcctattttcaactggaattgttatgtgattcacttacatcaaatttatatgtttcatttgggataaatgcatttaatgtccttgatgattcttgtgccatattgagcatttgtaccttttccagatatgtcagctacagctttcattgagccgttacctgttattgattttgttgcacaactattgaattctgacatccattcaaggccgctttctgatgccgaacgtgttaaggtgctcttactaaacttacttttcgtgtgactgtctcatctgttagcaagggccaattctcaaatgaaatttacacattcttttttttttaaaagaaagacatgtagatctcttgagctatgttctatttttccctcaaaacttgtatgtcttgtcccactttcctgtctatcttagtgggaggtttgtttctccttatagatgcaactcattaatctttatgctatttaatgagctggctaatgctcccgcattgagatatttcataaaaaaatgacgagattatatattcctaaaaaaatagcattcttattgtatttattgtgatgatcggggcattgtgatttttagttctctcatatcatccgtacttgacaataagattatatctatttctgacaatgtacatgaggattgtacaacataaaatcaccttgccttccaaaaggaaagatagagatacttgtgataccagtataccacacagtaattgtattgggcctacaatcattaattggttagcagtgtaagagtgttgcttgtctgtcccatgtaatagtactctactctatatattgcacctttgggcttttgctggaacgcatgaagtccctttttttcctggcagctcaaggaatttttttaagttcttttaaaacaagaaatgcagtagaggttacaagaagtcgggaacttcagtttgggattttttacactttattttgcttttcctggttgacattgacttctctaaagttttcctttcagaatgtatgtatgctttaacaatttaatctctatgctcccactgtattgaaacactagatcaagaaagccttgagaggagtaaaggtggaagttacccaccgtggcaacatgaggcggaagtaccggatatctggtttgacaattcagccaactcgtgagctaacgtatgatttctaatctgtgtgttttaccaagtaatctctaaggtattcatagaaaaggccctgtgatgctactttcgtatgctctgaaaaaaatatgttgttctccttgtggcagttttcctgttgatgaaggaggcacagtgaagtcagttgtacagtactttcaagagacatatggctttgccatccaacacacctaccttccatgccttacagttcagcgattaaattacctgcctatggaggtaatgtagtggtgaacctttgttgccttttgttgtaatgaatttctacaacactggcccaactttacattttccatgttcatattgaaaatataataccaaacactggtgctgttcaattttggattcacggtgattgcgactgaatttaaccaggtctgcaaaatagtggaaggacagagatactccaagagattaaatcagaatcagataagagctcttttggaggagacatgccaacacccacgtgatcgggagcgtgatattattaaggcatgaaatttgttatcacgtcttagtggtgcaatattgtgtgcgtgattaatgtttaacataattctcaatttctctggtttgggatggtacacagatggttaaacataacgcttatcaggatgatccttacgcaaaagagtttggcattaagataagtgatcgtctggcatcagtagaggcacgaattttaccggctccacgggtaggttgactatggctttgttgaggctttgttgattttgatgtactttcttgttatacccttcttgtcctttctaactgtattgtggatacagcaaaaaaaagggatgcaattaacattttctcctatatacttgtagccttacaaatatgtttttttgttatattttcttgtgatgcagcttaagtacaatgagactggtcgagagaaggattgcttaccaagagttggtcaatggaatatgatgaacaaggtaaccacatgaacattctgttgtccagcaaccatccatttattggcacaaaggctagagtagaaaaggggctaatattggatattcttcttaattatctgagaagctatttacttagttgtaactatagcatgcatggtaactatgacgtgtcatgcaaattaatgtggaaactcccatgcaatattcttgttagttctttatttaggtccatagaactggataacattacagactaactttaagtactctctttagattcattaatcaaacaaattagtagatttgtttattctgaccacatacttaatgtcccttttcatttttctatgcagaaaatggtaaatggtggtaaagtcagaagctggatgtgcgtcaattttgcccgtaatgtgcaggaaagtgttgttcgtgggttctgccatgaacttgctctgatgtgtcaagcctcaggaatggcaagtatccttgaaatgcttcctgcaaaactctcatttgagcatgagcaaagcacaccaagatccatatataaaattttcaacatgaattctaagatttgtacttcatattaaccatttacaataataacagtgtaatgcatcattgtaataggatttcgctccagaacctattcttccaccactaaatgcacatccagatcaagtggagcgtgctctaaaagctaggtatcatgatgcaatgaacgttcttggaccccagcgcagggaacttgatttgcttattgggatactacctgataacaatggctcgctttatggtatgtctgtctgataatcagaatccttgtagtttgcatctgataacaaagagttgttggattctcactagtattgtgcatgtgattctttatcaattttttttctctctataaggtgatttgaagcgcgtgtgtgaaatagatcttggaatagtttcacaatgctgttgcacgaagcaggtgttcaaaatgaacaaacaaattcttgcaaatcttgctctgaagataaatgtcaaggttaaagcaatccatttacgccttttcgctgcaatttgtatttcttctatgttattgaatttttcatcatttaattttgcaaggttgggggcaggaacactgtgctggtggatgctgtgtcaaggcgtattcctctggtaaccgacagacctacaattatatttggtgctgatgttacccatcctcatcctggagaggacagcagtccctcaattgctgctgtaagtagaatatcgcctgtgacctgttcctgaattttttttccctggagggtaataatttactctgcctacgctaactatatatcgttttgcaggttgtagcctcccaagattggcctgaggtgacaaagtatgctgggttggtttctgctcaagcccaccgacaagagctgatagaagatctatataaaatctggcaggatccacagagaggaacagttagtggtggcatgatccggtatgctactcagtattttttagtagttctttccttaagaacttcacagatagttcttcatttttaaaataacatgatattaaagcccattttatatttatattgccaaaaaatgcagtgagctgcttatatccttcaaaagatcaactggtgagaagccccagcgaataatattttacaggtatctaccctttaggaggaacaattagactttctatgatttatagatttggaaatattatatgtgctatatccatgatttctgttggatcttttgaaacatagcaacatgttgaatttgctagaggggacatctcttccactgaacaggaaacaatcataattccactaaagccggatcttgttttcttttgtcagggatggcgttagtgaaggccaattttaccaagttctactttatgaattgaatgcaatccgaaaagtaaaagtttgccagatcctgtatccttccctcttttttcatattccatgtaaccattaaattctgatgtccttgttttactcaggcatgtgcctccctggagacaaattaccaaccaaaggtgactttcattgtggttcagaaacgtcaccacacaagattatttgcacataatcacaacgatcagaactcagttgacaggagcgggaacatactccctggtagatcttatgaataactccaacaacatattgctttacattttcaccaatgatcttttttctgttggttaattggttacttttttctccatgctctatacttgaaggtacggttgtagattcaaagatctgtcatccaactgagtttgacttctacctgtgtagccatgctggcattaaggtaatcccaggaattgcttggattctgattttgttttgtatttctacgagtcttaacaaataaggtacaacatcctgctctccagggtactagtcgtccagctcattatcatgtcttgtgggatgaaaacaacttcacagctgatgcattgcagattcttaccaacaacctttgctacacgtaagcatgccctttttttctgaccacctggtgaactttatatagaaagttagtttctaacttccatcattttttctgcagctatgcaaggtgcactcgctctgtatcaattggttagttatcttcttctggggatagttttctcaaaattccagcgactcatctcctggctaatatctttctaatccttccattgcagttccacctgcttattatgctcatctggctgccttccgtgctcgtttctatatggaaccagatacatctgacagcagctctgtcgttagtgggcctggtgtacgtgggccactttctggctcatcaacatcacgtactcgggcccctggtggtgcagctgttaagccacttcctgctctgaaggatagtgtgaagagggtcatgttctactgctgaagctagggcctacatagctaaagctcttcgtttcttggcaacctgcctatgatggttgtaattatgtgtcaaaaaatcccataataatctgccagctgctatcttctccattgtactatgctggtcatgtttgccaaagttaccctatatgtatgtatattatgctattgttttttttttttgcggggactattgttatcatgtattatgttttactgtcatgtctgtagttatgattcgaggagtttgcgactgggcttgagcatttcatcttagttttttcttgctagaaattagtacttgtgtcccgtacatgtaggagtttagagtgatgagttttatatgtgctccaggcatactatttataagtagtcagtgctaccaagtatgttaatctttttattattcccacagtaatcatttattaaatcttcacaatcaatgttatacaatacatttctcactccaacaacttcagaaagttctgacgattggtctctacttcaagctccatctgttgagaaattggaggctgggagcagtggtccaagtaagttggttgcaatcctgcatgacacaacagtatattaatggattaatatctcagtctggagtgatgctctctgtttgctgtttttgcagcttcatcagtgctgagaattctcacctctggatccttatttgcgtccttctgcagcgctcaaacgacaaatgtttcagtcagttgttccctgtctctttcttcagtaaatttcgtaagaatgggcacacttgcctttctttgggtcttggtatgatcctattaggctctgcgctctctgtaggttgtgctggttgttcgcccagtgttggcacattctttgcctgaaaaattgaaagaaatgaacaaaatatattcatagatcttcagcatattgtttgtcttgcactggtcctaaactcaccaacttcctaaattgaagattatagaacatgtgtaggtagtgctgtttagcttgtctttcttccttgtctagagtcctccagaagccatatattgatgccatgttcagaactttggttgcatagatctgccacgtgtaacttcaaccatagacaagcatggcccttagtttattaagaaaaaacataaggtatccacctaggattttagcatggtatgactggatctaaagtgttcaaggcatagatgcaaacagcacaaattttactgttccttttcttggtgatggctatatatatttaggttcagctgagaagagagtgataggtggaatggctattgttaccactcatagatgcgttggagtccagcggtggacatcttgctccagtagatgaggtcttccttgcatttctgaaagaagtcagcaatcttgtcgcttgcctccttgccattgagcgg

SEQ ID NO: 543 - DNA, 7013 bp, Oryza sativa
tatttttgatgtagtttatttttttatagacttttaagttattagaaacatatattaaaattgtatacgtacattattttttggacattaataagctcttatgatttgtaattaacttttagacaactgatgagactctcctgcaaggctgcaatccaggcctgtaagaagaaatggttcaaattactacctagataggctagattgcttattgctacctgctcgaaatcgaatacagtagctcattagtactttgcttgtgttacacgtcttattttccaatttggacataacacggggatctaacagaaaaaaggccacatcccaaattctggacttcccaattattcctacccaagatgactccacgcggcaggttgccaacgtccacttgactcgtgtaaactcctcatgtcccactttgtccctcttagcgcaacaaaattgctgccggagcacacagaaacttgccatccgtcaggggcaaaatcgtattttcgcacataattctcgtgcccaagcaaaattcacctgcgcgccctcctcctataactacccctcgctgccatcttcgatcccctcctcctcctcctctgctctagcgaaagccgagagagagagagaaaaaaatccgtcacgaaatccacacgcttctgagttctgatctgtgggttcgagttcacggcggagatggccggtcgcggtggccgcgacccccggagaggctacgacggcggctacgggtacccgagaggcggaggagggcaagggggtactaaccggggaagagacgggcagcgcggtggaggaagaaacgggcctcgcggaggacgctttcccggtggaagaggagtcgagcctcgcagaggcggcgatgttctgggaggaggccaaggcggtgggcgggggactactgctggtgctggtggtcttgtgcgaggagggtccgagctcgcagtgggagcggaactgcggcggcgcgtgcccacctgccacgtgaacgacttcccggagttggggattggggggacgcccgtgctcgttcggcgatggcgcccgcgcgaccaccgagaccagcacgaccaccagagccagcgtcaccaccaccgccaccaccaccaccagcgccagcgtcaccaccaccaccaccagcgccagcagcgaaggggatccaggacgagggatcctcgagttcgtcgtggtccgttggtaagttcctctcctgattcaatcggtgctttaattttgtgcggtttggcatgtttgctctgttccttggcattaggaatgttggaaactgatcgatcaagtggtcgatctggggttttgcactttcgagatagtatattaatctacgcagagtttgatttcgcctattcatgcgagtgatctgggttgtgttttctgctgtttcgatgattttttttcgaacaagatgctgtttcgatgataagagtagaagcagagggatgccgattttgcactagaacggtccttgtgcttctgaatgcatttgatcacgattttattgctgatgtcacgaaacaccgtaggggagcatttggatttcagaaattacataagacgggtgttattcttccttgaatgtgaatcggatgcaacatttactgtcattttactttgggaaaacgttgtgcaaatgcagaatttctaggggtttttcacagcttggtgatccattttttttcgaagttctaactgcattactgcacgtgaagtgcctctcctgattcaatcggtcctttgtgcggtttgcaatgtttactctgctccttactagcattatgaatgttcgaaactgattgatcaagtggttgatctggggtttagttctttcgagagggtttagtacttccgacattgcatattaatctgcacatagtttgatttcgctttcatgcgagtgatctgagctctgtttcccgtggtgtgtcgatgagacgatgatagagtagaagcagatcgagatatgttgattttgcactagtatgatgtgaatctgaatgtacgatcaatttttcttttgttgatgatgtgtcgatgatagagtagaagcagatcgagatatgttgattttgcactagtatgatgtgaatctgaatatacgatcaatttttttttgttgacgtcacgtaccatcaacatttttttttctaaaggcagggttgcatttagatttcagaaaattcataggaagagtaattccttgcttgaatgtgaatcatattactttagggggaatatcgatctacagtttggtgatcccttctgttctagttttaagtttaactacacgttgagttggtgggtttgcttgtgtaaacttgacattctctgtttctaaccactcttccgtttcctttagagcgcattccctacggtgaggatgaaaaagaagaaccaccggcaaccccaattgcttccagtaacaagaataaaagagaagaaccacctaccaaacataggccaatggcaagaccacctggtggtggaggtccattatctaaaggcgaggtcaaattgttggtgaaccatttttcagtcgactacccaaaggaatcaaccttttttcactatgaaatacgaatcaagcttggtgacggtcccaacagaaagctctcaaaggcagagcttcttacagtcaagaatgagctcttcgagcacgagagccttcaggagctttcgtcagctgttgcttatgatggagagagaaatttatacacttgtgctgaactaccagaagactgcatagtccctgtgagcaaattccgtgtgaaggacagttcacggacctacattgtatcagtgaagttgaagaagccgctgcctttaagccaactcttggagcagcggcctgggcctagagatgtcatgcagggccttgatgtcattgtgcgtgaggcatctagcttcggcaagattgtccttggtcagggattttacccgcagagcggcagtgaggccatcagtgatagcaatattgtagctctcaaaggaacccagcagagccttaaatgcactcagaaagggctgatcctgtgtgtggactattcggttttgccatgttggaaagctggatctgtgttggaccttgttaagactatgaagttcatggaatacccgctcttggaagaccaattgaaaaaattgaacaatgcgctcaaaggcctgtgtgttactgtaagtcacaggaagactgaggagaagtacactgttaaaggcttgacagataaacctgccgaccagataacttttaaagactctaaatcaggacagacgacgaagcttatcgagtactataaggagacgtataagaaagagattgagcatccgatgcttccatgcttggatttgagcaagagcaagtccaaacaaaactatgtgccgattgaattttgtaatattcctgaaggggagaggtatccagtggcgaggttagatgacaagaagtctgataataagggcgaacaagagaagccatctacaaagacgacactgagaaaaatttctataaaggttgcctctagtcggaaggaggagattctggacttggtggggaatgctcaagatgggccttgcaggtatctgtttgagtttcgacccctttccactttttgcaaacgtctaactatcgtcatccctaatattaacatgttgctacgattaatgagtagtagggtcatatactcaatgagaacttctctgcataaacaacctgctaccacaaaacttgtgctgaactgctgatgctgtaattgtgtgaaacctgatcttcgaacaaagatatgcatttgcttattcccgtaaactcgtgctgatgctatatatcggtaaaagaaacaagagacttcaactgcttactgtgttggggtcaactcgttgctctgcttacctttatcttcatgatattcaactgttcaactgataattagcttaattttgatctttatcattttattttggagaaaatgagttgatcttgatctgtttaatttcaactatagaactatagagagagctaatgtatcttgtcaggcgctaacttactgttttaattccaggggaaaaatagctcagcgattcaggatttctttagatgcagcaatgatggaagtcactggtaggattcttgctccccccaccctagaacttggcactggcacctccagaggccagaccttcaaattcactattcatcaggatgactgccagtggaactggaagcttaaaaaatacgataaacgagtagtagcacatggcgggactcttaactgctggggcgtcgtcgatttcagtgaaggcgacctagagagcaagtttattgacaaggttgtcaggaagtgctccgcccttggcatggtcatgacccgtaaaccatgctatgagcatgtgtcaaatatggaagtgctatccgatccaaagagcctcagagatgcgcttatcgaagcgaagcgtgccgcggaggaggaagacaagaagctgcagctcctcttctgcccgatgctcaaccggtgccatgggtacaagaccctgaagttgatgtgcgagacggagctggggatccagacccagtgcttcttgagcaccgccgcaaaactcgacgaaaaacgacaggaccagtacattaccaaccttgctctgaagatcaacggcaagatcgggggtagcaacatgcagctcgacccggactcgatcccagtggtgtccgccaaggatttcatgttcatcggtgcggacgtgaaccaccctccgcctgggaatgtcagtaaggacatcccgtccatagcagccgtggtggcctccgttgataaaggcgccagcaagtacgtgacaaggatccgcgcccagtatcaccggtgcgagatgatccagaacctcggtgatatctgcaaggagctcatcggcgcgtatgagaaggtaaacaagaagaagcctgatagcatcatctacttccgcgacggcgtcagtgacggtcagttcgacatggtgctgaacgaggagctggcggacatggagaataagatcatggtgggtgactacccgaagatcaccgtgatcgttgccaagaagaggcaccacacgcggctgttccccaaggacaggaaccagcggcagaccaagaacggcaacgtgctccccggcacggtggtggacaccgacgtggtcgacccgacggcgtacgacttctacctgtgcagccacaagggggaggtcgggacgagccggccgacgcactactacagccttctggacgagcacggcttcgcctccgacgacctgcagaagctggtgtacaacctctgcttcgtcttcgcccgctgcaccaagccggtgtcgctggccactcccgtctactacgccgacctcgccgcctaccgcggcaggctctactacgagggcatgatgatgttgcagccggcggcgtcagcggcatctgcctccgaggccatgatgccggcggcacagccccaggcggctgcggctgcggctgcggcagcgtcgccgtcgtcgtcagcggcatcctcatctgagggcatgacggcgtcccagccccaggcgccggcggcggaggcggcatcctcctccgcgggagctgccgacttcagggagttgcctccgatgcacggggatctgttgaacaacatgttcttcctctgacgacagcttttcgccgcatatggtctctcgttgccaggtactcctcgtatggtcctggaacttgcgtttgattttctggttgtgatacctgtccgtgtcccggtgtctgttctttaactgcctggagtctctcatgtctttgggtggtttatccatagtaaatttttgtccgtgtcatatcttttgcagtcctatacatgctgtcgggctgcatggttgcacaataaaagtttcttcttttgcaatcttcattattttgatgtgcgaacagtaaaatgtatggtccattgccaaagttgctcagctcagtccagtacaccaatttttcactgaatcttttggttgttacacttcacctgtgatcacttcatgccgccagcgctaagggcgtcgaaatgtaggacaagtaacaagttctgtcacaatgtgttgtgcgttcctgggagcaaacctgatctacaatttagccaactagtatatacaaaagctccctttggaacgagcaactgataatttgtacactgaatttcactatgacattttctctatacaaaacgagctcgtagttgtcagaatggatggcagagactcctaaagtcccaattattagttagggattctagcagtcctgtgttctagctgccacttccatgacaaatgaaacactggtaactggtaagcaggaagccatcactgattatcatatctgtgctgctgcatgcttgtgatagtagtgcatcagagaaaatcccacactggtattgatgactgcccctgatcaccattctgatgctccatctggggatttgcccctacaaactgtagtgcatgcatatcactaggatagccctgcaagagtgtgtagatagcagttcatcaaacatggctacatagaatctgcagcatggttgcactcttagctttgaccttaggctattacttcattagtggacaagaatgtcaaatgctgaaaaaaaaggcataaaacttctcgacaacgtcgatagtatataactcacttgggttaattgattgtttccgggaaatgcctgctgttgcatggttggaagtgaggaagcctacagtaagccacaagaagctgatgaatacgatacttcaatagaatgagatatattttttaaagtaatagatgatcacatacctgaccaaactgattcaaattgttatgaagattctctgaggtaccaagcccatagctctgaccaagtatataatgcccctgaacaaggaaatcaacacctgtaataaataactgttccacagtgatgaaaggaacatctaaaaaaaatactgtcttgaagaaaaatcaacct

SEQ ID NO: 544 - DNA, 3190 bp, Oryza sativa
caaccccccccccccccccaattcctcttttaaccactcgatttgtgtcaccccgctacctacaccaacccaccgttgacttcttgcttgtgactccagtggcatcaacgtcgcctacggtacaagtcatgagtcgcgatcatgtcctgcgtgaggttcgtgctccaccttccaccgcttgctgctcataaacgagttcacgtctttaccatcgtgtctcgcatgcattggcttctatgcgcccacatccacctctactagcgtggcacctcaccagctctcaccctgctatctccatctcctccaccgttgcatcttaccatttggtgtgtctcagttgcacaccaacgaccgtgcaatggcccgatcaggtatttgggccccatcaagtttctgcctaaagaagctagcacggttggttgtggaagatggaatcaaggattagggcctttggggcagggccattcttgtccaacccactctcgtcatatcccattgccaacctagcacaaaacgacattctatatacactgtttttcttttcgtaagatgggaatattgcagaattagaatcaatggaggtcggcctaccaaaacttatataggtaaatgcatggtgcactttttcccggtatagaattggcgatgagagagcgacaatagtagtaataacacgttggtttatcaaccatagtaacacgtgatccgagcatccgtttttcacaaaaacacgttgctgcgtccatccaacgcgaaaagtagtaaacgagcagaagcgataaaaaggctgtcaagcccgtccgtccaacgcccagaaaatgtcgaaagtattttcattcgtgtcatctcccggcgccaggggccgacgccgcgacacctccgcgcgcgcccaccgcaagcaatgtacagcccacacatcccctcagcttccgttattacctctgcgcacaagttaccgggcgaccagacgacggggagccgtcgcacgcataaatatatgcccactccttcacccttcctctgacaactcactgccccccatcttctttcttcattcctcttcccaccaagaaccccaaaccttacctccattgagttcgaaaccgaggagcgaggagttacaagccgagttgtcagaatggatgaggagaaggaagccgactcgccgcagccaccgtccaagctgcctcgcctctccggcgctgacccgaatgccggtatgtgtttgtgtaagcgtgttctttttttttttttgagcgaacatgtaatcgtgtttgtgtgcaagtcgtgttgataagtctggcgtgtgtgttttcgtaggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttcccgtacgtgccaacaagatatttttctttttcttctcattgcgtttggcctgattggtgtcgagctttccgatcattcgataatgtggacgccgtttttgacatttgagtggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcccgtttgtttgtttgtctcggcgcatgggaaaacccaaatccgcagggattatgtcatgtcctgtaactctttttttcctcgcaacttttgaagccaaaacaattctcaccgtgttcgatggcacgcgatgcttgtagttggagtagaggtagagtacttgttgagtttgagcggttgtcgcctgtagacgtgcgtgcgtgcgtgcgtcgcgtgatggccggcgacacacgacgcaggcggcaggtgcggcgataattttctttggttgggttgtggggagcgcgcctgcctcggtggcggtggccgcggtggtggtggcatgggcgacgggggggccccggcgaggggcgtgtcctggggccgcgcggggggagagagaaagagagcgctctgcagcagctgcagcctgcatgcactgaccttgtcagtcagtggctcgggcagagtgaggcattggatgctgctctctgtctgggcgtggtgcagtggcccagcgacaagtcccgactcgcactgcatgactcgctgggtcgcaggcaacgctgctgctgctgctgtgctgctcacttgacgcatggaaacggtgatcgggtgcatcgttgtactccacttcgctgagcatgacgcctatcgcgacaatgccggctttgatttgcaaactgcaatgcaacgctgattgatcaggcgttttctctacattttttttcaccttccaaaccatgtgaacattctactccagagaacggttggcaggcagatcatagggatatcgtgcagttgttttaccccgaactcatcgacccctcctcgacctctctgccgcccgagcataccgccggagttccgcgtgggtgcaaggacggtggcgtggcgggtccctttctcatccatccaaggcttaacacggtgatgacggagctcctgtggatctgatgctcttttcttcggaagtcgcctggatctagcatgttgataggagctcgccggctaggagcatggtggtgtggcattgtgggaatcgacgtctagaagcatagtcgtgtggcatatcgtttgggggtattgttcgctcgctcaatggcacggcagtccggttagggcgactggcacgaccccccaaccccccccccccccccccccacacccgtcgcaccggatttggtgaaggcgatggagaaggcacccc

SEQ ID NO: 545 - DNA, 6133 bp, Oryza sativa
ttatgtccccgttgaaaatcggccttatctgaatcgttggatgattcattgactcaccttatatcaatccttgcagggaatcctatgctaacgaaatatgacaccgatgggttgtatgttgatggtgacaagaaacacaacttagggtgtgtttgaggaggagattggagaggttgggaagatacgtaaaacgaggtgagccattagcgcatgattaattgagtattaaatattttaaatttcaaaaatggattaatatgactttttaaagtaattttcttatagaatattttttaaaaaaacacaccgtttactagtttgggaagcgtgcgcgcggaaaacgaggtgctttctcaccctatatcacacaaacgaacgcaaccttaggctctatatcgtcgacttaggggatgatgctaagtgcaccatcgaaaacttatacataggtgtacattatgtgatgtgtctttgattcagtaatttttttgtttgattttcttctcattttttttaataaaatcttaaaccgccggctgttaaaaagctaacaagacatgtaatgtattactccgcaatgatcaatacaactctctatgttgtaagaaaaaaaaacaaatatgtggtgtatattaatatatgcatagtaatcaaagtttaatttatctttttgcgacaacatgtagaagtcatatttagacttctatcatatttagacttctatctttctagagtactttatcttattaaaaatattaaaatttttaacaactattcagatgagatataagatactagaggacattcttaagtgtttataatccactcccacaaaaccgaatactgaaagcgagcagcacgcgaacccaaaggtaagaaaccgatcaagacgcaggtgcttgtcccttagctggaaccctcccgtgtcggcctcctcgcccacccccgcgcaccgctcctagctacccggccggctatatagccccatcgttattcgtccccgtctccccccctcctccctcccttcatcaggcagagccggcctgcagcctcgctcgcatcagcttgcacacagcccacggcgccaccaccagcgaggcgggacagagggaaggagacacagaccagccaagtaaaaggcaaaagcacagcacattaaaagagagagggcgcaagcaagcggcagagaggagagagagagagagagaggcgcacagagagagtgtgtgtgtgtgtgagggagagagagatagcggcagcatatatggcgatgccctttgcctccctgtcgccggcagccgaccaccggccctccttcatcttccccttctgccgctcctcccctctctccgcgtaagccttcgctctcgccttcgctctctcttcgttcttgctgccgtggtggtggactaatgtgggtggtggcgtcatgcggttgcagggtcggggaggaggcgcagcagcacatgatgggcgcgaggtgggcggcggcggtggccaggccgccgcccttcacggcggcgcagtacgaggagctggagcagcaggcgctcatatacaagtacctcgtcgccggcgtgcccgtcccggcggatctcctcctccccatccgccgtggcctcgactcactcgcctcgcgcttctaccaccaccctgtccgtacgtgccccgccgcccttcgcctccgtctcactctcctctagtagtagtactactcatgcatccacatgattgtctcgcttgtttattcggatcgagggattcaggtgtacttggccccggtttgttaatttggtctggtcatttgttaatcctctgctggatttagccccctaaaagcttgcgtttttatattccagattagctaacttgtgctcaagttcaagatttgctcctaggaatagagatagcttagcctcctgtgttagtgcagttttttttattcgagtccggttgattggatgcacacaggacttgaccccaggcaaaagaggtggttagtttattggtccttttcgtaggggttattcctgtctggttgttgggagccttacccacgcattcattactgctgcgattaagcaagctgtactgcatcaaatggaccccaagattaaacaaccaaaagaaacgagtactaagtccctatcttttcctagttttttttaatcgcagtgtacattgttgcgggcgtgaatgattgagtagagtagatctacggagcacggcggcggccgccatccggtccggccgccgcgccgccagattgatttcaatgaacagacgcctagcatcgcatcgccattcgattcttgcatctggctgtaaagcgttccattccaggattgctccctccaatccaaatgcgcaccgacacatgcgttcgttggtggatttggatgccttcgagatgcgcacgtcacatcattgacttgtgattttttttcttcttcttttttgcgtgcttggttggtctgcagttggatacggttcctacttcggcaagaagctggacccggagcccggacggtgccggcgtacggacggcaagaagtggcggtgctccaaggaggccgcgccggactccaagtactgtgagcgacacatgcaccgcggccgcaaccgttcaagaaagcctgtggaagcgcagctcgtcgccccccactcgcagccccccgccacggcgccggccgccgccgtcacctccaccgccttccagaaccactcgctgtacccggcgattgctaatggcggcggcgccaacggaggcggtggtggtggtggcggtggcggcagcgcgcctggctcgttcgccttggggtctaatactcagctgcacatggacaatgctgcgtcttactcgactgttgctgctggtgccggaaacaaagatttcaggtacagggtgcaattaaaatttctgcaaactttctttactgtttattgttgtctactgcatgatggatgtcagatggatggatgcagcagagctggatgcctcctaatagtgtttgaagttttctcattattgtgcttgattgcatctgcagacactagtggtaaatctgaatactactagtgcagcatcactactagcacttcaagtgctcgtctgaaaatgtgcatggggcgctgtttacttcaaatgtttgtcgtcagctctggcacaagaactgctgttaactgtgtttaggctcctccttttctctgggctctggcgatgctttctgggaccagatttttgcctgataaaaatctgaacgtagcattagttcctggaaatggcgttggtgctctggtggaatcatacaagggtagagcaggagagcaggctgtgttcttgtgtgattgcaaacataggagtacaactaaaagttgcaacttgtctgggttctatgctcagagctagtgtctggtgctctctgcacctgctcgatctcagacctggcatttattctgcttcttttattcttctgctgactgctgttggtcttcttgtgcttctcgtttcaggctgaattgctgaactagaaacacgggtagttctgcacctgtaaaacttctcctgactttctgaccaaaaacgcttcgtccctatgcctgaaaccatctgaaaaaggctaacatgataccggaagcccatctccttttgcccacctaatctgaatctttttccctcagtactcctactactttgcgagtttgcaattccactttagtgaagctctgtcactgtagggttacctgcggggcagttggcacatgattggtgctgctgccaatcatgtttgcttagatggttagtttcccattttgttttgtttttcacttttgtcacgaagcaatgtgatgcaacaattttcgtctcccttgacttgttattctcagtcaaagagtcgcgtgtcatgctttaagtaaaggcatgaggcctaatgcatgccctatgtgattattcacaagtaggggttgttacaattatattatcatgtatcgatgtggaaccgatctgttgtttctctgagtttgacaaagaaacgtttgcaattgattttttttttatcctttttcagttgttacttgtgaactatgttcccggactgctcatgtgtatatataggttgcactcagaacttgttttaagttcttgctaatttgcttatacatttttgcacatcatattttgcacaaactgttcttctacattgctgttttagcatcttcaaatgacagttgtaaatgcttggttgttggtggaacatattggtctgtggattactgatatactgatttctgcctttccaatattcaggtattctgcttatggagtgagaccattggcagatgagcacagcccactcatcactggagctatggatacctctattgacaattcgtggtgcttgctgccttctcagacctccacattttcagtttcgagctaccctatgcttggaaatctgagtgagctggaccagaacaccatctgctcgctgccgaaggtggagagggagccattgtcattcttcgggagcgactatgtgaccgtcgactccgggaagcaggagaaccagacgctgcgcccctttttcgacgagtggccaaaggcaagggactcctggcctgatctagctgatgacaacagccttgccaccttctctgccactcagctctcgatctccattccaatggcaacctctgacttctcgaccaccagctcacgatcacacaacggtatatactcccggtaaatgcgcgtgaaaattttccattttgattcatcaattctgaagaacagttttattctgaacatcttcaaatcgttgcagatgagtgaatatcatctggatccctacgtgtcaatgaagcgctgaccaccgtttgctgaattgtacggagtcctggactgcgcctagttttcccaaagcaagaacaataccgcattaatatgtttatgtaattttcgagcaatgctcttctatgtttttgttatgttttatcctattggggaattgtatgaagtccaagtcgatcagaatcccctgtacttgatgtcgaaacctcattttgagtatcaaatcaatccgtgtctcgctcattttcactgttaacccaagttgacaaagattcaaagaaccacctgtacttgattttcggacttctacattttccctatcaatcgtacaattgattgccttacgacgacacgcaaatgcgatgttcatcacatggctggaacagtattacagtagtgatcccttgctttgtcgaggcggcaaagcccccctgatccgcgagctaactcgcaaaacagcttcccgtgcaatccttcgaactactaacaaattcacaaacgcggcatggcgaaattgacatcttttgccccgcgcgcgcgctcaccatttctccatgtccggtctccatgcctctttatgatttgctttggcgtgttgagaccgaaggggacacgataggaagcctcacgggcgagcactgatgatgagatcgaacacgaagaagacgggagaggttttgtttagacttttggagggagagggagagggaggaaggaaaagcgcgcaataatgctgcgatggatctgccgcaaagcctccggagttggtggagcaacaggctgtaactctgtgtacgtggggccgtagcaaagtgcgtatgcactcgctggctttggctttgttgcccgtctcggaagcaggcgtagtcgggggtacgctttgcacggagcacacacggcagcatctcgtctttgtgtgtgccccgtgctgtgctatgctatgctattccgttagcgttaggcttttggagatggctcgcgtggtctcgcatctcccggcagaagcaagcggggcatgtgcggccgtccggccgggatcgcgccgcgcgggccaagcaagtttagcgtcgcgcgcgctcgtgacgagtcgtggaccagttgttaggtcgtcggacgtacgggggttcggttggtggtgaatagatagatagtgcgcgcttcggccggtccccgactccccccgagtgaggcgtgttatagctatccatgtactgtatatgtgcctatctagaatgcttctagctggcgcgtcgtgctgcgtgcgttcctgccgaccaccggatc

SEQ ID NO: 546 - DNA, 5264 bp, Oryza sativa
tcacataggctaatcatggattaattaggctcattagattcgtttcgcaaattagtccaagattatggatgggttttattaatagtctacgtttaatatttataattaattttcaaacatccgatgtgatagggacttaaaagttttagtcccatctacacagggcctaacttaacatccatatagatgtaggttttgcttgaagagattaagactgtgtttagataaggggtgtaaagtttttgcgtgtcacatccgatacacggacacatatttgaagtattaaacgtagactaataacaaaacaaattacagaatctgcctgcaaattgcgagacggatttattaagcctagttaatccgtcattagcaaatgtttactgtagcaccacattgtcaaatcatagagcaattaggcttaaaagattcatctcgcaatttacacgcaatctgtgtaattagttattttttcgtttatatttaatactccatacatgtgtctaaacattcaatgtgacagggtgaaaaattttaccaggagatctaaacaaggccaaagatggtaagacacaacttataataataaaaagaattggtcatatcaatttctactctgtcctaaaataacataacctagatgtgtccaacgattatggacatcctaaattaaattattttgtaacggagtgagtaacttctagcttctattttagtagtttactccctctgtcccataatataagggattttggtgggatttgacatatcctaggactacgagcctgtccagatttgtagtactagaatgtgtcatatcccgttaaaatctcttatattataagacgttatattataagagggatggagtattttctaggattatgtaactacccgtttaaaaaataattaaaattataatatctaattaaaaatttagaaagctaaacaagacctaaataggtatagatactctaggaggaagaaagaagcagatccccctctcctctccctctcacactcacacgctgcagcagcagcagcagcagcagctttcccaccgactcctccccctcctccattaatggccgccaccaagaaccctccaacccccacgtgacctcctcctcccctccccctccccctccccctcccgacctcgccgccggcgacctcccttcttcttcctgcttgcctgctcgcttgcctgcctggttcgaccgatgctgagctcgtcgccctcggcggcggcgccggggataggagggtaccagccgcagcgcggggcggcggtcttcacggcggcgcagtgggcggagctggagcagcaggcgctcatttacaagtacctcgtcgccggtgtccccgtcccgggcgatctcctcctcccaatccgcccccactcctccgccgccgccacctactccttcgccaaccccgccgccgcgcccttctaccaccaccaccaccacccctctcgtaagctctctctccatcttttttccacaaatggtccatctcttgtttgcttcatgcttgggtattcaaatctgagaaaaatttatatatgtgtgcgcgtgtgctttcttgggactttttcttttttttttgtttcttctttcaggacaggatctctttgctgccctgctcattgggattgatttgctattgctctcacgatttattgatagatgaacgtacacggatctttgcttatagtatgtccgtttaagctgttcgattgattctttgctcactcttatatcctaagcaaattaagcatatagtagttattaccattaccaactttgcattgggttgatgaaatgttgaagtggtgcattttgatctagttttaatatgaacaatgatgaatgctgatatggattcaatgtgcctgtgctcatgtcactgcagtgagctattatgcctactatggcaagaagcttgaccctgagccgtggcgttgccgccgcaccgacggcaagaagtggcggtgctccaaggaggcgcaccccgactccaagtactgcgagcgccacatgcaccgtggccgcaaccgttcaagaaagcctgtggaatccaagaccgctgcccctgcgccccagtcgcagccccagctgtccaatgtcacgaccgcgactcacgacaccgatgcgcctctcccgtcactcactgtgggtgctaaaacccacggtctgtcccttggtggtgctggctcgtcgcagttccatgtcgacgcaccatcgtacggcagcaagtatcccctctaatctcattgactctgtgttgaatgcttatttgaattaagcttgcctagattgattgcatattatgctggaatagagctgatctggtagctttcttaaaagggttgagacactcaaaatagtatttgagctctaatgttgttgatgcttattgctcaagtagtgaacctaccctcattccagtaattataagtgtgtgaggctgcctaagaatttgtcgatcagagcttattcaatgagttagtcagatgagtgatactgccaatttacatgtgaccataaccccaactaaaaattttgtacctggattatgttagttaaatctgtgtattgcattccatccatccttgatgctacaaacctctgtgggcacaatgtcataagcatatgtctgttgcttgtgcctttagccctattatactgttgctttttgcagtaatattgtacgcttttccagatcacctaagccctagctgattttgacctttattgccctaactcctgattatgttttgagaaatagtgttaacagttgtcatgttctggggtgtttttggtccatgccctctaaaatcttggtaccgtcttttttatgctggaaaattttgcttgtgtcatcttttttgtgtgccataccttagtttagtatttcctcctctgctagcaatcacaaaataaaaatattgtaccttcgacaccatccttatgcttgtgctgcatgcatggcatatgttctagtttcgtgtcattttgcatttgcatcttgctagatgactgacaaagcttattttgctccttcgactatttttcgttctttttccttttttaactatagtaggttgtcttattatcgttttggtagcatttttcctatgcagctgcttttatgtcctccccttgagttgtagaaatcccttagctactgtgaacctgtaatcatcccattatattccatttgatgctgcgcaaatctacatgtactgtgtctgagtctggtgtctggtcctaattttcatgtatcaatggctatgcaggtactctcttggagctaaagctgatgtgggtgaactgagcttcttctcaggagcatcaggaaacaccaggggcttcaccattgattctccaacagatagctcatggcattcactgccttccagtgtacccccatacccgatgtcaaagccaagggactctggcctcctaccaggtgcctactcctactcccaccttgaaccttcacaggaacttggccaggtcaccatcgcctcgctgtcccaagagcaggagcgccgctcttttggtggtggagcgggggggatgctaggaaatgtgaagcacgagaaccagccgctgaggcctttcttcgatgagtggcctgggaggcgagactcgtggtcggagatggatgaggagaggtccaaccagacctccttctcgacaacccagctctcgatctccatcccgatgcccagatgtgggtcccctatcggtccgcgtctaccttgagcatcccttcaccaacatttctctcacacaattcattccattttctttgatgatgcaggtgattgagaactttgctgcttgtggcagcggggtggacctctaccccgcattttaccgctgctagtgagttggatcagtgattgcgcctcccctggttctttgttcaattgtatcgtgctatgaactagttaagagaaccctactttttttttctagtagaagagacagaaaactcttatccatcatcatgttttaagattccacgatgttttgtacctgcaacccacgacctgccggctgctggaagttactggctgtctgtaatgtttgtagtagatgatctatgatgtatcatgtatctatctacttgttccgaattgcggaaaccaaagccgataatctggcatgtgccaacgtcctccttaaagctcttgtgctatgtattttgcttttggtgggaaaaaagaagaaaagaaggttccatttttcttaataattcaagtttgtagaatcaaaaccaggcgtgacgttgtggtattcgttattccttttgctttgaaaagaagacgatgaaagaaagatatgtgcacgtgaactccaaaaggagaatgccgctcagatgttaactgcagccttttgagccgatatctgggagggatgatgcggcaactgcaatgcaaatgcaaatgccaaaaggatacaagaaggtaagggaaaacgagagagaaaaaaaagaaaaagatagctgagcctttggcaggagggagcacggcctgaacctgatgaacgtgaggtctccgtctccatctcctttggcaggcagacgcagggatggatggggatgtcgtttcagtacagaaaaagcctcagtgcacaaacactccggcgcggtcaaacatggaaatgaacacatgtatacatatactgttattgctactgtacatgaatacttgactggatggtacatgatgcccagagagagcactgaaccacaacatgcccagagagaggctctgcgcaaactgcaaagcagcagcagcactacgctttggtactcgcaaaaaatatcatcgtcactcacgacagacatgttcacagctctccacaacattttatagcaacagcaacagcacattttataagatacagtaataatagcaatagtatatatttattattattatttgattgctgcagacgcgctggtcatgcactcatgcatgcctgcatggtgcataaacaactggacaagcatagccgcaccacgtagtggtaatagtcctataacaatatttgacatagtagtagtagtactgtagtagctgcgatgtcacaggcaggggccagccaacgcagagcagaaacgactcaacaagcgtcacgtcactagggagcaaataacacacagttccgactcgaaacacaaggtttccatgcagacgcgcccggccatgcttgcatgcccccgaggatcagctgcatcctcgaggt

SEQ ID NO: 547 - DNA, 9482 bp, Oryza sativa
aagatttcacaccacacaagctccaaagtttcatttccgatcctccatagaaaaaagaaactcctagatatttcaattttcaaaaaacatttcaaaaatctataaactgcagagattattttaggtgctctgagaactaacacctagatatttaattaggaacctggctagctaggggtatatgtcaagcagtaccggtactatcttccgagtcagagagagagggagcaattggaccattcacaatttgagggcacagtacaaggcacaactggatgggatgtagtactactgtggcttcgccaccggatcggatggacaccactctagctagttactgtaagcatatgctatagctagctataggagcaaacatatactgttcccatagcctcgagatgcatatgatattacgatgtgtagtgtacatgtacacatatggagagagagagagagagatagaagagacctgtcagatcactatgctgagttacacatatatacgtacatgaaaaagtctttctacacgttataagagaatatcccgtgcttcttacacaccatctctatattttttcaaaaagagaaattttaccgttcttgagaaaatatcgagatactaaacgttagtaaatatggttctctaggtatctttttaatgatggtaaaattaccattttaaaaaagatgtttctctttttcgtttcgacaagatagagcggtgtatgttgatatatccatccatccaaccatggatctcatctcgctatctatcttagctttgcttgcaacatttgcctcgaaagaaagaaagaaagaaaaggaaaaataaaaacttttctggtgctcgctctcccgatcactgtggttggtctcgtgcgtacggggtccatgtgtgcgtgggaccccctcgccattattgcaacaatagaaaccctaccccatccttcctcccgctgtgcccaactctcccccccccccccctctctctctctcctccttcccgtcttcttcctccggcctcttctcctcttattgcccttgattcccccgcaccaccgctcacacttgctcctcctcctcctcctcctccgcctcagtgctagggctagcttgcttgtcgccgtcgccgccgtcgtcgccgccgcaatggatctcgtgtcgccgtccgagcacctgtgctacgtgcgctgcacctactgcaacaccgtgctcgcggtaaactcctcgagaaaccggagcagcggcttagcttcgcatgcagagaacgatcgatatatgctgctgctagctgcagctgcaccatggccttcgttctttggttatcttttgaattggacaagagagcaaagaacaaagtgttggttctgtctcgtgatctcctgctgctgcagattgcagagagggctctcactttggtttggtccaatcctttggcttgcttaatgtgcatcatggcatatgcttactctcacacaggacacagtgagagagagctagctagatagctgggaccaaatccagcttcttgcttgctctctctgtgtcctgaggagctagctgctaagctagtggaaacttccactggggattgttcatgacacgtgattgatgtgcccttgctgtcttcctgcatggtgttttattggctagctctctttttctttcttagataaaattcattggccatagctcttgatatgatgctttgtggtagaatgttctactcagctggttctctcgcagtgtcatgttccatctttcgcttccattatatccccttctttcattgttaccagctgcaggctgcatttttaaactggacaagaatccaatttagtagtacctgcatcttctgttcttccattaaaaaacaagtactactgaatcttctcttcttccttttctttttccctctctgttttgcatatcccactttatttgcttgctccatctagattccttccacacagatatgctgttctcctctactttttctccttaaggacagtgccatgcaacaaagagatgaaattaacgaagaaagtattggcttaattgcatgatgtgattaattaatttttcgtcttttgggtagctgcaggttggagtcccatgcaagaggctgatggacaccgtgaccgtgaaatgtggccactgcaacaacctctccttcctcagcccgcggccgccgatggtgcagccgctctccccaactgatcaccccttgggcccgtttcaggtcagtcctctcctctagctaattaagctagcgtttcattcttttctctctctctttctctgaatctccttgcagttcttgatatttttcctcctctttcttcttcttcttcttcgtcgtcttgatcttcttcagttctcgtgttgctgtttctagctactttctcttttctgcatatgggtagcttcttgcgaggagaaaggctggcgataaatctttctccttatacaagaaagggaagacatataattaaagaaattattaattgcacatggagagtgggacttttttttctcatgaaatatggtttagcagagctttggggtgttcttttgttcggtttctctctcctcttttcccttctctctctagctctctgtgtcctgtctcggctttatggagccactcagaatactgtttgcaaggcaagattaaacaaagctggattgcaaaagatttctctcttgcccatctgtggcctgggaaagcctcatgctgcaaaagcggccggccagttcatcttttttttttctcaggcagcatatgctgctagcagctgctctactgtggcattcatgcctctccaaattaaacctgcatttttatttatttacttctttttttttattttggtgtggaaagatgcattcattgcctgttttccgagttgactagtatagctacttctacccaagcagggagagagagagagagagagggagagagagagagagagagagagagagagggagagagagagagagagagagagagagagagagagagagagagagagagatctgagaaaatagttaggaaatgatgattttatcatcatccaactactactactactactactactactactactactactacactgatccatgcatggcaagcgtttgagagatcttgaaatgtgctagagctggaagctagtaattaaccttggttgcttcttgtgttggatatttcttggtgttagggaccttgcactgactgcaggaggaaccagccgctgccgctggtctcgccgacatcaaatgagggtagcccaagagcacccttcgttgtgaagcgtaagtagcaaagcaactatatgcacacttcacttgctatatcatacacgtgcatatataccagctagagtagatatcaatatctttctaattaaatttcttgcttgcttactgctcatttatatcagtcattcagtctctccttagtttcttgctaattgttaactgtcttcttctgacgagtccttcactagctctctgtgtcttgtgttcacatggaatatataaatatgaacaaacagctagctagcatatcttgtgtttcctctgacaaatgtttttatgtcttccattgtagccccagagaagaaacaccgcctcccatctgcttacaaccgcttcatgaggtgagaaactatttacctatttgtccatgcatttatcttatatatatgcttgtgatccctaatatggtttgcactcatgtgatcttatatatattttttctatttgttctgagtttttttttgagggagctagtagtggttcaatattttttttatttgtcctgtactataaactctatgagatctgcacctgttttgggagaaagtttcgattttattgaaggggatttatccccttctaaaagaaggaagaatatacataaaataatttatcatccaaggtcaggacatttttatattgtaaatctcagtacactaaataaaggctactatagctagtgtaattttgtgaattgaagaatattaattaatttgtttctgttaatcaaacaaaaacactctactccagtaatttacctagctagaccattgtgcatattatggatatctagcttgtttgtcattttgtggatattttcaaaaaaaaaaagaaataaagtgcatctatggtctgactttttttagggcatcgatctatggtctgatttaaaccttgtgatagcttgggggtttatacatggatatggtgaatgaattgtatatctaaaataaataccccattttacattttttttagttgccactatatatgttcttttctttaatatattttgttcttgttgatatatagtgaagggtctctctgtttccaggcttccatgtccagctgttttatttagctgagatctctgcatataattataatgtggtcctagttattgccaatttgcattgattttatcatatctctatctctctctacatatatgtatatgttgatatacacatttaacttagtttattatttaattaacacttatttttaacaaaagtacatttatttttgtttaatttattcctttccctgttaattgctcaggttttggaacagattccaggccatgatagtaataattaataaattagtaaacacattttcctttgaaaacacatgaccaatacacatctttattttttttgacaaaatacatctttatttaattcaatgagctgggcagtacgttcatcttgattcccaaataattttataaacacaagaaaaaaaacacttatatcatagttacccatatataactattaatgcctgtgtgcatcttatatctgatgcctgcagcctatgctagatatttatttacaatatctaaagcagttatgatggttaatttgtttcaacaaaatgaaagtaaaaaaaaagagttttggtgtttcctgttcacaccaacaatcctaatattttcatacattattcctgatatttgaactaccttttgtttgtgttatagaacgtaatcatcattattttttataaataactagtcaaagattatttttcaatatttacgacaaattattacatcaatacgtacgtgttacatatattttataaacaattggatacaattatgtttaatttcttcgatataaacactaagtataaatgctactccctccggcattacaagataattgagctattgccaccaaattattacaacaaaaaataatttgtagcaatatattgtactattgcaatgataatttttctgtggtaaaaaaatatattttattgcaatgatctacaattgttgttttatttagtacttttgttgcaatagaaaatgagatatcgccacaaaaaatcttactgttgcaaaaaaaatatgttctatcgccacaattttaatttttgtggcaatttacataataatggtacttttcactactttttgttgccacaatcagcaaattcgttgcaataaaaaaattgtcgtctcataatttaacttaatttttttcatatggatacggattgagacaaattttatatggaaattatagctctcgacgagatctataattttatagttgataacttgttcatatgaaatcttttagatattcaaatcttagttaggtaggctcaaatggaacaatatacatgggttcgaatcctagccaagacactgtataaagaaattaatagataggatgatagattaatatttgaacttttaatttggtacgtagaactaatgccacatatggagtggtggcaataatttttattacaacgatatgaagtgttgcaatatgattttttgccacatccattccgtggcaacatctaaatttattaccactaaataaaaattattgcaataacctattactacactatttattaccacggctagcaacgattttaaaattgtggcaatatgtatctattgccacaattttagtattgatgccacgatttttttcgtggcaacaaataatttttctagtagtacgggttgataatacttgtcgttttggataagggcacggtcttcaaaaaaacaactttgaccattattttctatcataatatgtaaaaaaatattaacaaatatatgatcttattaaagtacttttaaagactaatctatacatgtggtcaccatatttgaaaaacaaatattttgaaaatgattcataatcaaagattttaaagtttgacctcacccttgtccaaaacgacaagtattatcagcccagagggagtatccttttctgaaattttttaactaaattaaacacacttaatttaaaagtagtttcacctaccaacctacctgctataagtaacacacacttgttgatgttaaattcctgataatgcaagccatcttgccttttaagtgttcattgttttgttgttagaaattactaacgtaactgtaaaagatggggctgttaatttgtgcgcccttgtagtataacagtttattaaaaaaactagatcattttgaataaaagacattaatttatatgtgccatcttaacgtgtacaacttatggaagtttcagcatgctcttagatgcccatccatgggatagttttaattaaattaaccgacccttccataaaatagtgggtgctataaatttaagttaatttgatactgcattgctactagattgaccatttctttaattaaatactaattgagttagtaaaccaattatttcactaaaactgaataagcctaggaccaatctatatatttttatggtgaaagttggatgcaggggaaatttcacagattcgtggaaaattaaaatgggacaatatactagcttgaacacaaataagtagtatcaaaaggtagaacatatgatatattagcaaaacaccacacatgcattattatccaatgtgtgcgagctaattattgtacatatgctaatgctactgtaatataaatcacatttagtactccctccgtcctagaatataagaagttttagagttgaacacggttattaagaaagtaggtagaagttagtggtggagggttgtgattggatgagtagtggagataggtgggaaaagtgaatggtggaagtttgtgattgattggaaagagaatgttggtggagaagttgttatattttaggataaattctaagagctgaaaattattatattttgagatggagagagtatcaattaatctttttacagacccgtacttcgatatatcatcgatgaagtaattaaccaaagggaataaaatatgcatgggacaactaaactgggatatatatgtagacaatgccagtttatatctaatcgacacaaccatatgcatatatgcattgcatgtacctacgtacgtactacactctcttctcagaaataaatctgcacatggatattttagcggatcaattaattataattaatatatgatgatgcagggaggaaatacagcgtatcaaagctgccaagccagatatccctcacagggaggccttcagcatggctgccaagaacgtaagctctactcatccccaatatctcccggcccccaatttgcatgtgataattgtgacagttattagctataatcaaccgatccatcggtctctagatctctcgcaccttgcttacacatcaattactagtacaataatattaattacttgcaccgatggagatgcaagtgtctgatgatcagctctgcatttatgcagtgggcgaagtgcgacccccgctgctcatcgacggtttccacctccaacagcaaccccgagcccagagtagtagctgctcccattcctcatcaggtgatgatcatattgacgataattaacttgccatagcaacagagacaccgatcatatatacatacacacaaaatgagagtataattaaggcagtttctctatatgatttgatttatttgatgcatggccaccacaaaacgattatgattttagatagttcttgtgtgatatgatctcaccgtggaattgttctttaattatgtgctatattattgatgttatatcaggagagggccaacgagcaggtggtcgagagcttcgacatcttcaagcagatggagcgcagcggctagggcggcggcggcggccggagccggcggcgatctatatcggcggtgaagctcgtatgaagctagctagcctgcaggccggccactggggagagtaccaaatttcagatcccccttattatcaccgtcgtcagctcagctcatgcatgcatgctcatcgttcccctttagcatatatctgtgctcgttttgtgtttattagttaattatgtttgatcttgttaatttgttgttgcatggagtatgtaccccctataagacccagctgctgctaccgtacgatatacgtacgtatgctatatatatatatatatatatttgtcatcttataaatcgtgtgcaaagtatatgtcatgtgttcaagtttcatactatagttgacaactgatataattaattatcatatgtaaaatacgcatgtttgcaggttttcacatatataaacacgcaatcagtagtcagtgcagatctatctctatatatgtgaaatacaattatctgtaaatttatttttcagataaaggagatattttactgaagatagcaccataccactttgaaatgaatgtttgccataagtaatttggaggattcaatttcctaattaaggaaaaattttcctatagagccctttgattcataggaaggataggaaatttttcataaaggattgcactgctatggttcaattttataggggaaaaataagcaagaggtcaaatctcttggaaactttgctttcctttgttagttcctacaatgctagcgaagagctccttttcatctttcctgcgctttttttgtacgattaaagaaacatgcaactacacaatttctgcattttttttccttttcttgtgttttttctatcttgcgtttcatagggccggggccggttgctcaaatactctcagcttgccttacatatgtgcatcattcaggctgaccttggtgtggttagcaaggtgtaatagtggttgtttggttgcatgtattagtttaacctggttttatatgaggtgttgtttcattggttggatcgatatgtgaaaacttgtatgcatggtattcgtttggttggataaatgaaccttgagtatactcatctttctatgtggatggtaagattatccctactacccataaatagaaatattaccaagtgcaagatactctaaattattataaaatacacacatttcagatataaatgcagctaagtcaaataaattcattgtttttttaaaataaaaattgaattcatatccatatatccatgaacagcaaaaccatcatcacatatgtacatgactacttgattggt

SEQ ID NO: 548 - DNA, 6714 bp, Oryza sativa
cacattaataactcgtttcaaatcggacggcgtggctactctagtacacccatttcaacgggacgttccactccactccaccgtaactgcgcgcgtggggcgaccccatcacgtgccacggtacgggggcgtcgctgaccgtctctggcccaccgcaaccctgctcccccaatccaaaccccgcgctgcacgtctcgctggcactgggcatttcgatccatcgcggtcgcggccgcggtatcacgactgacgcgcggggccggcccggcacgcgagaccgatgtagacgtgtcaccggggaagcttgtccgctcgcggttgccgctgcgcgggggggaggggagggcgtcgagccgtacgtcgtcgtcgcatacctcggtcgcgtccctgtcaaagccggccatcgctgccggctgctcaatttattcccttgctgtttcatttcgtacgtactccgcgctcgggatgcggccatagccatatcgccatatatctcgtgcaggcaccgtcacgctcgctcggcaactgtacgtgccgtctcaggacgcggcagtcaatgcggagttggtacaaacttgcgatgaaaggagtggtactgtggtaccaccactgccctgtctttgcacacatcagtcttcccggagtttagctcaaggaacgtgggtgggggtgctgtttgtgtttgtgtgtagtttttgccaatccaaacaaattggcaaagggggctggaagagtccatggtatttcccctatttgatttgcaatttgaactgtgcaaaaaataacgcgtgatttcatccctgtaccacgggacgaaggatcggctttgcatggtctggggaatcatggccccataccggagaagtaccgggcccacgcagccatgatccatccctcgagacggcccggcgacagcgtatccaacgtaggctcgggcccacgtcgcagtggaacaaagcccacagacacaaaaccccaccccccgctcgctgttgaactctctcttccctctctctctttctctctccaaaccccacgcacgccgcgtcgccgcctcctcctctccatctccgctgctattattgcccgcgcagacgcaggccaccatccttcctctcgctcacgctcgctgctatatgggggtcctcctcatcgcatcgcatcgcatcacctcgcacgggcgcgcgcgccgtgccgtgccgctagctcgatccgcctcgtacgccagctcgctcgctcgctcccccaccccgctgctgcacggctgcgcccgcgctgtcccctgtccccccgctcgccgcggcgatttatacccaccacgccccctgctgctgctataatgcccatgagtgaaggcggcgaggggtggttctgagttggccgttggcgtgctgcgtgtggagatgggggaggaggcggtggtgatggaggcgccgaggcccaagtcgccgccgaggtacccggacctgtgcggccggcggcggatgcagctggaggtgcagatcctgagccgcgagatcacgttcctcaaggtgagcgccccgcggcggcggcggctgcgtttttctctataggtttctctttcacactcgctcgctcgaaattctcggggcccgagctctacttgcttcgtcttcctttgactttaccgattaattttaaaaaaaaggagatccgattcgccgcgcatttttcaaaacccaagcggccgagtacggagctacccgctactgcaagtaggatgctgtgaagtgtacagtaatggcgttgttaattgcggtagctagtgctattctagtacttgtagtactgtttctaggcggaggtgaatcacggcgccatcaatccgaggctggcgagacaagcttggccctctttgggcgtggcgccatggctgtactacctttgtcgttgtttggttgggctcctcgttggagaaaagaagagcgtgggcatggacaactgacctgagtggccttgtcagggagagccatagcagtggacgtgtctatctccgccattgcttcgtcgacactggacgtgcagacggcatggccatgagggctttgcacgatgggtggtgccgtgttggtgttatgggctgccaccatggtttgaggcttttgatgttgctagattttgtgtttaacgagggagggaagaatgtgttgttcttgacactgtgctgtgcttttaaggagcagagatttcagaagctcttcagatatcagagaacttctttgtagtagtaatcaaatgcgctttagacatctttttatcgtttcttgcaaggtcagtccctgctttggtacccgatctcgcttttgtgcaacatcaaagttacacttacacagtaaagcaggaatctttatgggaccgttcgtactggtcaattactccaggctttgattaatgggttttaagttttaaccgcagatttggtacaagtaacaacctttatttactttttatttctgcaactgtgtcttttaacatgaaagaatccagctccattcaaaagtttagtttttattttccattgtggtgcatggtcactcagcctgcagtactgaattatcaaaattttcttttgtcatttctctcatgttaagtgcatagtctattttacttcaacaggtagaaaaacttttgtgggtttgtttctagctcaaggaggaaattcatgggtttgcatctagcacatgagagaacaatattggtctaacacaaagctccttttgtaggatgagcttcacttccttgaaggagctcagcccgtttctcgttctggatgcattaaagagtatgtactactgcccttcatgcattacagatattttgtttttaagtttttagaaatttgaagagcttatgtcaagtatgaaatgtcagcttaattttattgctgtccttatctaatgtcttatgctctgttttataaaatttggttgcattttctcccccagggaaaaatcttgtataagtgtgttatgtacttatgtgtataaaatcttgttgcacttgtatgtcacacttaggccctgtttagatcctccaaaatggcagtttgccattttgaagaaccttttgccattttggatctaaacactagtaacaaaacttggcaatttggcatttggcatttgctagtctatagtagcaaattgtgccaaaaagtgctttggaaccactctctctttctttctctctctcactttagtgctagaatggtaaaagtttaggatgcatctaaacaccaactagtacttttacaatactaaaacttttgccaccaaaacttttgccatttgccatttgctatttcaaatggatctaaacagggccttagcaaatcaccatatgttaaaattaccttgggatgaaaaagaaaaaggaaaccagcattgaagtcttgtttgaaatgcatatgtacttgtaccattacagaaattcttaaaactgctgtcttgacagctacttatcaaacagccccacctgcatcataacgttcctagtggtgcctataactctgcctcagttattattttgtggcccactggtccaacaatttgaaaaaaattatattgaactaaatatattgaacagtagtatgacgtcctctttgcttgagttccatattacagctcacagtcctgagatttgtttcaccgattctttccatgcgatgtgcacatattcttattcaatttaaaaaatgaaagcagattatttttaacaagtaacctatcacgttagcttaacattgtatatttgtggtggaattatgtaatattccgatatcgcatttgaagttttgaacatgtgtgctcaaattgagggacacatgactgtagtgaaagcaaatataaatgtctgagcaatggactatactttgtattcattactacaagttatgtccttttgcaggttgctaatgtcctcttacattacttgtcaggataaatgagtttgttggtacaaaacatgacccactaataccaacgtatggcctctaaactttcagttcccccattttaagcatgttcgctgtttatttacgagttttgacattgttttttccttttccagaaagagaaggaggcacagatcttgccgtctttttcggtggatcgggtatgttttgatccaatatagtttgctcgcaggttctgaggggcaagaacattcaaatatctataatgttttctgttggattcaacattcatcactatttccctcgaaaaaaaagcattcgtcactattggaattgaaagtctgaaagtgcctctagtccctttgtatgttaaaagtcaataaacaagcagtagttttctatatgccacattaatattattgacgcattttaaaaagcaaactagtccagggatgtaatcatctttgttatctaaaactaaaaaaggaaaaactagtgcttttttacattaacattgatttttttgcggctgaaattacatgtagaaactttggcataataatctgtactactgccaaactgagcttttacatggtgaaaatattttccctgcagatcaaaattgtgtatctgcatttcatgtctttgctactgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacatcttttcatgcttcaaatccctgtacagctgcttcaagatcccttcatgcttcaagtcccagtgcaactgctctagccccaattgctgcacttgcacccttccaagctgtagctgcaagggctgtgcctgtccaagctgtggatgcaacggctgtggctgtccaagctgcggatgcaacggttgtggctgtccaagctgcggttgcaacggctgtggccttccaagctgcggttgcaacggctgcggctcgtgctcttgcgcccaatgcaaacccgattgtggctcgtgctctaccaattgctgtagctgcaagccaagctgcaacggctgctgcggcgagcagtgctgccgctgcgcggactgcttctcctgctcgtgccctcgttgctccagctgcttcaacatcttcaaatgctcctgcgctggctgctgctcgagcctgtgcaagtgcccctgcacgacgcagtgcttcagctgccagtcgtcatgctgcaagcggcagccttcgtgctgcaagtgccagtcgtcttgctgcgaggggcagccttcctgctgcgagggacactgctgcagcctcccgaaaccgtcgtgccctgaatgttcctgtgggtgtgtctggtcttgcaagaattgtacagagggttgtcgatgcccacggtgtcgtaacccatgctgtctcagtggttgcttatgttgatctagatccttttttggttgttgtttttcttgtattttttagttgttaggcctttgattaagttcgaactttcataaatatatggtgtttatcctgtaaagaaatgatgatttcaaggatttttcatagctatgagacgaggttgaaccattgaagcgccaatagaccgtgaagatatggagccatacacgctgaataatttttctgacagggtgaggtcgaattggctgccgtttcgcgaggacttttgctgcgcgacggcgaggacagccggggtcccacctgtcagccagctttgcgagctcaatgtttttatttccgccgttgcttcaccacgccgcccggcaaattcggcccgtcaacgacggtaggcctatatctctaatattgaaatccatgcaaattatcgaacgattagcggtgtcacgtgacatggcgtggttcagcactcccacacttaaaaaggactaaaatataaaaaacaattttacgttggagtaaaatgaaaaactgcaaagccacctgatgtctccggaagggacacgaatcttcttacgttggagtaaatatggaacctgatgtggccagtacctctgcggcgagcacgtcctgcaccgccgaggacgaggtcaatgacctgcaatcacatgtattagtgatataaaatgatgaaggaaaaaacactgactacggcttcattcagataaaggataaaaagaagcgttctacttgataacttctctaatcaagatagcctacttttactatttagagtccaagatggacacttgttatcttctcatctacaagccaatttacttttggtgtatctagcactgacaagaacttggactcatttactcgccaattactctaatgcaaaattgacatggagctttattaaaatcttccattatttaagctctagatcaaatgtctataatatgttacataaggctggtttggtttaaggcctaaattaggcttaccaatatttgacaatttcaatagtgtttagtgtctatttggtttgaagccaaattttggcatgcctaagaaaataggccatttcaatagtgaacttaggctattttggcttcaatccaaacacaactttaccttaccaaaattagtcatgcaaaacttgccaaaatttggcatt

SEQ ID NO: 549 - DNA, 4189 bp, Oryza sativa
tcaataattaacagcctattgatgtttttcttaattgtaccttgattttgttgacataatgtgcgaggtattgagcatatacactccagtggataaggaaagtggatgaatatataattcgtttctaaaaagaatttctgtctatagatggaatgctgatcgagttatttgtaaaagaaaattacatttaggtaattgatgcacaacacttaattttctttcaggcacacgaaaaacgcgcacacacaaccaactatgcacacaaaccacgcacgcatacgaatgtaagagacaacatataacagagtgatacatccttagaagatacttccgtcgttacagaataaaagagattttaggttaatggaacatattctactacgaatatgaatacgaattatatttagttagatgtagtaatatgatgtatcccatcaatctaaagtccttttatattttaagacgcaaggaataggtagcaagattatcaagcgaagcctcaatagaaagaagcgaattactctctccatcccattttaaactcaattatgagttttcatatccaactttaatcgtccattttatttgttttttttaaaaaaaataaaacatagatcacatataaaattacaaataaaacgaacgatcaaaattgaacacagaaactcgtggccgcgcttaaaatgaaactcatggccatgcttaaaatggaacggaaacagtaacaaacaacaacatggccatactagggctaaggatatcagcgatgagaaactaacacagggagtcttagttttatcactggaaaatactttggcaacatatacatcaccaaccggtttattattattattatttttgccacaaacccacgaccccaaaaacaaccccaggacacgcggcgcgacagcgacaaagcgcacgcgcgcggcgagctgtgagctccagtataaatatggcgccgcgagcgaggaagaagacgaccaagccggagcacccacctcagcttctcagcttcagcttcgcttcgctacagaaaagcatctcggaaaagccaagaaccaaacggctcagctctacgtcgcgtttgctaatggcgacaacctcctcgctcgcgctgccgctgttcgccggcggcggcggctccgaccgcctcagccaggagatcttctccatcctcgagtccaacttcctcttcggcgcgccgccgccggaggggcctgcaggttactactcctccgttggccgcgtccgcgtgctctcgattgatggcggcgccgacggcggcgcgctcgccgcggccgcgctggtccgcctcgagcgccggcttaaggagctctccgggaaccccgatgcccgcgtcgccgactactttgacctggcggccggctccggcgccggcgggttcctcgccgccgcgttgttcgcatgccggatgccggcggaggcggcgcgcgacgtcgttgccaggaaccggaaggtgttctccggccgccgtgggcgggggggtggcctgttctggaggccggagtcggtgttcaagaaggtgttcggcgacctgacggtgagggacgccgccaagccgctgctgataccctgctacgacatggcgacggcggcgccgttcgtcttctcccgcgccgacgccgtcgaggccgacgcgttcgacttcccgctgtggcaggtctgcgccgcggcgtgcggcgtgggccccgccgaggtcgcctccctcgacggccggaccaggctccgcgccgcggcggccacgggcggcggcggcgccgtgtccaacccggccgcggtggccgtcacccacgtgctccacaacaagcgcgagttccccttcgccgccggcgccggcgacctcgtcgtgctgtccctcggcgggaacaacgccgccgccggcccccgcgcgtcgtcgtcgagcctcctgcgcatcgccggagcttgccaggccgacatggtacgccataattctcgtgcatttccctctgcaaggacaattaattgtaccccgcgtcgcgtcgcttacccgacggtgtctgcgccttttcaggtggaccaagctgtatcaatggcgttcggcgagtgcagggcaaccaactacatccgtatccaggtaaaaacataaaaaaaaatcttacaattctacacctacttattactaccagccaagaactgcaagggctaaatttaaccaaatttattgaaaaatataacaatatttttaacataaaacaaatatattgtaaaaatatatttaatattatatttaataaaactaatttggtattacagatattgctgaatttttctataaattcagttaaaccaaaagaggttgtagtaagaaaagaattaaaacgacttgtaattagagagtaaagtacgaggcaagaactgcaagggctaactcctctctctgcttcgttttcatcttcagggcaatggcattgtggccggagcggcggcggcgacggcggaggcggcgatgacggagaggagcgtggagtcggtgctgttcagggggaagaaggtgatggcgcagacgaacggcgagcggctggacggcgtggcggagcagctggtgagggagcaccaccggaggatggagagcaaggcgccggtggtgctcatcaagccgtcggcgacgccgcggacgtcgtcgtcgtcggcgtccacgctcatcaccgtctccaccaacgcctcgtccgagtcgccatgagagaactctacaccaccatcaaacttcgcgccaaaattaactactagctttgggtttttatttattttttatttaaattttttttggatgctgagttcatctgtttgcttggctagtagttggctttgctttctttttcttttttagttttagcgcgagcggcgccggcacatcgggttttggttgcctgccggcgccgccgggcgctcgcgctcccggcccgcgccgccgccgcgggcgtcgccggcggccgggaagaaagaggagagtggccgagtgagattgtcaggagaggcttgtctagctaagttaggaaagaagaagaagaagaatgccgcgtgacgtggcaagagtgacgtgtgccactgcagctgaagctttacagcgtgtgtatgtacaattgtactggctactgtaggtgggttgcttgcaatgtaatgcgatcagtgtgggcgttttgctgatgtaaatttgtaactgtccgtgcaaatttgccagggatcagttgagatttcagaaaatttcagaacaatctggccatcttcagttcagatttcagaacgacctcgttgttgtcttcagtttagatttcagagcaacctggtcattttttttcccttgtaaaaggtgatattcgaacaggaacctggacaagattctgaatactaggtaatttggcttcccagatgaatgaacagtggacagtggtatgttttcaggcctttgaaaagagagacgaaggttcactggaaaacaggaggaaattaaggaacatgatgcgtcactagaatctagttcatgagccatgtaccaaacaagaacatgaaggatctccaattctccatcccagtttcttttcatcaacacatcttttagtcaagaacacattatggaacagggaccaaggaaaagattctaatcttcagaggtaatttggcttcccagataaaagaacagctggaatgtgtaccaaaatccatggtggcaaagaacttttgagctttgaaatatgactatttagagaaatcttgagcttcgatttgatccctgttctattatattcattcagttcgacaatatttcaaattcgatccctgttgtattatattaattcagctcaacaatatttaaatttgatttgaacaatacttgaaatttgatttgtagagcattttctcaaaaagagaaaacaccctatttcaaattcgatccctgttgtattatatacattcagtttaacaatatttgaaatttgatatgaacaatatttgaaatatgatttgtagagcgttttctcaaaaagagaaaacaccctccaaaaataagagtatgctgctatttgtggcgcgcacacggtattctttagtaaaaggcgaaagaatagttcgctttgtgctcaccacgcagctgcttgagttttcaccgagcagctaccgccctttaaatacccgaatggctagctca

SEQ ID NO: 550 - DNA, 6714 bp, Oryza sativa; identical to SEQ ID NO: 548

SEQ ID NO: 551 - DNA, 9836 bp, Oryza sativa
catgatgcttactccaggtcagatgacctgatgtttagtgcagaaaccaagaggtgctcaattggaccaccgtttatcgtaccagcctctcttttgcctgttggaaagaagaaaagttgtggttgacactacagggatttttgggtcgagaaaataagtgtaccgatttccttcaatcctcccttgtaagttactagtagtatgttggtaggtgagtaaaaatgaaaatttctatctgttcctattatcaaattacatttgttttcttatacattttagccacaaattcgtggcatataggatataatgttaaagaaaatatgtcatactagaactataacgattacagtaggaaatataacaatgccgtcaaataaactcacaacatgacattgaggcataatacgtatgtccgccatgtgttctctacgtgatacgaaaaaaacgatgttaacactatttttaaattgacacgtacatattatcaaattagagatgtacattaacactaccacaatttcaatgattaaatgaagtagaccgataaataacccctcaaaaaaaaatccctccattaaaattcaaaagcaacctctagtttgtctctaggggtagaatggtaaatcccagccgcacagtccacccaaagccgttgttacaccgaaaaagctcagtcacagccgaatggaaataaagaggagaacacaacaaaagtagctacccttcaacccctttcttgccaaagattacacttctaaaaaaaaaaccctcccataatctcacctaaagcttcatataatctccaaccttaacactaatctctcctaaataccaccccaaaaaaaatctctattttttaccaacccttttccataatctcacctaagcttaattaacactaatctctcctaattagcagtaaacaccactcaaaataaattaaaaattaaaatctaactatactagtactagtagtaatttttagcttcttctctttcccaatttttctcactgtcacagagcaccactgcagcaccaacaaaccaagcagctcatcttccagtcttccactcttcctctctctctagctcactctctctctttctctctcctcgcgcgagcgcacgcttaccggaatcgggggggcgagcggcggcgagatccgggcgggccgcggcgatctcgtcgccgcgggagctgcattggcgccggctcgccgccttcccggcgtttcttggggctgtcgcgaaggaggaggaggaggaggagagcttggggttcttggtgaggggatccaccagatccgacctcgccggcggcggcggccgcgatggagcccgacgccccgctcgacttcgcgctcttccagctctccccgcgccgctcgcggtgaggatttcgattgggggggggggggggggtggtgttcgtcctgtgggtgtttgctaatggtgggatgcctccgctgcaggtgcgagctggtggtgtccgggaatgggcggacggagaggatcgcgtccgggtcggtgaagccgttcgtggcgcacctgcgcgcggcggaggagcaggcggcggcgcagccgccgccgccggccatccggctgcagctggaccgccgcgccgcgtggttcagcaagggcaccctcgagaggtccgtttgctgccgtggcagttattgggttggttggtggtgtggagaattcggggagaaaaagaaatgatgggaattctgagaggtgttcttgtggttgaaggttcgtgcggttcgtgagcacgccggaggtgctggagatggctaacaccttcgacgcggagatgtcgcagctggaaggggctaggaagatttatgcacagggagtgagtggccaaagttttcttttctatattttctttcagttgtggagtgtgtttaggttgtgtggtttatggtggaatgatcttgcagttgttctaaaaatagtattatgctgtacgcaggttgccggaggcgctgatggagctggtatgcatgacaatgtttatagtgttcttttgtttgtcgaatggggttttgagtctcgttcgattagttttatgcctgtttttgttcatagttcatatgtcactcagtttatctacacttgaattgagtcgaatcgcgactcgagtgccttcacaagttatttgtgggaacatccagggagaacttttattattgattggcttgattactgagatgatgcattcaatgccactgtccatattattcatgctgtgaagctttgttaatgggggaatacagtaaataatccatttccaattttagaaagaaatgaacaacttaattaattgttgcatgtgttgaactgcaatattagggtacatgttttatcgttttaacatgccttcattgaggcaacatattgttcttctcaacacaatttgcttaccatcttacaaatttttttttcccgggtgaaaatgttgcagaatcagcagcagctgcagatattacgaagtatgcttctatgccatctctgtcattatctatttacttcttcattgtccgataaccttgatttaagtgagttgaacatggttaacccttacttcttcagggagaaccttgattgttatcaatttcagtcaatgatatatgatttgttaggactgttctatatataagaaatggttggttaagaactattcatgacatcgtactaaatacggagtggagatgcctgtgtcagaatactttaacatgactagtatttcgggcgttccttgatgaactgtttaatgcttattctgtctcaggggcctttcatgatcattttcccttttcggttgcttggggtgtagcaaactgtgttcatcctttcatctgtttactatgcttaaggacatcttttgtttcggcttacaacattataaaaacttgatgttcttaattgaatattagtaaaattgttgcagtcatgtagcaatgtgatctgctgcaaattttggtagacaaactcatcgcttgaatatgtagattgtagaatactatgataattagataaaggtgaaatgcttgatctcttttggttatgtgggtcagtgctgttaagagccctagttatatagctttacacaaatgagcacttacatccacgcatgcaccaaaaccttattttattatcgttgtgtatttctacatcattaattcagtctcttgcttatgctttactaattaaagttgttgctaaagcatcgctatcagtagtataggacttacacataatagctggtagaatataaatgattatactgtttcatctgtactcagtcttaaagttataattccttacaaatggcactgtgtaaatcatacaaaatatagttgtctgtactacttcatcacgtataacttgaaacttactgtaatttgcatataaagttagccatttttgtattgtcagtatccaaagttgatgccctggcctttttttttttctatgcaggaaggaacttcttagagcgattgatgttcgtctaagtgctcttaaacaagaccttgtcacggcttgtgcccgggcatcatctgcagggttcaaccctgacagtgtttctgagcttgttctttttgcagatcattttggtgccaaccggctgaggtatgattggaacttaacaagttcataatttaggttctaggtgtcatcatttatatttacttaaagaatacatttcacagaacttcagacactttaatagaaaagccacataaaactatagatttagaactaaataactcacaaaactactggtatctgtagagagaaagattatcattaacttttacaaatgccattatattgcgcactaaattgtacctagctcacctcaaacttgtacagtatgatggaaagctatgaacatacaaacttcagaattgcagtttaggacacacataaacttcaaacaccctaaggttattatggaaaagtggtaaagtttgcatgagaagattcttcaatgtactaggagggagatcatttgaagtggaatcttatatcagattcagttgtgcacacctatatgttcccaattcatccttatactgtggttgccatgatagcattgcgacattgagttaccctctgtcccactcgttttgtttctcggaggatccttttgtgacctcttgatgattattttttgtgcacacatgacaactttttttttttgggtatccagtgaagcatgcaacaaattcatgtcactttgccagcggcgtccagacatctgtcctcattactcggtgtcatcaacttcgtcacaatggaagagctttgatgatggaaatgtccgtggctcctccagttcagacatgtcactagacgagacacaagctgatcaaggtgcatccagcaacaaatctataattggtggtagtgtctctcatattcacagaagcaacagccaaaactcagtagatgttccaccagaacccagcgcagttcaacaccctaaaccaactatacagcagtcagtagagaaacaagaaaaggaaacagatgctcttcctgcccctgccccagctggagggggttcaagacggttgagtgtgcaagacaggataaacatgtttgagagtaagcagaaggaacaaacctcaagttctggtaatagtgctgcatgtactagtaaggtggttccaacgaaaggtgagcaccgcagggtgccttctggtgcgtccatggacaagttggtaaggaggtggagcaatgtaagtgatatgagcattgatctaagcaacaacgatagcagcagcttaaatgaaaagagggaaattggaacccctgttggaaccccaacatctgccaatttggaggttaattctaaggcaagagctgacggggacgctaatgggctgaagcatgcagttacatcatgccaaaaagatacatctgatgccttacccttggattctaccactgcagatgctttctcatcctcaactttgaatactacctcaccatcccccttatcagccatcgcttcttcttctcctcagaaacagaccgcacctcgtgtggaagatgacatggttataacctctagcattgagagtgagtcatccttcagaaaggaggtaggggctagtcaaggaaaaggtgacgtgaggatgtcagggcaagctgtttcaagtgtttccactcgagcccgagtaaaaacatctccaaggccaacatggccagaaaacaatgtaactttaagtagcccaccattgtcacaggagcatgtacagatgaccgatgaggaaactattcccattgttcatgaagtagcagttaaaaaggaacagattgtacagaaagataatagaggttctcgtctccgttctaaagagattcatgctgaagcagatgtggttggaaggaaggaccgaccctctcgaacaactggaaagatatctgataccagaacaagggccacctccaacccacgtgctaattttaggggttcatctgtcagggatgaagctgcctctacagaagctgaagttcatgatgttaacttgcaacggaaaagtctagcgcggaaggtagaggattctgggagaaaggttgcagctggctctgaaatactgcctcaatcagattgttctattcatcagggaactaatttgagcagacaatcatccagtgctgaacaggaattgagtttgcatggaggtaaagtcaaattaattagtgatggaaatgctgttcctttggagcagactaagagaccgacaaaaggtagtcaagatcggcatgatgaactgcaaaagaaagccaatgaattggagaagctatttgctgcacagaagctaacctcttctaggagaggcaagtcaactgatgtgcaggttgagaacacacccagggtgaatgaggtaaagcctccactggttcttccagagaggatttatacaaagcaaattgtaaaggagagtataaccaatgagttcgatgccaatgagcttttaaagatggtggatactgaagggtataacaataacgtaccacaaagcattattagcttagaagagtcaaggggaaagttctatgatcaatatatgcagaagagggatgcaaaactaaaggaagattggaagctgcaaggagaacagaaggaagcaacaataaaggcaatgcgtgatagcctagaacgaagcaatgctgagatgcgggccaaattctctcggtcttcaagtgttcctgattcaacatatatttctcgttgcgctcataagtttcctcctttgcaatcagttataaaggataaggatcaggtattaaattctacttatagcagtttttaagtagaaaacagtagtacagaaaattacttaactacacacccttagtgcattgatgtgatttatactgaaggttgtttttttatgtaaaaaaatttaatactaaacaatcatgatatgtgtatcttgaggagcccataaggctataattctacgcaaagtgaaatgatgagttgtagtttatggttgtttatatttttgattttgcctttcccaggggatagattccttcttggtagaagaagaaatgaatagtgactatctatctggtgatggttcatccaggagtgctgattccaggaagcatttttcaaataaagttgcctgcaatcaaaagaagtctattgctcctgttcataggcattcatcaaggaccgtaagctctggttatgcaaaccgtaggaatctaccagataatcctcttgcacagtctgtccccaatttcgcggacttaagaaaagaaaatacaaagccctcagctggtctgagcagagctgctccaaggacccagccaaaaagttttatccgtagtaagagcatcattgaagagagtaagaatatatcaaaagatcaatcgaggaaatcacagtccatgaggaagaacttaagtcctggtgaattaagggacgctacatccatgaatgacgtcatatacaattgggctccctcaaaaatttccaatgatcaagttgagggagtttttgcttatatcacccatacagctggttcaaccaagtcttttctcaggaaaggcaatgaggctcaccctgctgtcggtatagctggatttgctcctcctatgtttgcaaatacctaccagaatggagatgatgacgattttctagatcaggaagaagactccccagatgagaccaaagatgaagaatatgaaagcattgaagagaatcttagggagagcgattttcctgctgactcagacagtgagaatccaggaataagtcatgaatttggaaattcagatgacccaggatcagaaaatggtgatgtttcttttccaagtgacgcacccactcttggtggttccaagttcaatgcttttgcaggaaacatgcatgatacacctggtgaagtaccagcatcatggagcacacgcccacacctattcgcttatgcaaatgataactcagatggtgatgcttttgctgattcaccaaatggaagtccatcaccatggaattctcatactttagatcaaataacagatgctgatgtttcccggatgaggaagaagtggggcagcgctcagatgcctttcgttggtcccaatgcatctcaacagccgcggaaagatgttacaaaaggatttaagaagctattgaaatttgggaggaagacacgaggtgctgatggtttaaatgattgggtatccgcttcaactgcctcggaatgtgacgatgatatggaagatggacgagatttggccatgggatcttctgatgatttcaggaagtcaagaatgggttatccttctgcatatgatggttttgttgataccgatgtttttgctgaacaaggtattttcgcttgccgatttatctccactctctgtttccattgtcaacaaaagtccctacttattggtgacgttcgaggaaccccctccaaaggaccagacccaaaacttgaataaaagaatatgatttcctagattgtcatattcatgtgatcttgaaagtatttttttttctcattcatgtgttttccttacctcattcattaactctttgctatacacacttgtctgcttagttttgcacacccgtttaattaattttttaatttgcagaccaatcacttcgcagctccattccaaatccccctgcaaatttcagattgagggaggatcaactcactggaagctcacttaaaggtacacttacagttacagatatatactactagtaccttattttttttattttaagttgctaatgtaccacataacatatgaagtttttgcttcttatttctgtctatcaatattaatatgttctccccccaaaaaatgcagcaccgcgatcgttcttctccctctcaacgtttcgtagcaaggggggtgatgcaaggctcaggtgacaatgtgacatacccttaagcaccagagctggagtatataaaatatctcccgaaattaggtaccggtatcaaattttcatggatggtacgcggacactgctagcttgtcttataaatacaatatattctgtatctatagtaattcatataagctgccagttgagcgtttcctctgttgtttgattattctttttcctatcacttgtgtagaattggacctctagatttttttttctttcttttgcggtatttgatttcaattggcccagagacactgtattcattttgttgtttttgtgatatgcttgtatcttccacccccatttgttcattcacatatatcacaaattcgcggtatatgacaatcttgccaacatgagcctagaaatttctgaaaggcatcttccaccgttttgtgtccgtgcagtatattttcattctcagtttactgagcttcataatcagactcatctaccctgcatcaagacatttgttttggtataaacacgtgagatcagctgagtttttcagcagatggtaccagtctcttgctgtacatatgtttttacagatttctgaagcataattttgtttctgtataaatgtactaactggtgccctgctcattttgctgcctgtgtaaatactttttatggtctcatccgaacacagggtaaaatgccccatagaaattgaacagtttcctatgaaacttctgcagaaattatgtaaaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgtcccgattacttataaattctcctattgtcaccacaacttattattactgttttaaaagttatgtatctataaatagataaaactggatatgtaccaataaaataagcctaatacatcattgatacactaaaatattcactacttatctaagtgttcatgtttcacttatttccgaatcaatatataaatattttaaaaataccacttataccaattaataaaataacaccgttaaagataaacatgaatgcccctctaacgggtgaagcccatcgtaaccactaagactttctttctctgttgagttttctaaaaaattgaaaataaaatttttgataaattaatccaaaaaattaaaactaaatcggatttacttaaaaaatagactaaattgtgtttttatcattttttacatttgtagatttaaattagtgttgtatatttatcaagtgatattagaaatcctaaaatataatgtgaaactatttaaaaattaccacaa

SEQ ID NO: 552 - DNA, 6018 bp, Oryza sativa
catctcgtaataagtttatttttatctcctttcatttgtcccaaaataagtttattgttagaataatatcatataatcaacttgaatatgaatgagactttgtagatatgtgttatactattagaagtatatatttattttttttagaatttttcgtgatatttactaatttatattcacagagtatgcacgaaaaatttcagtgcacagtatatattcctcggatctaaacctgttggttcaaacacatgaacaactgctacatgacctccctagtttttggcaataactggttatcttcatcattttgagcaatagcgtcgagttttcagatttttcatctcaccacaggaataattttagagggcatagactcttagcaacccaaagaagatatcgcgtattacataatgcatacatcatacatgcatggggagcgtatatcaaaagtaacatgcatttttttctatatttaataaaaatgtcactaaaggctaaaatctaacatgttgtagtctatttatatttatcactaatgtagaaaaaattttgatgacctatttctatattactttaaatgatagtagtagtggttaaacaacatatactgacatgtaaggctacaggtataaggttcttacaatatatgtgaacgttgcgactttcattatatgcctaatcgactaagtatgctataaacttatactttttatttttctttcatctcttgtacatccgtggtaatgcatggacttttaacttagtgtaaaaaacctttctactcgttagaagtctcgacttagtccttattctttcaagctacttcactgaattattgtcgtgcattattttatccacttcctagaaaacattttttttccaaaaaaaacgtctacttcatttttaaatatattttccaatacagtaatatgttgaatgctctattttcaaacagaaaaaaattattttattttttgagcataagaagctgaaaagaaaattgtctagggaccaaaatgccccttccttctcttcttcttccctcacctcctccccctctttccctctcagctccctccatctctctctcccctctctctctctctctctctctctctgatctgcagagccggagcccggaggcgcggctgcggctgccaagcctcctcctcctcctccagcgcgcggccagcgagcagcctcggaggccaccgccgccgcctcctcgcccggacggcgggggagcgggcggtgctccgtccagcggagcgagcccccccaatcttggccggaatcggattgaaggtatccattcttcttctacactgtagctatctctctctctcgtcctcctcctccgcctccggttcgtggggcggccggggcgcagatgggagatcccgtccggaccggacctggattggttctttcttccctccaatttgtttcttgtcgtttggtttggatttctttctctttgagccagtaggagtttgtttcatggagaaatgacgcattttgttcggtttcgctgcccttttcaagaaacttgtgttcaggtttggtgttgtcactctcgaagttttcttgtgaaattcatttattttttatttattttattttttgcgattagtgaacccgccaagaaatcagacgatcatcacaataatcctttttcttctaaagaatactactttttttcgctgtccgtccgcattccctttctcttttttttttttcatcactgacgacagcggcggcggcgattgggttcttgctctccggcgaatatccatcctgacatggattgatacgttttcttgccaataaacctttgcttggattgagagttctcttttgggggttcttctttctgtaagcaacctaatccgaatcaacgggcattccagtttttccagtttcttgcggatttgtttactgcttagtggagtggatgcagttgaaattaatttactgctataaaaaccataggctatccctttcacctatctggcatttacattctgcttccttgagctcatggaggcaatgtataagatgtatatatactcaacgctctgaaaaattgatgttgtgttgaatattgagtaactctggtatctagattagatgttaccatgtggctgatgcatgaacatttaatttcatcacttgcacatgcaggatcttgcgttagttactgtgctgttcgctggatgctggcaatggggtcagaggagtgggagttgtatccatcttccttcattggtgctcaggtcatagattatgggcatgtttctggagacatggatgatgatcagagtggagacttggccgtgtcgatggacgccgttctccctgatgatcttttagaaaaggtcctctccttcttgcctgttgcaagtgtcataagatctggatctgtttgcaagagatggcatgagattgtgcatgcccggaggcagacatggagcaaaatggtgcctcagaagccttggtacttcatgtttacctgcagcgaggaagcggtctcggggttcacctatgacccgagcctgcgtaagtggtatggattcgacttcccttgcattgagaagaccacctggtcgatttcctcatcgtccgggttggtgtgtctgatggacagtgaggataggagccgcatcatcgtgtgcaacccaataactaaggactggaagaggcttgttgatgctcctggtggcaagtcggctgattacagtgctctcgccatttctgtgaccaggacctctcatcagtacatggtggctgttgcaaggtgcaaccaggtgccatcagagtattatcaatgggagttcaccatccatttgtacgagtcagagataaatacatgggtgtctcccttcactgaactattgattggatggcgaggaggtgatgagtgcgtgatctgtgatggggtcctctactatctggtgtactcaacaggagttttggtgaataacaacgagcatcgccattgtcttctcatgtatgacctatctaccaggcctactcacacttctttgatgagcatggctataccagtgccgtgccctcttacatgtggccgtttgatgaacctcaatgagaggcttgtcttggttgggggcattggcaagcaagataggcctggtatcatcaagggaattggcatctgggagctccggaacaaggagtggcatgaggttgctcgaatgcctcacaagtttttccaaggatttggcgagttcgatgatgtttttgcaagctgtggggcggatgaccttatctatattcagagctatgggtcaccggccctcctcacatttgaattaaaccagaagctgtggaaatggtcactgaagagccctgtgacgaagaggtttcctctgcagctgtttactggtttctcttttgagcctaggctggacattgcttcctagttttattttgtttcacttccacgggaattcttgcattatttgcctggtttggagttaccaagtgaagagatgatgtcattggaagccattcgagaaagtgtttcaggttttatagatctattctatttattgctgagtatatcttctaattgaaagggcgtctaaacttccctgtttcatttttgttgatttgatggttggataatagagggagggatgatgccatacacaagaacaattcttgctgaattgtgttttctttattcttatgttgcctgcaaacaaagtgccacttcagatgtcccaaacctaaaagattgttactttcttgatttatagtagtcatttgcgtttggggtccccgctgctactgatttatgttttgttttattacgacaccactacatgcaaacatctgaacttgaagcagagtcctttgttgttgagtcagtacttgaagcagagtccttgctctgcttgccgtataaccattgatggacagcagagctgttaaggttgccttctcttttagtccaatgcacaaaatcaatctgtccatcactcttattagcacttacataatcagaatttttggaaatgcagatagttaactgaaaataaaaacatggatatcaaaccatgccatgtaaatcgcgaagagctggtttattgaaatattaggcaaacatttggtgatctctggttttactgtactcattgtttatccctaatgttcttatacttatctcctctgtcaagttcctttgatgctatttgaagctcatgtttatccataatgttcttctacttatgtcctatagtactaaactactaactgctaaactgtaccatactttatcccaattactcatacagcattgtgctgttcatgtagtgccagaatccttgcctgcttctgatgcagcatctgtgtcatactacatagcaatggcatgtgattgtgcaaagacaggtaaaggagcatgcatgctgcatcagggactcccggactcagagtctctctttggttttggatggatacgttaacactattttcctcatgcctgaactctctgtacttgcttgatagtaccaccaatcctaaaaagcagcatctccctttttatattttcttgcctgctgtcactgctcccaaatgttgcttaaagcctgtaaagccacaccctctgctctgcaagtgaaggacacatattgtttcagatgtccagctgtcaatgatgtatgttgtgtatgccttcagagaatcagaaagagaccctttcagccagccagcaggtgagctcagtgatgtggtaccagcagggttgcattgttgcaagcatggggcaatttcttctgatgagcatatatattgatgttgaagggtggtgtatgatatcttggggacagtttctaccagtctgttatactactagaaaaggtagtaaatgtgggtgtgtatgtaattgtcactttgcaaaggtgtcctccaaatgcatttgctgtgcaagtattgtccaatgctgtacctgaacttgttgagctttgtgctatagtgatttttattagcagaaagcatggtgttctgtcaaaggatatcccacaacttgaacatgatcagtgcttagctaatgtacttggagaatgccagtgtttttgtctctttgcaacatagtataaaaagaggtaaacatgaaatctatggcagggagctgtttctccaagccagaacagacacatcacacatactagtatactactgataggagtagaatcatatttttaaagaaacaaaacaagattcacctgcccagtctttgttaattcttgtggttagaagttggagcaaatgcatctgtctggtttgacatcttcattttgtcataatctgttagtagtcagctattactaccgttgctaattaaccctcaaaaacgtcagcgtgcactaaacgagttagagcatgtttggacatatctaacgcctaagataagttcagggaataaaaaaaaaagttgagagacctagatgatgcacccgcataaatttcagaacagctagggcacttcattggaaagtctaaaatttaaaattaattacaccttaaacaaataagtaagccgtaaacacaaaaacatatccgagggagcttctaacaattattggttttttcaaaatctttagcctcgtaaatagttcatattgttatatggattgtaagaaactttaatcatacaatctagaaaataaactagcagtagaagctcaacttttcacattctcactaatctagaccagccacctcggctgcttattactataatcttaagggcccctttgaatcaaaggatttatgtaggaattttataggatttcctatttgcccctttgattcaaaggattgaagctttccaaatcctatgaaattcctatggaatgacacattacatgtagattttagaggaaatttagcaagagctctaacctcttggaaaatttcctttgagtctctctctcatccgattcctacgtttttcctgcgctccaatcaaacgaccattcctgtgttttgcaa

SEQ ID NO: 553 - skipped

SEQ ID NO: 554 - DNA, 3623 bp, Oryza sativa
gcaggactgaactctcgccatttcaaaatataaaaattttaagattttttttaagtaaagtattgtataagatataagaaaaaaacactcttgtgatcactttcggagctaaattttaaatttcttagattttttttatcaggcatcacatttaaactctcaccattttaatatatgactttttagattattttagtaaaatacaaagatatataagaaaaaaaattctcttttagtcactttaggagctgagctaaattttaagttgcttagactttcttgtctgacatctcattggttagaaatatattttcctcccaatggataagctagaaagtgtcccatcggaagctaggtagaacactttgtgacagaggaagtagtataaattttcatgcattgaaatcaataaatatttatattagagtaaaattttaaatcatagaaatgcttccatttgagaacgacgtaggagcatagcagacttttaaagccctttcgaatcgagttataaagaatttcataggattcacgacctacatggaaatttttctaccctttgttacaaagaattggaactttttaaatcccataaaatttttatggaatggtaattgacgtataggttttgaagaaaacttagcaagaatttcaacttcttgaaaatttttctttgagtcgtctctctcattcaactcgtacattttttctgtgatctaatcaaaccgaaaaaaacttagcaagccctttcatatgttttatgtgtcttttaattctctattttacacttcaaatttatctttttatttctacgtttagggcccttttgaatcgcagggttgaaaaaaatagaggaataggaaaaacataggattctgataggaatcgaagggtaaaacagaagattgcaaaacacaggaatggtcgtttgattgaagcgcaggaaaaacgcaggaatcgaatgagagagatagattcaaaggaaaattttcaagaggctagagctattgctaaattttctccaaaatccacatgctatgtgtcatttcataggaatttcataggatttgaaaagcttcaattctttgaattaaagggccaaataaaaaaaatttctatagaatttaaattctataaaatttctatataaatcctgaaaaattaaagcgagagattaggctgaaagatctagagatcctaggtccaaaagaagagagggtcgtgacggtgccgagagccgtcctgccgccctggaaattgtgcctatgtaaagtgtagccggccacacgttgtttcttcctttccttcacatctcacagccccgtcttgctgcttccagtccagcccgctcgccgtctcgccattttgaccagaccacctcgctgcctctgctctgctcagtgctgctcactgcctcactcacactgtcacagtgctcttctgggtataagtagctgggcgcgcggcgtcaccttccttggctgcccgtgagcttcccgcgcgcgccatggcacggcctcgtgggcgtgggcgagcttcttggtaggcgaggtgtcgccggcgatcgagttgtctcgagaactcagctatgaggacggcggccacgccgcctctcgccgccgccgccgccgccgtcgcggcagtgttcctctctgcgttgctgctcgcctccgcctccgcctccgcctccaggctccctcctcctcgccgtcttcttcccctggtacgcgtacgccctcgccgccgccgttcttgatcgacctgagtgttttttaaaaattttgttcggttagttgatgcgctgtgtgttcgtccatggcgatgccgatgcaggttggtggcgaggtggcggtggcggtggtggctggggaggaggagaaggtgcggctggggtcgagcccgccgagctgctacagcaagtgctacgggtgcagcccgtgcgtcgcggtgcaggtgcccaccttgtccgccccgtccgtccccgccgccgccgcgccgcgcacgacgccgcgccgctcgtggcgacgttcaccaactacaagccgctagggtggaagtgccagtgccgcgaccgcctgttcgacccctgaccctgaggcgcgcgcgccccgtggcgcgccgtggcgtggcgtggcgcgtgcatggcggggctcgcgctcgcgctctcgctgtgaattacggtgtgtgtggccgcgtcgcgtgcccggcagcacatggcgctgcactgctgctgatgctggtggtggtggaatcgttgtcgtcgcgtcgggctgagagggattgttgatagattccgtgtaatatgccaggacaaaattttgtcaccgctgctgctgcccatgcagctggatcggctcggctactttcaccacctatactgtatctttcactggcatctgctcgccgttttggaatctctgcggtgtggggttgcctcttgcatgtacacatgtttttcatgtatcgatccatgcctcctccatggaatctaatgggaatccatcatcgttcatgctggatggatggatggatgtagtgaatggtagtttttcttatttttgttggagatggatattttttactttacatctaatcggatatatgttgtcttttaaattgagaatttagctactcaaacaatccattctgaaattcgttcaaacgaagatttgaacttaagtatcttaggctgcgttcggcagaccaggttcccaactccttattttccgcgcgcacgcttttcaaactattaaacggtgcgtttttgtaaaaagtttctatactaaagttgcttaaaaaattaaattaatctatttttgaaaaaaaatagctaatatttaattaaatcacgcgctaatcgctactccgttttgcgtgccggggagtgagggttccccgaacacagccttagagtgttattcagatcgctgcaatctacatgccctttctcaaagtgaacggtatagttctagtggtaaattggtaattggtccctctctgcatctgctatgcatgcatgcatttgcttgatagtatgtttttgtgcgttgatgtgcataggtcagttttgttcatttgaggtttcatgccagggaaaatcgatcatgcactacatcctttattattgccgtaagtacgattgattatgtaatcgacatattcatcaatcctcccatgatccaaaaacgttccatgccggtgtgatcgtggtgatttggttgatttgaaaggaacgtaatgattgaattttttttatgggaaggccaacttcggtagaacacttgtgtgcagccatcaaagacgagtggaaacttgcaatgcggcattcctcttaaccgattgaggtcagttgcagcccatcgcgcagtggtgtaatcagcagtgttttaaatagcgggtttaaaacgtttagttggttttctcaaacagttatagcgggctaaatagagctataacggctaaaattgtataagagagtaaatagctatacccttctcagacagttatagtcaaagatggtggcagctatagccggaaatttaaaacctggtaaccagtaacggctcgacactagcaccgttcttatgaggtctggttttgagttggcggcgacccctccattt

SEQ ID NO: 555 - DNA, 7864 bp, Oryza sativa
ctttatctactctttcatatcaaccaattataaccatattttacttgattttttaatggactttcttatcttcaccaattacaatcatctttcatttaaatcctcatcaaccttaattaaaaacatcaaaattaagatagctgtattttaggaaggatgtcatttatattttggaaaaaaaggggtctacgcaggatcggtcgagacgcattcattacatcgaaaatgatccctgctggctctatgcatgtactctgtcaaattagtccatatacatccgcagttcttttactggagtgaggtcttccatctatccctaaatattatctttaatttttgattaaatttttttaatcaagagaactttagcttaaattttgtctcctagaaactgtcttttttaagtagggttcattatacctctttaatagtacttcaacgttttttttattctcgttttagctttggaaccaatagtatagcagctccatttctctcctcattttttctccgtatatatgatcgaaagatatggtagtttctttgtcttttgcttaatttacctttgattagctcggtaaaataatagacttttaggtatggagaaagtacgagtacgtttctccatcagccataaatacccttctcgatctgccgctccctgctagatctctcctccacatccggactctctctatcaaatttacgtaagcgcagtgagaaaaataattagctgggccaccagcatactgttggcgtacagctgcaaatacctgtcgagctaatcttggttaaaatgttggtttagtgctgtttcacaggtggtataccctgcttttgttaatagtacctcgcgactctgctgtatatttctgtcagtgtcaaatacaaatctacttcaattcgtcggcacagattctgttgcttaattgctggtgaggaggagcactcactatatagctcaatccatcttcctctgcaaaacgtacgcacgacactacgacactctggttgcgatcgattatcactccctgatcgcgagttcttggtctgcgagcgtctgcaattaaggtacgctataccctaactccctttattttccatatctgtataactaagtttctctttgtttttcttagggaagagttcctctttgttttgacgaggatcgaggattgtttggacgaaccagcagcagcgtacgtgccaatttcattgatagtcgctgtatctgatttacaggttattgctttatttcttcctatattttcagtttttagtttgttactattagtttttggtttttttattaagaaacctaaccagcttcattggaagtaattaaagttatgtaacttatgttcgatctttaatataagcgcatgcatgcactagctagcttaacgcacatagaggcatacctattattaattggaagtaattaaagttatgttcgacctttaatataagcgcatgcatgcactagctagctagccttacacacatagaggcagtcctatcatagaatggttacatataaaaatttgttcatatatgccttattctacatatgctgttcattttcttgcgtactaacctcagtttactaccgtatgcatatatatacaagcaggaaaaatacatacaacagtgtgtggtaaagtatactactattactggagtactaattaatggaagagacccctctgccatccgggaagaacttcaggagccagcttgctgctgcagcgaggagcatcaattggacgtatgccatattttggtccatttcaaccagccgcccagggtaatagaccatatatatatatcatgcatgacacgccttaatttccactacctataaattcaagaaatctttacatctctacataatccatgttaccatgtataaatatcttgaaattttacaaaagatggtatagacgattattctgtaaatgctgtaaccttttttcgaaaaaagttttgtaattatttgattgatacatgagaaatgacaaacaaacggttgtgcgcgcatgcatgtacagtagtgcgcgcgcgcgcgcgcgcacacacacacacttaattgggctgtaaaaaatccagttcgtacatataatttcgtcactttgttttgtagagttctgacttggaaggacggcttctacaacggcgagataaagacgaggaagatcacgaactccatgaacctcatggccgacgagctggtcctgcagagaagcgagcagctgagggagctctacgactctctcctctccggcgagtgcggccaccgagcgaggaggcccgtcgctgcactgttgccggaagatctcggggacacggaatggtactacgtcgtctgcatgacctacgccttcggcccccgccaagggtgcgtatggtaacttcactccacagagcacactatttcatttgcatatgctaccaattataatccactatgaagagactgcacctattttattttattgcataaaacatgatagtagaaaattataatccctaaaggcactgaagagaaattatacttctcacgcattggctacacccttcgtaaaaaaaaaaaacttaacctagttgggggatgtcctatcctggttttcctttcatggaggaataactagaaaacaaacgtgctggttggcgcaccaattaatatagcctgtggtggtattgttggtcctgttcgagatacataaattgatcattttttttcttaagagatttgaagactttacactatagaaacaaaaacaaagaggctaataaaaaaaagaaaatattggaatgaaatttaccaccagaacatatggtaatagtacccattggaaatcatttagttagacagattccacaaagttaagttagaataagtggtgtaagataagtcaattgatcacatggatagaccaacagtatgtgaaattcatatacttaagagctagattaaatgtatggggttatctacaagattagttttatttttattgatcaattctaaaagatatatgaaatgtaatatttgtgatattccaatttgaaaaaagaacagtatggaaaaaaggtataattcttaccaatatgcaaacgtatatcctctataagcaagttttaaggggaccagcatatgtgggggtacattcttttgatcccatctaatcggaatgttctggatgttgtgatgttaaggtactactttttttttaaaaaaaagaactattaaggtactatttgcttatagaattatccctaaacacttctgtagttttctatttttcttgatcttctgtaattttttccttaagacgaaatccaagatttatttgataagccatgggggccacatggcctaatcaaaagccggcataaccgtcggctttagattagtagattgtacttagtagtatattttctaatatcacaaaatttttgtatgtagttatattagaaaaggaagcaagtactatattattgagaccatataacgcgatcaagaattcaagactcatgtctccagtttttttttttaaaaaaaagacgtgacccacgaccacaatgttcattaagaggtttgaaattaaaaatgagattgggggagagataaattccccgatattttcttttttactagatgaaaactcaaatggaagatgaattgagggtgtgtttagttcacgctaaaattgaaagtttggttgaaattggaacgatgtgataaaaaattagaagtttatttgtgtaggaaagttttgatgtgataaaaaaattgaaagtttttttaaaaaagtttggaaactaaactctgcctgaggctgctagctggtcaacctgcaggctgcagcctgctgccagtctcttacagtatcttgatatgattgtgctagtatactgtaacgaactgttgttctctcgctattgatgaaccgtgtcaggttgccaggcaaaagcttcgcaagcaatgaatttgtttggctgacaaacgctcagtctgcagatagaaaactattccatcgcgcgcttatagcaaaggtactgagttactactacatgagtagtaccatttagtacctattaattcttgcgctctgaatggcaatatctatgaattaagaatttgtattatattcttctcccttttcatatgtatataatctcccgttcacgcgatattgccacatcgtctctcgattactcttttttttttgtttttaattatgtatgacgacgatggtgctgcatgctgatctacctacttcacagagtgcatctattaaggtacaatttcatgcgtcatactatgaaatactgcatgcgtatagctactctctccatagcaaaataacgtcattttaaaatatatgtagccaatataagtttactactccctccgtcacataatataagggattttaagtttttgcttacattctttaaccactcgtcttattcaaaaaatttatgcaaatataaaaaaagaaaaaatgtgtttaaagtactttgaataataaagtaagtaaaaaaatctattttttttttgaataagacgagtggtcaaatagtgcaaacaaaaactcaaaatcttatattatgggacggagtgagtagctgactatagcgctgtagctgatgtattgaagtgtactttcacagtttcttattgcagctgtaacttgttttacagacaatcgtctgcgtgccatttatcatgcatggtgtccttgagctcgggaccactgatccggtaagttacaattactccgcctaaacatacaagacctaaaaatgcattgatgcatgtacagcatgatcggctgctgatgaacagcagtacagcacgcatgcattctccttgctattctctcacagcaactcgatcgatcgtgctcccctgcctagccggccatgatcaaattttcgacggatattgtttcgaaatattcgaattaacaatcattagcaaatgtgaatttgctagatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaactccgacaacgacctcgagcagatcaccatggacgacatcggcgagctctacagcctctgcgaggagctggacgtcgtgcgccctctcgacgacgacagtagcagctgggcggtcgcggatccctggtcgtcctttcagctagttccgacgtcttctccggcgccggatcaggcgccggcggcggaagctactgacgtcgacgacgtcgtcgtcgccgctttagacagtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaaggaagcagcatcaagaaccatgtcatgtcagagagaaggcgccgggagaagctcaacgagatgttcctgattctcaaatcagttgtcccgtccattcacagggtaatactaattactacttcatccgtttcacaatgtaagtcattctagtattttacatattcatattgacggtaatgaatctacattcaaattgatgttaataaatctagattcattaccatcaatatgaatatgggaaatgctagaatgacttacattatgaaacggagggagtgtaatttttttagaaccaaatttgtcaaggtaattggagtagtactagctatttagtgcttccaaaatggaatttcaagatgatttgaattcacgagatgtcgcgtgctgcaggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaagccaaggtcgtcatctcagcggctaagtagagctcgcagcagaaatgcagcatcgtctatctatctatcaatctctgtatctatacgtctgtttggagttctgatattggccatattattgttgcatggatgcagtttgcctcatctgctgccgtcgaacctggatgattacagaagctctccggaaagctatagcaagctagctagctagaaggttgagatcagtatcgtcttggtcatttgctctcatcttgtttaggaggtaccgggaaataaatcttgtcgctctgatcagtgcctccttactagtctcgtgatctgttgtaagtaatagttagacatgcatatatatcatacaacaacgtttgatcttgcatggtagcatatatatgtacaccacatttcttatatctttactcctttaaaattcagtgaggatggtaagtgatgaatctgccaccccatcaccaactccctaaaattctgacatgtgaaacgtcgaccactgtctatcttctctctaaacaaaacatacagtaaaaaaaaaatagaagtcacagatagactctgtagctctcaaccataatcatccttacatgctactcctctaataaatggagactttatgtgtagtggtgaaaacttgcaaccaaaaatctctctagttaattcagaaattaataatgcaaatttgatttcctctttgcaatttgtttttttaattccgtaacaaatgtctattatcgctctatacttgcatgcaataggaactctagagtatatattgacaccactatcacataattaacgaggagcggagggcgaaatatgtaatctaatctgcatgcatatgatatgatgagcacgcaatttagctgaaatactcttgatttttcagacctactactggttaaccggccggcccatatcggttctcaggcccatggcctcttttatcccaacgcgagcgcctgaatttgttagcccacaagctcccacatctgttggttcgtgcaacgatgaaccgactgccgagacggcggtcggcggcgctccccccttctccctgcagcgatctgtcgtctgcggcggccggagctaggatccctctccggtgcgtctttcgctcctcctctccctatcgcttctttctctctcttgatgcgtgctactgagatcgatctcgcgagccggccggggttggatctaatatattggtcgtcgtcattaacaaccgaaggacgacgacgcgggcatcggagaggcatgcatgcgggttgccctgcgaggatatgttgctacctcatcaggatcgcgatcgaggagtgagagcggctggccgcggggatgggcggattctgccgttgatcaggttcgatagtggtgggacgtgtgttttgcgtctgattttcctttaccttcccattcaag

SEQ ID NO: 556 - DNA, 4048 bp, Oryza sativa
tgctcgggagagtcaaattttccagcactttttttggggctcggccgcgcccatacacgggtgaaagccagcccgtgtcagtctttgcagaaaatgcagaaaattgtcgtggtcgcgagctcgacgtctcacccggtccctccctccggtcgcatggacaaacgtcacaggcgcccacagcagcaactggaacaacttccccaaagaagcgagagaggagggagagatttggcatggaccaatccatcggtatctgcaaggtttcggagcagctgcgacgtgtttttccgatatctgatcgctcgaaaggaactgggactctggaagaggtagctagcggttgcctgatgcaccatgcgctggctgggctggggtgcagagcgcagcggctggccggctgctgctgggttgaatttttctcgtggggggcatgtggggggagagacccagcgagctagctcactcgtttttcaagtcagctagagaaatgtaaacatatcaaaacacattaatgcgaaccggttgagctgttttatatatatatatatatatatatatatatatatatatatatatatatatatatatatatatatatatatatatatatattaaaaaaagaggaaattaaaaatcaacaagcacgcaggttttttcttcgctgcagcaccgccggtgccgcgttagctgtggaggtccggatgactgaatattccacagccaaaaagcagcggtggtcggtgccttggtggggaagagcagtgaaaaattgaaggggagagctagctactgcctaccagtagtagtagtagtagtagtagtagttagggccaggcaatcaggattagcacggttaattaggtaattaggacagtttcggctcggtgaaagacgtgaagccccaccccaccgtgggggcgaggcgacggaggcttcggccgcaagccgcctcggcacggctctcctccgcgtcgagccttataaaagccgcccctcggttcctcccccccaaccccaagtccattctctcgttcccaaaccctgcatccttctctttcacacaagcctctctctcgccggcttcggcgtccgtctcctcctcctcctcttcgtctagccttgtggcggcgtgcggtgcggtgcggtgaggaaaggagggagctttgaaggtcgggggagggcggaggagatgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccaggtttgttcctgaattctctccttttttttctccccttgattcgttcgtacgataaatctttgggcttacggatgagtttgcgtggtttgatttttggcagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggtccggccgttgcgtccttgccttgccatgctactctcgcttctgcttacttctccaaagtttgaaaatttccttcctttctcggtcgatgtgctgattcctcatctttcctcgacgcgtttgtttgcgaacaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaactaatccacgcctgaatgatccggagctagctccctaccgaccttgcgctacaggattttgcttcaggctggttgattaattacttgatttgattaattaacttggtgtttcatgcttgggttaattagtggcagtttgttgatgcatccttctcttcctccttccgatcgaaggcttcttctcgggatgggttcggatgatcagattatttatcatccatccagacctccagggattagctaggactccttgttaattaatcctagctagctaggtttcttcatgtcttgatctgatgtaaatacaattactactactaagtacggggtatcctgattgtgtctagtagcatgatgattgattatactacaatcaatggggtgtagattaggggtggattgatcatttacgaattgattaatttggcatttgatgagccagctagctgctagctttataaagctttatactatgtacatgtaccattaattgcttgagctagacatctcatcatatgtgaattgatgcttcggtttagcctttttcctttagtacctcttcaacatgttgatcaatcctcacttattactccctttgctggtgcaacctcgacgtgaccagctgaaagtaccacctgctgctgctcgatcgatcacgaacgccctcacaaatctatcctatcctactattgttcatggcccgcgatgtcatcacggtcgcgctcgtccaatcgtgtgctacgttgacgcgtactactactagctattgcctattagtactaggaacacatacgtaagccggtgagcgggtgcgccatgcgttccgttgcgtcggcggcttcggccttatccccttttggaaacctaagcgcctccccgatcatgtatgtatttagccgatgcgcaacggcccaaagccgggaaaagaaaaacgagacgaaacgggcacatcgatcgtaaccaactaccagctaaccaacccggcaaccccacaactcgccggttcgagaacttgtcgcggacacgccgcagcagcagccgggggcgcgcgcgcggctgctagtgggcgacggcgacgagccggacgggacagccgcgctcccgggcgagttcgttcgttcgtgccagacgaaacggtttttcttgctaggatcgcttcccgttcgacgcaacgcaacacgatgtacgaatcctccgctcggcgacagccgggttgcgcggcgatgcgcttgctattctcacgcgctcgatcgcgtcgatcgtgcatcaaaacccggcgccgaaggctcgcacggcagaaggacggggaaggaagcgagtgcgtgagcagatgccgccggcgcaaagaagactcgttttcatcccgtcaggcagagccggtcgcattcgcgagagttgattttgcgcgaatattctcccttctcccccctaaacccgactccaatgatattacacggtttagattagggaggagtcgtgagccgtgacacagaaatactcctcctcgggagagagacagagagagagtcacgtactctggagtctcgtgtcc

SEQ ID NO: 557 - DNA, 4873 bp, Oryza sativa
acttatcgattaaaattatctctttacttattccaaatatttcaattacttagtcaagaaaaataaatcacggctccaatcaacaagggcatcctcgtattttatttatgatctattaaattaataaatggaaaaaagtaaaaatgtattagatataattatatatatatatatatatatatatatatatgtatgtatatgactaagaagtcatgcagatacatgttaatattaacacttagtcatttctgaacatcaatatgaacttatttagtggcaaattgatttgtaggtcatatacttccattacgaaaatgcaaaacatcatcccataataaaagacaagcacgcattttaagattaaaccattaacatattttaacatatttgaccaacacttattataatatgaaataaattttacttgctaaaaaatatatcattggattaatatataaatttactttcatatggttgtaattttattgctacaaagcttatagtatatgaaaaattataaattaaagattagttttagagatcgtgctaattttgatcacgtcttatatcatgagatataaaaggagtaatatgttagtttcttttactgccgatcacatagaagacgcgcgtaaatttttccaaaaccaaagcgtgtgtgcgccctttttccaaagatcacatgcaaaaagaaaacaaaacactaaacatgaggaggcgaattggttctcacgaaccaagaattccttttccaaaaagtttgccaatatttaacaaacttgaaaaaaaaacaaaaaggtgaagtgaaacctcttattcgaaaaacaaaaaagtgaagtgaaatcgtcaccaaacacgtcttcaccttccataaatccatctcccaaacatggtgtggtcaattaagcaagaaagtgccaaaccccaaccctcgttgacccttcgcaaccaaatccctctctctctaaactctctctctctatactttctctctctactctctctctcctccctcccggccccatcgccgccggcctctcctcctcctcccactatataacccctctcctcccacgacccgccattgccacaccccacccaagctcacctcacctcgcgacgaagcgcgtctcattggtggtgctctgctcggtggtgtgagctctgtttcaagaaacagggggggaggaggaggatggaggaggatggcggcggtggcgcggggtgggggtgggcgacgtggagggtggcggcggtggcggcggcggcggcggtgtgggtgacgatgcacgtggcggcgaggatggcggacgcgctgtggtggcggccgcggcggctggaggcgcacttcgcggcgcagggggtgcgggggccgccgtaccggttcttgctcggctccgtgagggagatggtggcgctcatggcggaggcgtcgtccaagcccatgtcgccgcccacctcccacaacgcgctcccccgcgtcctcgccttctaccactactggcgcaagatctacggtgagttcttcgctcccgcctccgccgccgccatgtgcgcgcgcggcgcgctctgtggacatgtggtggcgtcgcagtggatggatttttggttgcatctgctgctcgatctgttccctcctcgccctgctccctctgtgttgtgtctgcttgtggccagagctcacagcttttgtctcttagttgtcagctcagctcgggttatggctttctttctctctctttcttggcgccgccattgatgatggaagtgttcgagcttgggccttggattgatggtgtgggtgtgtgttgcagggcataggttcttgatttggttcgggccgacgccgaggttgacggtggcggagccggagctgatccgggagatcttcctgacgcgcgccgacgcgttcgaccgctacgaggcgcaccccgtcgtgcgccagctcgagggcgacgggctcgtcagcctccacggcgacaagtgggcgctccaccgccgcgtcctcaccgacgccttctacccggacaacctcaacgtacgtgttacctcctacctcctctgcttcttcgtgttcgtccatggcgtgcgcgcgcgggcgggctcgtggatgagtttcatgttgtgtttgttgttgctgctgcagcggttgataccgcacgtcggcaagtcggtggcggcgctggcggcgaagtggggcgcgatggcggaggccggggggagcggcgaggtggaggtggacgtggcggagtggttccaggcggtgacggaggaggccatcacgcgcgccacgttcggccgcagctacgacgacggccgcgtcgtgttcgccatgcagggacagctcatggcgttcgcctccgaggccttccgcaaggtgctcgtcccgggctaccggtacgtcactcgccgccgccattgatccatcccatctccaaccaatccgaccccgaattgaccaagaaaaccacgcgttctcgcaggttcttgccgaccaagaagaaccggctgtcatggcggctggacagggagatacggcggagcctgatgcggctcattggccggcggagcgacgaggccgagcaaggcgagaaggccgacgacggcagcttccgcgacctgctcggcctgatgatcaatgccggcgccgccgccgccacccgcggcaacgccggcggcgagaagaactccccggcggcggcgatccccgtggaggacatgctggaggaatgcaagaccttcttcttcgccgggaagcagacgacgaccaacctcctgacgtgggccactgtgctcctcgccatgcacccggattggcaggagcgagctcgccgcgaggtgttcgacgtctgcggcgccggcgagctcccctccaaggagcacctccccaagctcaaaacggtaggccaccaccacctcctcgattccaaattcaatgccttttttttctcctccgaattttgccttgcataagggcattctcgtcatttgacaagctaacatacgttcattccttgtcatgtgacagcttggcatgatcatgaacgagacgctccggctgtacccgccggcggtcgccaccatccgccgagccaaggtcgacgtccagctctcggacgggtgcatgatcccgcgggacatggagctgctcgtcccgatcatggccatccaccacgacacgagatactggggtccggacgcgtctcagttcaacccggcaaggttcgccaacggcgcgtccaaggcggcgaagcacccgctggcgttcataccgttcgggctaggctctcggatgtgcgtaggccagaacctggcgcgcctcgaggccaagctcacgatggccatcctcctccagcggttcgagatcaggacatccccgaactacgtacatgccccgacagtgctgatgctcctatacccgcaatacggagcgccattgatcttccgcccgctctcatcacatccacccgattcgacgggcccctagccccctcttccattgtccaaattgacccaaatgcccccctctccaccatcacctccccctcctgtgtatagcccatgccaagtgacacaaaaagccaagaagcactaactttttgtcctagactgtgccttggcgccccacccaggttgccaagaataccctccttaacagaccggatcagaccagccttttttaagatttgatgacacacagcaacgtggggcccactctctgccccttcttttgttgccttgcctatggcttctggtgtatgtaattgtatagaggttttattccatgtcttctatacgagaagaagaaaattcagggaaaaaaaatatttggagaaggaaagaaaaaagagtttagtgtggtttttttgtctaccttccacacggcattcctcttcttttgccggtttctttgtgtctgtggtcggtgatcctgcttaatatacaagaactgcctaattaacaaaccaaagctctgttttcggtgatccaatttgtgcaggcatacctggcctacaacaacttaattacaagattcatcatttcgacaaagtttataagcgactgtcagttggatgtgctctgccccagtatcttgttttcttttttaacaaccatttgggctcttgtttaaaagaaaaaaaaacattcactagagaagggtggtattatttaagttgagcgtataatttgaacccagttgagtggtaaggttttggccacggcatccgtcatcgtgtggcagtatgccattcagtggttattgacgtgaccaaaaggttcagtttcaaaaagggccatgaaatatgatttaaaaacttgtggttagatagttacaaatacatattatgaaaaaagatttcactccatcccaaaacacttacagaaaagaaaaaaaaaggttttcgcgaacaccgtggcaactatatacacaagcataccaacttgcatttttctggtgccaacctgaaaatgctacagtgctcaggaacaacaaaaccccagagtttctgatcacgtgctacttagccactatccatccaggatccagccacaggtaaaaattccatcacatgaaagaaatcaaaaatagaaaaacaagatcaattaaatcaaccagctgaggcttggatgcatatgcatggcaatggcagtgacccagtgagtgagtgactgatcgagcagctagcaatggccggcactgataataatccgaaggcaggggggggggggatgagctagggcgtgtgggacgaggaggccagggagcagccaaaatccgaggtgtggggtcggtgtggccggcaatggcgacggcgagagcaggtgggggggtggggaagagagacgacggatcgatggatcgctggtgttt

SEQ ID NO: 558 - DNA, 4875 bp, Oryza sativa
ctgctttttcaatagaaattgagagacgagaggtgctgaccttcatttatttagcagatgatagaagatgtatccgcgggtgtgtgcgaatagcgatgtatgtattctttcacataataaaaaaaaaacctcatccggtttttaatatttgaagatgttgactgttggcattaaaaaatatctatttatcttattaaaaaattatgtaatatgcaaaagtatagatcttattaaaataaatcacaacaaaaataaataataatcacgtaattttttcaatataatgaatagtcaataaacaatgttaaacattaaaaaccagataaaccagtttaaattttagaatataattttttttgcactaaatactataaagctgacataagtacatagtagacacatataataagtactccctccgtcccaaaataagtgcagccatgagttttttatccaactttaatcgttcgtcttatttaaatttttcttttgaaaacactaaaaaatataatcacatataaaatgttatttatattttataatctaatagcaataaaaaatattattataaaaaaattaaataaaacagatgatcaaagttgaaaaaaaaacttatgcctgcgtttatttgggtttatttggggctgagagagtacatcacaaactttcgatcactcaagagtaagcagcacacgcaagcaaaagccttgccttcactcccctcctctcatttttcccaactgcaacgaatgaaaatgttgttctacaaaaaagagaatgaaaatgccacgtcagcacccccaagctcggtcagctgaactgaaggcggttttctcacacttcacctacctcgttgacgcctcccccctttctctctccatcccatctgaatttaccaagcagccaccaccaacagatcatcgtgctgggccggtgggccccacctccgccgccccgcttcgctatataacccccgcctcctcccgccatcctcgccttcccatttcgaatccaaacccccaacccaaccgccgccaccactcaccggcgcaaccaccggcggcgacctgatctctctgcgtttgtgtgctctgtttcaagaaacaggggaggagatgatggaggcggtggccgtggcggcggcggtgctgctgctgctgcacgtggcggcgagggtggcggacgcggtgtggtggcggccgaggcggctggaggcgcacttcgcggggcagggggtgcgcggcccgccgtaccggttcctcgtcgggtgcgtgagggagatggtggcgctcatggcggaggccaccgcgaagcccatgccgcccgccgcgccgcacaacgcgctccccagggtgctcgcgttctaccactactggaggaagatctacggtatgttgaggacggatggattttgtgtgcttgctcgtgtctgatcagatggattaatggcggtcgtcgcggttgcagggccgacgttcttgatttggttcgggccgacaccgcggctcacggtggcggagccggagatggtgcgggagatcttcctcacgcgcgccgaggcgttcgaccgctacgaggcgcaccccgtggtccggcagctggagggcgacgggctcgtcagcctccacggcgacaagtgggctcaccaccgccgcgtcctcacccccggcttctaccccgacaacctcaacgtgagtctctcctctgtttcttcatcctccgatcgatcggggcgcacccgcgatgacgacgacgacgatggctgacacgtgctctgtctctgtctctctcttgcagcggctggtgccgcacgtcggcaggtcggtggcggcgctggcggagaggtggcgcgccatggcgtgcgccggcggcggcgaggtggaggtggacgtggcggagtggttccaggcggtggcggaggaggccatcacgcgcgccacgttcggccgcagctacgactccggccgcgtcgtgttccgcttgcaggcccgcctcatggcgttcgcctccgaggccttccgcaaggtgctcgtcccgggatacaggtacggtacacgccacgaacaacccaaaaaactcccaaacgattcgccattctcgccgaaattgggctcacggttggcgccggaattcgatcgaacaggttcctgccgaccaagaagaacaggatgtcgtggggcctggacagggagatcaggcgcggcctggtccggctcatcggccggcgcagtggcggcgacggcggcgaggaagacgagaccaccaccgagctcaaagacaagcaggacagcggcttcaacgacttgctggggctcatgatcaatgccggcgtggacaggacgatgccggtggaggacatggtggaggagtgcaagaccttcttcttcgccggcaagcagacgaccaccaacctgctcacctgggccaccgtgctgctcgccatgcacccggactggcaggaccgcgcccgccgcgaggtcctcgccgtctgcggcgatgccgccggcgagctccccaccaaggaccacctccccaagctcaagacggtacgcacaccaaaccatatccatggcccagtgggggtattcccgtaattccacgccgacaaaagtctcaccttgttggttctcgctgtcatcttcttccagctcgggatgatcctcaacgagacgctgcgcctgtacccgccggcggtggccaccatccgccgcgccaagttcgacgtcaccctcggcggcggtggcgacggcgacgccggaggcatccatatcccgcgcgacacggagctgctcgtcccgatcatggcgatccaccacgacgcccggttgtgggggcccgacgcggcccagttcaacccggcgaggttcgccagcggcgcggcgcgcgcggcgaagcacccgctcgccttcatcccgttcgggctgggctcccgcatgtgcatcggccagagcctcgccatcctcgaggccaagctcaccatggccgtcctcctccagcgcttcgacctcgcgctctcgcccacctacgtgcacgcccccaccgtgctgatgctgctccacccgcagtacggcgcgccgttgatcttccggccgcgccaatctcagccgtccaattagctactattactaggtaggagtactagtattgctagctaggaaaagacaggaaagcccctgtccgttgtgtgcatagtgacacaggaaaaggccaagagacaactaacaaaaggctctgcccgtggcaggggcagggccggattccgaaaatgccctcgctaacagactagtggtacgatcagagcacaacttttagggatttgatgggtcagaaactctcagaagagaagaagagagacagtagtagggtagtagcagtagccccacacatccactgctcggttgcttccatttgttctcttctccttcgcgtggattctggtgtatgtatcgatcaatgcatgtacctgtatgtgtgtgttgtgtacaggggtgtgattattttgattcgggacacccggcacttcacagcaaaggagaattccatttggaaaaaacatacaaaaaagaaaacatagagagagagaggaagggagagatcgagatttgattaattggttgtacacggtattccagccttgtgctcctctcctttctagcgtctggtcggtgtggttgttgtgttgacaatctattcattcatcgatcgagtagaatctgtaaccgaagcctgctggagtagctcctcttcacatggtactggtactagtagcagcagcagctgcagcatatcttattgaccaatgaggttttgatttcatcaatagctagaaagcccaaacatttagggaaatgtttgtgctttagggactctcgttagatttttgactttccgagataaggggatcctctctctcccatgctcttcattctggttatggatgtactcaatgcgatgctccgccacgcctccgactccggtggtttccttccgcttaatgatcgggccttgcaacaccgcgcctccctctatgctgatgatctggtcctcttcttctccccgattcatcaggatctcgagttcatccagggtattctttatgtttttggtgccgcgtccaggctacgcaccaactttgccaaatgttcgatcaccccgatccgttgctcggctgaggacctggagttggttcagtcctgctttccctacgcggtttctgatttcccttgcacctacttcagcattccgttgtccgttcgcaagttgccgaaggcggccagcttgcaaccgcttgtggataaagtctcccatcgactcctgccttggaagggacgacttacactctggctggccattctgtgctggtccagacagttctctcctccattccggtccatgtatctatggcgatcggccttccagtctgggttattaaggccttttacaagaagtgtcgcgccttcctgtggacaggtacggactcggctcatggtgggcagtgtcgggtgtcctagacgaacgttgtcgccccaaaacttgtggtgggttggggatccctaacctcagattggcagggtttgacctgcatgttcgctggctctggctccagtgctcagggcacccctattgggatggcctgaaggccccagtcgagcaaaccgtctccgacatgttcatggcatccaccttctttttgctgggaaatggtgagtctatgctcttctggtctgaccaacggatcgacggccgctcggtggcgtccttggctctagatctcctcttcgtcgttccccagtgtctccgaggttcgcgcacagttgcttctggcctagcaacaactcttgggtctctgatatccgcggtgccctcactatcccg

SEQ ID NO: 559 - DNA, 5127 bp, Oryza sativa
ctggcaccgtgaaatacgggcctatttagatcacgaaatgaaaatttttgggtgtcacatcgaacgtttgaccggatatcggaaagggttttcggacacgaataagaaaactaatttcataactcgccctgtaaaccgcgagacgaatcttttgagcctaattaatccgtcattagcacatgtagattactgtagcatttatggctaatcatggactaattaggctcaaaagattcgtctcatgatttcctccctaactgtgcaattagtttttcttttaatttacatttaatacttcatacatatgtccaaagatttgatgtgatgtttttgggaaaaaaaatttgggaactaaacatgccctacatccaacacataactcgcaaggatctcttctcaatctcgttgtcgtcatcatcagccggcgccatgggcgcatgacacgacacggtcgactcgatggtcgatgacatgagcccatgacacgtcgatgagctgatctgatctgatcgtgagatggatcatacatgcatcatgcaaaggcatggaaccctccgcccaacaaaggccactgtaacaaaaaggccttcctccttcgcgggcggcggcttctcctacgctacagtctacagctaggcgctagcttacctgtagctaggcccgagaacccggcgcgttggctgcacgttactatagcccctacatggcgccgcggggcccacacgcagcacagcattgggaagctaggatggcgccaaacggccaaagcaacaacagaggccaattaaaaacagaggaaaaaggttttggaaattttgggttgacccgcgtcctccattacacccccgcgacggcgctgcttttctctggctttttctggctcgctctggcttctcttctggacaagataacgcatatttaccattttgccctgttccacttgcgcgtgatttggtgcctaagcgattgattagtgttataggctaggattagtagtactaatgctttgcctcttcatacacatgatgacatgctagtgcagtactgctggctggcgcctgccttcctatataaaccaacaccctcaccttgatccttcctcccacctcaccagtcaccacaccacgtctctcatcctctcttctgcttctcactgccacctcactcactgcagtgcaggctgagcacacactggttggcaggaggcacagattatattgttctcggcttccgtggaggtgatggggtggtgggggtgggcggcggcggcggccgcggcggcggcgtgggtagctgtgaaggtattggaggtgctgtggtggcggccgcggcgggtggaggagcacttcgcgcggcaggggatcacggggccgagataccggttcctggtgggttgcgtgcgcgagatggtggcgctcatggtggccgcctccgccaagccaatgccgcccccctaccgctcccacaacgtcctcccccgtgtgctcgccttctaccaccactggaagaaaatctacggtaatcctcctccacctcctctgcttcttaattcaatcctatctcaaaaacaacaaccaagaacaagacgttggcaagtggcggtggtgggcgagcgatttgctcccgggagatatgatatcgatatgatggcggctttaggtgacatgcagcattaagtggcatgtcgagcggctggtgttgtctgtcggagtggtttgccgtagttgtctctcgttttcgctgtcccctggttgcagcttggttaggtagccagggtctattccctaccccagaccagacacacctccctttctgctccccctcgccaccccccgactccgacctctcttgcaattgcatacatccccctcaccatttactctagctctccctgcgcccggccccgcccggccggtcccctatctctatgtgcgaatgattaattgtactagtatcaatatacgtatactaattgtagtactcatagaaatacgtatgatgccgtacgtcttctccagcagcggttgttgggtgctgaattgctgatgtggtggggtgacatgacgcccggcgtcccaatcattgggcgctttgtttgcttgcgaatttgcgttcgacctcacactaggactctgtccacaggttccacgttcctgatatggttcggcccgacgccgcggctggccatcgccgacccggagctgatccgggaggtgctcctggcgcgcgccgaccgcttcgaccgctacgagtcgcaccccatggtacggcagctggagggcgagggcctcgtcagcctccgcggcgacaagtgggcccaccaccgcagggtgctcacgccggccttccacatggacaacctccgcctcctcctcccctgcgtcgggatgacggtcctcgacatggccgacaagtggcgcgccatggccgaggccgacaagtccggcgaggtcgagatcgacgtgtccgactggttccaggttgtcacggaggacgccatcacgcgaacggcgttcggccggagctacgaggacggcaaggtcgtcttcaagctccaggcgcagctcatggccttcgcctccgaggctttccgcaaggtcttcatccccggatacaggtaattaaccatttctctctctctctctatctctttttaatttatgatttacctctgctctgcatgattgatcaggctgataattagtattagtattcagtatgcatcgatgctggttgttggtttcactgtgcaatgtactaattaatggaagcaaattgatcccgtgtctgccattgtacagattcttgccgaccaagaagaacacgagctcgtggaagctggacaaggagatcaggaagaacctggtgacgctgattggtcggcggcaagaggcgggtgacgacgagaagctcgacggctgcgccaaggacctcctcggtctaatgatcaacgccgccgccagcagcaacggcgggaagagatcggcgctaccggtgagccccatcacagtaaacgacatcgtcgaggagtgcaagacattcttcttcgccggcaaacagacgacgtcgaacctcctgacatgggccatcgtcgtactcgccatgcacccggagtggcaggagcgcgctcgccaagaggtcctcgacgtctgcggcgctgacggcgtcccctctcgcgagcagcttgccaagctcaaaacggtaagccacctgatcaccttgcattgacatcgaatattttctcagcgtccggcgagctgacgctgacttgcattgcagctcgggatgatcctgaacgagacgctgcggctgtacccgccggcggtggcgacggtgcggcgcgccaaggcggacgtggagctcggcggttacctgcggatcccacgcgacacggagctgctgatcccaatcatggccgtgcaccacgacgcgcggctgtgggggcccgacgcggcgcagttcaacccggcgcggttcgccggaggcgtggcccgggcggcgaggcacccggcggcgttcataccgttcggccttggggcacggatgtgcatcgggcagaacctcgccatcctggaggcgaagctgaccgtcgccgtcatcctgcatcggttcgagttccggttgtcggccagatacgtccacgcgccgacggtgctgatgctcctccacccgcagtacggggcgcccatcgtcttccggccccgctcatcatcccaaccaacctgtgaaaagatgaacccgctaaccagcagctagccgtgtcagtgtcaggatgtcgttgctctcacactctctctatccatccgaagagggaagcagagagatcgtaggaccaagttgtagcgagagaatgactcacaattaaagaaacgaagaagaagaagcatcttttactgtactaacaataattaacctgcctgcagacgatgaggatccatgcatcagcagcagcagcagcagcagcagcttagattaggataggagtttagaggccttgagctggctgtatgactgtatctcccaatttttttttgtctgcattctagtttgatgatttcttccttggattggagggagggttttggtgatcagtttggtgtatgaaatgaaagattgcaaagtgtacacatgccatgtccccatttgttcctgaatttcgagtacatgctgaagagaggctcgatcgatctgcctctctatgtatgtatagatgtggtcctcgtgcttgcagagcagagaccattaaaggaagaagagatgggggcactggacactggttagtgggtactcgtatttaagagtgccttggaaggggaacaaatggtgtgccacagatgggcaagcggacaggtttgatcatcgatccattcattcattcattggcactcacacacagcatcatctatgctctagtagtgctctggcctgcctggatcacaatgtccaacatgcagttgcaggcttgcagcacatggatgtccgcatacaaggcgtgatccgtgatgtacggtttccgggcaagctgtctactgtcaccggccaagccgcgggccggcggccgaccgaggaccataactgtagctgcgatgagctgagctgagcggagatgaaccgggcctcgatcgtctcgtcataaaagcgtggaggaggagggctggggtcctacgcttggccatgcagtgccacactattcatctcctttgtcagactgcgctggctggctgccacattgtaatcgtattagcaaacagaaagataggttgtgtttagttcagcgcaaagtttggattttagttgaaattagagataatgtgactgaaaagttgtgtgtgtatgacaagttgatgtgatggaaaaggactgaagtttggatccaaactttggatctaaacagaacttttcagtcacatcatctctaattttaaccaaaatttaaactttgcgctgaactaaacacagccatgataagcagccacactcccgctgctggaatactatggcctggcttgcaatggactccactgtgggtgctgtgctgctcttgggatctggatcatacaaacaacagctcagagattcatttcatcccgagcacacaaggactcgctcctctgcaggctggattct

SEQ ID NO: 560 - DNA, 4912 bp, Oryza sativa
acgtctaactattcgtcttattcaaaatattatgaaattattacttttttttacttactttattattaaaagtattttaagtatgacttatcttttttatatttgtactaattctttaaataagataaatagttaaacgttgtaagtaaaaagtcaaaacgatatctaatttgggaccgagggagtactagcatgccccccatagtgttcttttagagcctataaatttcccatgcttcaagccgaaaagaaaatagctgtagcttccctggaaagaaaaataaacctaaactctctctttttctttaatagtagagcacaacatgggaggtccccactaaagtctcaaactctcttagcttaagagcagcagttttctttttttaaaaaggagaatttttagaggaattttgtaggattggattaattattgtaaaaagcatgtgaatttcttgcattcgaagcaagccttcagtttcctggtggtccaatataatacctagataaggtgtatgtagtgaatttattcctaggagaatgttaaaccaaattggtcctcggaaaaaaagaatgatcatcttaaagtatgaactccaaatatgccctaaacttgcggcacaagctgagtttcagtcgtatcactgtagcccaatcacgacatattatcatctactaaaaggaattcccataaccgaatcgctgatcatgctagacaaacactccgatgaccaaaaagactaccagccaagcgttttttacacagcagcaaaaaaaaaaaatacacttgcttctcattactcacagatccaaaaatgaaaaatgaaataaagaaagaacaaaaagaaaaggaagaaaagaaaagaaaagaaaaggaggagcatatcgtaggtgtgcatgtcagcaatgaaggatttgattgccaagtaaggcgggttgagagggagagatggtggagagaatcaaaaaaccgcacccctgcggccacaaatccatcttgtggctctccaccctcctccgtgggccccaccacctccacccccctccctccctccttaaaactatccccaatcccatcgcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggttggtgtgttttctggcgatcctttttgtgttttgtagtatcgttttgagggcttgagaattcaagcgatgtagtactatgttgtgatctggtgatgtggcgatcggaattagcggtcagttcgggataattcgattggtttgttttgcttggataatggggagtgatttgattgattgattaattttggccatttctttggtttgaacatgataatggtgatcaaccgggagtccatatattggtcgtgacttataaggttgtatattaaattgttaattggtaattaaaacggtataatcttgagtgtacatacatgccttataagtctgaggttggtgtgtttctttgactttcttattatttttcttttcatttttggggatatcaatgtgagtaggcgtgtttagtttccattagcgaaagaatccttcaaaagtatcttgtttttgcttcgtttccatgctttccttagatagtatcagttaataatacaggaattagctatctgaaagatggaaccttcttgatgagtttctagactgtgcagactgtttcaattaggccttttcctcggccttccatgttttttttttcttttttggatgaaagcagagctgcttcttttcttagcctacagtactacaaaagtttagaggcatatgtaactagatttaaccaacacaaattgcacaactttattttcatttcctaagctagagatcagaacatgtggccttacaagctatcagttacataatcatatcctccagtgttttactagatcaactgaacaaactgaaacaatgaacaaactctgtcacagatcttcctggtacaataacctgaacacaaaactgtccatgtgggcttatagtttccaactgaacaaaattgcaaatttaacacccaaaaactcatcaagtttcttcacatgcttgcaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttccttttgcagtagtatctgaataattcgtcgctgtctgattccagtgtattaaaccagtcccactgtagccctggaaatgtgatacttttctgcatatattcatcttgtttcctatttgtctatttctttcggtatcaggattggcagagacagcagaaacagtatccaaattttctttgttccctttatctatatatccttttgtttctctctctcttttcctgtgtttctttctacttttcaattgagataattggatcgtgaaagtgatgcaaaaagtagggaaggcacgaaagaaagcaagaaagcgatagacaactactggatgtcccactgaccttaaatgtgagagcggaatatatgttatctccttcacacatactgccgactgtcccgcagaaaaaatctaaccaataagagaagacgaacacaaaaaataaagttttaggtccgtgcaaatttccatgtgattatctgattggtgcacttcagtactcagcatgcgatcagaaaaagaaacattatgttctgacaaaagaacaatagtttctgattaagcaaaatgtgataattaccatagaataattaagaacaaaaatgataaaaattccattctccataaaacattaaacttcgaataaacagtatcaaaatatggaaaagctagcatgcagtaattggttcagctagacatgtgtctgtaacatatacaaatttgtttacattatttattattgcttatataaacatattatggatggaaatggacgagaagctctaccaatcatatcaagaaacatattactggtagatactcctaaaataaagtctcacatgcattacagaaaacatctaagctttgaaacgttttcaatacatgcattattaccaccattcgacctgcctttcactcattgacatctggtagtgccacttccacttacacggttttttgaacggaacttccacctacaccattggccagccaacttactaagccagcatgtttgaccttaaatcaaaattccaatgtgcaccttatttctagtctatatattgccagggcacctttttttttgtcaccaactccctcggg

SEQ ID NO: 561 - DNA, 3481 bp, Oryza sativa
tcacccctcatatcatcatttacacaatattttaacaaacatatctatcacttttataatatttaacatatagttatcaatatgtttcacactaaagcacaggtatcatttgactgataaaccctgatgtttctcttttatttctttttactcctagcttgattgtaatatatatatatatatatatgtatatatatatatatatgtatatatatatatatatatatatacatatatatatatatatattgaatcgcttagaaattcccgcagcaaagcgcggagaatcacctagtgtgtgtatatataaatatacacttcctattgttttaaaaaacatgcatgtgacgaatgctagcaaatctgaaaacggcgtcccatttttcttcaactcgatcgactctagtagatcccagttaacttttcgcgttcccatatgtagataagtatatatatgaccaaattcgtgtattactgataatatactttgatcattctagatcaggaacacaaatttcaacacacggtcccggcccctttgcacctaccagtcaacaagcagtaccaggtcttcaccctggctgtctcttatcgagtgatcaattaatcctagctagtcccatgtagctcagtcgaaacttcataattcagctgaggtagatgaactcatattcgtcaaaggcaaatttcttgcgttccaggtaatctaataaagaccaggtgatcttctttgtggttgaatcgtgacaagtcgactgccgccagtggtcgatcgtaacagtcaactctaggacaggtgtttcgttgcctagcatagtgatgaacttactatgtcatataaacagaagatttagtacgtagctggtgacgacaaccatatatatcttgaagaaaaatctcaaacacgacgtagaaattaacacacggcgatcgagtatatttgggcagcaataactataaatagaaagccccacctccaaatgagatgcagacacacatctcaaggcattgtgcacgtagacacgagtgagctgtttaattgagacttcgtgcagtcgtgctcctatcttctcattaggatttaacttaatctgatcagaagatagtatatgcacacgtgagtgagtttggcggttaaagtgcggtgacagtctgagagtgcgtgcgtgtagttttcaaaagaaaaaaaaagtgcgtgtttcctagttgaactcgtaatagaataggagtagtaaactaaggatacgtggcactgatggaaggcagccgcggtgacaagggcaaggtagtggtggtgatgggcgccacggccaccggcaagtccaagctggccatcgacctcgcattgcggttcggcggcgaggtgatcaactccgacaagatccaggtgcacgacggcctcgacgtcgtcaccaacaaggtcaccgacgaggagcgcgccggcgtgccgcaccacctcatcggcggggtgccccccgacgccgactacggcgtcgacgacttccgccgcgacgccgcgcgcgccgtggcgtccgtcctcgccaggggccgcgtccccgtcatcgcgggcgggtcgaacaggtacctcgaagcgctgctcgacggcgagggtgggtcgttccgcgagcggcacgagctgtgcttcctgtgggtggactcccgcgcgccggcgctgcacaggtacgtgcgccaccgcgtggaccgcatggtggagcaggggctcgtcggcgaggtgcgggggctgttccggctggacgacgccgactactcccgggggatccggaggtccatcggcgtgccggagatggacgcctacctccggcaggaagccaccggcgccctactgacgcacggagacaagtacaaggtcgcgctgttggcttccgccgtcggcgagatcaaggcgaacacgtggagtctggcacgccgccagctgcggaagatccaccggctccgcggcctgcccggctggagcctccgccggctcgacgtcaccagagtgctggagttgaaggtggaggcccgcagcgaagcggagtgcgccgccgcgtgggaggcagacgtcatcgcgcctgcggcgcgggaggtggggatgtttctgcatggaggagggaatgtggtggagagcggtagggaggagcagccggtggtggtagagaagatggaggttgcggcagtgggtggtgccggtgcggcggcggccgcggagaagtggtgtggtcggcggttgctggagacgacggcggcgtaccatggaatggaggcggccgcggcagtttgaccagttaataacgtcggaagagtagtacatatatattcatgacgtttcatggtttggtttggttaggttagctggcgattattttattaattaattgtttcattttttaataattgttgtatccatttaataaactcaacctgaaggttgattttcggaatgtaagtttgcgtcacctcttctcaatatactggagaatgtcagctcatttttttcatcaaactcaaacaattataaaaaaatcactaccgtagaaaggcaacaagtgccggttgggaaaccctaattggtgctggtttttccaatcggcaccacggaagcagtatggatgacactggtcatcggtgccaccaaaaaccggcacctatatagtcctaataggtgccggttctaagccaaaaagacacgtggctactaaattggtgccggacctagctaataggtgccgattctaatgtaaagagacacgtggctgccaaatagctgccgtctggtaatgaaaaatcggcacctatatgttgggtaaaaaaaataaatattgcaggaaattcatccatacaaccctaattccatacgaccccaatttcatccctaagtcaaaattcaccaagtctaaaaactcatgggtccaaaaattcctatctttaaatcctaaacatttcaatatatattctaactcaaaatatgctaagtttaaatttcctaaatcaaaagattgtaagtctaaaatttttgaagtctaaaagttgtgggctgcggcctgctaacttgtcaaggcctagctcgttaaggctcgcgagcagctcgagctggctcgttatctctaacgagctaaaatcctagcccggcttgttagaaaaatgaagccgagccgggcttgtcacgagccgagcgagctaacgagccacgagcttcctgtccacccctacttacatccattgtaaactagagttttggagtccttcaccatggttgtgatcttgcgatattccctattatcagtgccaaacctctccccatcgcgcagcatctgatctagaataggttcaccatgatcgacacacgtttggtcctcctcctcctcgcagccgtcatttgcatcatgcccgtgatagttgccggcacttccctcaccttgctcctcctcgccaaggaagttgcccacaaaaccccttgtaagaagatgtgcatggacctgtt

SEQ ID NO: 562 - DNA, 4095 bp, Oryza sativa
tattgcaccactggtcaggaaaatcttttgccttttaacattccgtaaataaatacccaatcttggccaggaaaatcttttgcctttaacattccgtaaataaatacccaatctattttgtcataggctttttcaaaatccaccttgaagagaatgccactatatgttttttctggtgcaaggaattgagtatctcatgcaaaatgacaaccccttccaaaataaagtgattttttaagaaggctagctatttggccttttgagatgatgtattgcattatctcaatttctgttcatcagtacttttgttatgattttgaagctaacattcaagatactcaattatacttatactttcacattcttcacttgcgtcgtgtttgacaactttgaggaagaattaggactaatctctccgagtgatgagactacactgagagccacacaggcgccggtactattgacaacaacaaaggaagtgtcgaattaccaaatttctccgaatgatgaactggtgtcctacagtccgatataatgtgcagaccaccgtgctggttcagttcaacaataaagctaagcgctacacaccgagataagatcagttttgttgcccgaaacaacaagtagatgaactgtccctttcatgtaccctaagttttcttcaagaaatggactatgaagggaagaaacagatttactaaacaccagaaatttcgcacatcatcatgtctctgtcccacaagaaacaacaatggtccgagatttctcgcacatcttccgaaatgtttcgtgtcaccaagacatttgacatatataagagacacataaatacatttatattgatcttttcatttttctttccgggtgtgacagaaggtgtgtgtatacatgtgcacctaagaattggaacaagttagggcggtaaagttgcccaacaacctgcccaccatctgctcgttttcgcgctcttttccatctatatagctagctgatcgatcaactgccgaaccactccacaaaaacaataacagggccagtgtgcttatctaaaatcacacctgaatcttgccaaattaatgcctatttgtttctgatccctagctttaaaggctgaagctgctgtcagctgtgttcgcgcagcagcaagcacaggcagcatcatggcgaaggtgcaccggctgatgaacgccgtgctccggctcgccgctgcggcggctgctgcaacggcggcggtcgtcatggtgacgagccgtgagaccaccagcttcttcggcattcagatggaggccaagtactcctacaccccatcttttatgtaagtagaacatattacatatatatacatgttgttgattaactttgcctctgtacaaagttgtcaaaatctcaattctgtcatatgatttatgactttacgattctatttaaggtgcctgattctcctatcctacatatagaatctacgattttgtgatttttacgtatatgattctatgattatatatggtcctacttagaacatccgatttcgatttgagatcacgatttagcaacattgctccaatgccatcgtcggttgagttctctgcacgtactgttgtgttctgtggcagcttcttcgtggtggcgtatgccgtggcggccgcgtatagcctgctcgtactggccgtgccggcagggagtgccctctccagattggcgctaacaacagatgtggtactgtctcctctctgttttgtaaatttacttacaatattgtttgattccctcgtttcatcgattcattctaaacagcaagataatgaatgtccttcttttcggcattggactttccaatcaattaattgatggtaaaactcgtaaagatcaactttgcgaaaattccattgtatcctaggagcttgtaactcataactcattagaaaaacaaaaatgagattctatataataagttgttgatattcaataactcgtagaaaacaatcacaaaatctaaacatttattagtttatccataaggcgatcccgcaatacattatagccattttctaatcgaaatgatcaagaaagatgattcagtgttctctactagtagtattatactactagtaaaaatgatctgaaccgttcgttaccaagagtaaatcggtaatttactaatacagttattacgggtaactttgttatttatggttttccccggctaaatcgatatgtggtcattcattgtgttggtattgctcatattctatctaaaaagctaaaaaaagaagaaaaaaaaaggtttacccactactaaatgacgattatgtcccttcacactttttttttttttgacaataatgatcctcgacatttctactgccactatctaaggtgataatataaatagatacaaacccttcgatcaaatgagatcaacagtttataaattgttttctactacaagtagaaagcaccatactaggctcacattattccgtcttttaaaatgaccagatttatttatactaaattgcacggatgatcctaaagcttgtcgcatgcatggtatcatctggtaaaaaaaaagattgtagaaccagttttcgatcaatatttctccgtccgtccatgtacgcaggtgttggggatggtgctcgccggtgccgtggcctccgccggcgccatatcggacatcgcgaagaacggcaactcgcacgccgggtggctgccggtgtgcgggcagatacacgcctactgcaaccacgtcatggcggcgctcatcgccggcttcgtcgcgctggccgtccacttcgtcgtcgtcatgtactccctccacattgtcaccgatgtcatttgcccctgccattagcagagtctatctatatatatagtccatagtagcagtatatatataggtcgtgatatatacttccatcaccaaaaattcgggtacgtatataccattttattttctctatatctatgtctcaatttgttaaagttatgtttcagatggcaactacattgtgatctatggtcctctgtatcttgttgttacttgttacacacaagatttgaatgaaaaatacccccacgatgttccagaaacagtacagtacagattctagccattataacgtttcgcagaatcttcaatttttcaaaataatgcagattctccctccagattttgagaatatgcagctataaaattcaaaaaattaattgggaatccagccatttttagattctcagagattgactatcaatcaaccgtttctcaaaatcttacactctctgaacaaggcataggcggctccaaaatctcacaatagacatttttttaaaaaaaaataatcagtctttgacaatttatgatacgcatgtttaatttgtctttgactattcttccatgatttattaaggttgtccgtactgtatagtacggagtcagtgatgatatggtataaagaaaattgaggtcattgacagtgccatgttgccaatataagactgagaaggcgttaggtgagctaattttgatattgttacaccaaaacgatcacctgaacatgtactttggtgaactacagtaccatgtggccatgtgttctttctaaaatgaactctgtctgggtttaatcagagattgtgacaaattgcgtaccccagtttcagcaaaagaaaaaaaaggtaatagtactttcccaaatcatactaagagaacgtaataaatagacaagtaacaatgctattcagatagtatcaaccaaatatgcttcatggatcgaagctggataaaacagaattaccgattcatgcccagatacagtagccagttggacagggtaaatcgaagcatgcaacaatgataaggaaatgctatgtgcaggaaaaaaaaaaatctagaattggtcatgctttgagaagagatatgttcaattgtgtattcaacaggtgtagccctgtagggacttgagaagcaacatgattgttcaatgtttcatggaatgagagatattatcatacactccaagtctccaaccatcagtgtggacatattcttcgcccacatgaaattttaattccagcagcaaggcacctactgta

SEQ ID NO: 563 - DNA, 6347 bp, Oryza sativa
ataggtaatgtattgaacatactttcgtgccagtaagagttaaggacggtacgtagagagtagtgaactgttatgtttgagctacaaaaggaaatctagagcttttgctccagcaaaaaggagcccatacatacatgatcgtcaagagatgacttgtcttggttagcttgagcctgaaggttaattgcttcactgttcagcataccagttgcatgctaccagctagtgcccacaaagtagaatctagaaagcgctaagctttcggactctcaacaactaacaaagtcgcatcggcttacacccgtaccttgccttgtaagagaatccttatattgctaatcctcctgctccatctcgatccacataacgatccactgttaattcgtccttcgacatatggaagggtctgtgcgttgtccctgtcgcctttattagctgcgtgcaattcctttccagcacagtaagtgacctaatcaattgtagttaaatccagatgcttccagattatgcacttaactgagatcaatccgagaggccagtttgatgcgggttgatgagcgaggtgtcctgcaggtgctttggtgaagcacacctgctccatgactccatcccctcaaatgttaaactcacatgcatgtactatacagttttttaaaacagcgtttttcagaactcccaggtcatgtttaaaactgaaaaaaactatttctaaataaacatactacggagaataaaaataatctgaagataatctatcctagtacgagagtaacagtcgtatactaaagtaaagtaaactctgtacaaaacagtggttgataaacacagtgactgactacgaatattaaactctgtacaaaacagctgaaactaaagatccgcacggcacaactgaaactgcccttcctaaacccagacgaccaaagatcaaaacaaaaacaaacaaaaatccacatataagattgtctcgtaggcgtccatcgctatccccacccaacaccacactacaacggcaacagtagtagtagtacctgattatccatccctaacaaatcccacttccccacacacgccaaaagcctctcctctcctttcctcctcctccagtcctcctcactgtccgtcccaagaaccactcggtgcagccgccgccgccgccgcagccagtgccattgcaagaatcgcgagggggtattgaggttgggcggcgagatgagcatgtacgggagggacccgtggggcgggccgctggagatatgccacgactcggcgacggacgacgaccggagccggaacctggacctggacaggggggcgctgtcgcggacgctggacgagacgcagcagagctggctgctggccgggccgggggaccagggccggaagaagaagaagtacgtcgacctcggctgcctcgtcgtcagccgcaagctcttcgtgtggacggtcggggtgctcctcgccgccgccgtcttcgccgggctcgtcgccggcatcgccaaggccatccccaggcaccaccgcccgccgccgccgccggacgacttcaccgtcgcgctgcgcaaggcgctcatgttcttcaatgcccagaaatgtgagtgtgcttccctccctgccgcctcgcgcgtcggagtatcagatcatttttttcctttttttgtgagttctcagttgtgctggattagaaatggtgggttttttttggcgatctgggcgatttatgttcgggagcttttaggatttgattattgtgcgtttgagctttgccaagttctgaagattcgatttttttttcatgcttctcttggtagaataggaaagaccggattttcccgttgtttctcccggtgatcttgtggacaggaagtttcaagtctttagcttggtttccggtttcttccgagagttacgatggcttgagagttgagacgccggcttcagagatgggatttttattttattagcttggatttatttttccggtgcttgaaatgggaataactaggcaccaaaccggtctgtccatcagatccatccgtaaagattacaggagtttatctagaagaataatatgtccaacttaaagatcacattttgatggtacttcccatttgtgtatttgctgcagctggaaagcttccgaagaacaacaatgtgcattggcgtggtaactcgtgcatgaaggacggactctcggatccggcagtcgggcgcagcctcgtcggagggtactacgacgccggcgacgccgtcaagttcaactttccagctgccttctccatgaccctcctcagctggagcgtcatcgagtacagtgctaaatacgaggcagttggggaacttggccatatccgtgataccatcaagtggggggccgattacttcttgaagaccttcaactcaacggcggataccattgatcgtgtcgttatgcaggtaaaacaaagatgcaaacatggatatgtgcagagggattgtagttcttgccatcagagccattgctaattcgagattttatggtgggtgcaggtggggagcggtgcaacatcacccggttcgactcaaccgaacgatcactattgttggatgagaccagaggacattgactaccctcgcccagtagttgagtgccatgcttgttcagatcttgcggctgagatggctgcatcattggcagcagcatcaattgtgttcaaggacaataaggcgtactcgcagaagctggtacatggtgctaccaccctcttcaagtttgcaaggcaaaaccgtggaagatatagtgcaggtggttccgatgctgcaaaattctataactcaaccagctactgggatgagtttgtatggggtggttcatggatgtatctcgcaaccggcaattcatcgtacctgcagttggcaacacaccccaagcttgcaaagcatgctggtgcttactggggtggtccagactacggtgtattcagctgggacaataagcttactggtgcacaggtaattgcatttgttctcttctgtttaagtaatgatatagacattccccaggttgacccattggcatttaatttggtacttggttgatgcttgacatgaatattccgtatctaacatgctgatcattataatataggactatctgttgaatcaccaattttgtatataatatgtgaggtggtttagttgcagtagctatcttgtgtggagtcaacttgttatgtggtatatcaagacctgaaatgtagagcattagtaacaattatagagaaagaggtacacaacttgtatgatatattaaggtttggaacaccgtcagtgttgtcctgtctcccttttttgttctttggaatttcctaaaaatgtgacccatgataacaattgttttcagcatgcaacctgcatttgggctcatcttttaaataaccagttctggtaggtttcaactatgtgtgtcaaaagaattggtcacacttctctctagtttaacccgttgaatcatagaacctggtaacttttgtgtatatgctatttcttaaccttcaagagctaaaattctttgctactccctccttccctaaatgtttgacgccgttgatttttttaaacatgtttgaccattcgtcttatttaaaaacttttgtgaaatatgtaaaactatatgtatacacaaaaatatatttaacaatgaatcaaatgatataaaaagaattaataattacttaatttttttaaataagacgaacggtcaaatatgtttaaaaaagtcaacgacatcaaacatttagggatggagggagtacatagcagtagctagtaaaaaaaatccagatgaacaaataaacggatttaacatatcaattggtacttattttatggtctgtcattacaggttcttttgagccggttaaggctcttcttaagtcctggttatccatatgaagagatcctcaggacattccacaatcaaacaagcattattatgtgctcttatcttccaattttcaagtctttcaacaggacaaaaggtttgaccttgaactcactgaatcacacagtcacacattggtttgtgaacagttagttacttaggccctgtttagttctccaaaaacttttcgcaaaaacatcacatcgaatctttagacacatgtatggagcattaaatatagataaaaagaaaaactaattgcacagtttgcatgtaaatcgcaagacgaatcgtttgaccctaattagttcatgattagccataagtgccacagtaacctacatgtgctaatgacggcttaattaggctcaaaagattcgtctcgtggtttccaggcgagttatgaaattatttttttcattcgtgtccgaaaagcacttccgacatccggtcaaacgtccgatgtgacacccaaaaattttcatttcaccaactaaacaggccctattattattgtatttcaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaagtaggtttgcagagtttaaaatgttggaatcttgtaattccagcagtttttaactcctgatactaattcactacttatttcagatcgaatacatcttaggaaaaaatcctttgaagatgagctatgtggttggttacggaaaccgttaccctaaacgtgttcatcatcggggtgcctcgatcccaaagaatggtgtccactacggttgcaaaggaggttggaagtggagagaaaccaagaaaccaaaccctaacatcatcgtcggagcgatggtagctggccctgatcgccacgacggcttcaaggatgttcgcaagaattacaactacacggaagcaactctagctggcaatgccggtctagttgcagcattagtagcattgtcaggtgaaggccatggcgtggataagaacactatgttttctgccgtgccgccgatgttcccttcgcccccaccgcctccggcaccatggaaaccatgattggctgccactatctgattctgattcattttgtatacggcttatttagattagtgtttttctcccttgttctggaaatgctgggggaaacctaacagaaaagaaggcgtcaggtttttatctttgtttctcccattgttgtatacttgtataatccccatgttatgtaacactattgctgttctggtatgaacctagtaattaatactatctttcctcgtggatttgtgggagttagatttttaagactctgctttcttgaatcagtctatgaaacggcaacgctcatattaacattcacgtcctaacccattcgatttgtactctactgagatgaaactgagtaccacacttgggccaaaggtcatgaataatgatgattcttgcaacccattttcattaggaaaaagtccaccttcactccctaaactaatgaccaaatttgattcgtatccttgaatcgcaataccagatatatcgaccccccaaagccccaactattaaaaccggtgtaatttgactcccttacgtttttagagggttgtttcgctggcgtggcgcatacgtggcggtattgacctggtcttcgtccaacgtggcattgatatggtatgctattataatacatggacccatttatcattcaaaaaaattatgggccactgacatgtgggcccacatgtcatcctctctccttcccttcttcctcttccctctctcccttgttcggctgtgtgcactgtgtgcagggagtgggtgctggagcggcagcagcgacgacgacgtcgtcacataggcgctccgtctcgaggcagcgcccgccctcccgccatcattattgcagaaatgcagagccaattttactactaattccacaatacgaattcaagcacaagtagaaatgcagagaccgcaatggttctactcctagatcgcactcgtcgccgccggagctcagaccttggttgcctctaccgccaccgtcacccgaggggcaaggacagggggagcgggaggcgtcgtggcattggccttcaccacgcgccaccatacccagacgacaacgagaccggtgatgagcaaggcggccaagacgatcacggcggcggcgatgaccattgcccaagcattcgtcgcgtgagtgacacccctacgccgacctctagtcttccaacacttataatccatcgtgatcgtggtgggggttgtcagaggctgtaaggccaatgaggttcactgccaccgc

SEQ ID NO: 564 - DNA, 3935 bp, Oryza sativa
gcaggtctaaggtctctctgactgattggttttgcttcgctctcatgaaattgtttcatagtatgctctagaacctggtttaactctagattttgggaactggctgtcactagtttactcttatctgttaactccagtgtagctttgctgacctcaaagcagcacagctgtgccgcagtagttagatgttgtcttatttgtcatacatagtacttatcttcagaaattgtgcctgatctggcttgtaatcaaggacgggtcaaatagtttgacatcatcatgccctgctgtctgctagaacatgtgatgatatcagatgaaaccgatatactcctacggataagagttgacagagtcagcaatgcatgctgcatagtcagatttgtggatttttgctgtgataaaaatatatgacaggacagagtagttctgcacttgttgaccacttgactggctgatgctattggcctctgttatattttcagtctcttcagaatatttttcttgcttaatctgctcaataggaaagtacttttcttcagcatgtatgacttaacacattaggccgattatggccggcccatacactttttttcattggtgggcctctgggtcacagctgatttaagctgggccgtagatgggcttactctatgaaagagctttgaggcagagcatttaataagcttgccgtggacccgtggtacgtacgtacaaagtgagctaacggggccatcatgcatgaatgcaatcaccttagcactgtgctaagatatgggcgtcgccccatatatagcaagttgaatgtcctaatcttaagccatgacacaatcatatgacacaccccccaagttattaattcgtatccttgagggattccattacaaatctgacgcaaccaatgtgcaaatttaggcctctatcgcgtaccgcacacggtacagatgaagcaccacgctcgacaccaacataaattaaaactctgtactgtacatcatgtaatagcatattgatcacacttaataagcatgtatcctctcagttctcaggtgttcatcactggctctcttctcttgacccttaccaagagcccattcttcatgtggagtatgacggacagcctcggctccacgacgtgccccggcaccacctccacggcaaagttccacgccatggccgccgccgtgaccttcatctgcacgagcgccatctccttgccgaggcatgtcctcggcccggagttgaacgcgacgaacttgttcgacggcacgtaccgcagcttgccgtcctcggtgatccaccgctccggcctgaactccctgcagtccttgccccacacccgcttcatcctccccatggagtagtagaacaccagcaccttgtcgccggccatcacctcgtgcccgctggggagcacgtcgtcggcgaccgccgccttgtgctccaaaggcaccggcgggtacagcctcatggcctcgcaaagggccgcgtgcaggtacaggaggttcctcacctcgctcgcgtcgaacgtcaccatgccgccgttgccggggaagagccgcccctgctgcagctgcggcttgcgggaagcgatgggcgccagctcctgcaggagcttctgctcgacgcgcgggttcgtggagaggaggtagaagaaccacgacagcgccgagctcgtggtgtcgcggccggcgacgaggaggttcatcgccatgtccctgatgtacacgtcggcgtcggcgctgccggcgatctcgtcgtcgcagaggaaggaggaaagcaagtcggcgaccgattgcttgtcgccgcctccgccgccgccttgtctggacttgctctcgtcatcggctctgtgtttcgcgatggccgacgcgacgaagctctcgaccgtccgcctcgccgcggcgttcctcttctcgtgcccaatccctagccatctcatcgtcttccagaacgacactggcatggtgtggcggaggaagatcgtccgcagcacgtcgtccatcgcccgtgcgaaggggacctccggcaggccgatgtccaggcagccggggtcgacgccgaacaccaggtggcacgtcgcgtcgagcgaccaccgcgtgaacacgtcctgcaggtcgcacgtcttccgggcgtcggcgacgtgcgcgaggaaaggcaggaggcccttctccaccttgtcgaggctggagcgcgccacgaaggcgcggaaccgcggcgtggtcatgagcatctgggccttgttccgctgccgccgccaccgctcgccgtcggtgttgaagatgccgccgccgaggacgtcgaacatgtcggcgaacacgtcgcccttggggtagttgtcgaagttggacgtgaagatgtggcgcacgttgtccgggtcgcaggtgacgaagaaccggaagccggcgagccagaagcggcactggaagttgagctgcgacgtggccagcaggaaggtcacgccgtcgaggaggcggtgcatgttggcgacgatggccgggagcacgccgacgatcggccactggacaacccctaggctacattttttcatggatttaagccgctgatatcggtagcagatgacgagcacgcatactcctgacaggagaagctgcaagacgaagaacaagtcgaacaaattcatgttaccaattgctgccatgcatgcacacgcgcgcgaatgcagcacgtagctatctatagcgcagtggagtgcaacagttttgtgtgtggagctatctcatggggatgcggcggtgcttatatacgcgcggccaaggtcgatcgatggcacaatcaatcaatgctagctatcgctgccaacagttaacagaacggtttgattgattggttgtgtccatgatgatccgaagatgctcatttgcatgtatctctattatctctctatagtgatatcctggatggcaccattagcaaattatgtcatcaacagtggtaggtagcatgcgtgcatgggttcggccggtgtaattaattatgctctaatccctacacatgcgatacgtgatggcttggcatagatgcatatatgcttgcaatgcaacggaaggtgtgtacatgcatctcatagaggtcctagagggtgcgtgcaatgcggagggagcgacgagaataatgcaggtcgctgtaagacatcggcaatttatttgtaagcatgggctgtgtatgattaatcgcccgtaccaatagcccgctcctgcaaatcagaggaccatacttttctgactgctcaccgactgcctgactagctaattcacacgatatgttggctccagccggcagcggcacggtcgttggagccaccaccagcaccacgcatcgtgagttcgtgaattgatcgtgaccaacaggaatgggcgaatggccactatcaaagctctcatgtgcaactgcatatgtggtcagttgcagctgatgcgtacgcaggtgcatttctgcgttttttgcttccttggtagaagccactaatgttgattgtgccgtctcctgttccaaatctaataaaaaaccgataggagactaagagaggaaaatatgagctcggcatgaatcaacacgctaaaacgacacatccttaattaccactgtgcacgacgatatctctatttcgaaactgataatatgaggcatggttctttgtcagatgtccgatgcacggaaatatatcgtcgtcggtcaactcaagacttccgaccaatgactgacttcgctactgcaacgttgatggcccaccgccccttcttttttaaaaatgagatgctctttcaaatactctactattatattttccattcaattatagattgttatattttaggacgaatgtagtagcttttattctacattataagaagttatgattatataattcaaaaataatgtactccctccgtttcaggttttaagacgttttg

SEQ ID NO: 565 - DNA, 5140 bp, Oryza sativa
agcccaagtgggtacggttttagtgcaaatagggtaagtcttgtttacatcatatcggtttcattttggtacacgaatggagaagaaatgaaagagatcgaaaaaaggaagagctcgctgtgtatctgtctcgtaacagccccggtgttacacgtgctctaagagagattaattaaatcgataagctaccagaggtttagttttccacgtgttaattagattggaaagcgagagaaattaaaaatagcgagtaaaaatagagataaccttattgctattttgttttttttccagcaacaaacttatctttcaggctagtttaggcgatcgcttagattccgcatcgtccttttcactattttttttctgtcagtgacaatgtgaaaatttattggacagacgactagcttgtggtactagctaggaaattccctatcctcgatatgaacaacttactcaactcagtagagtagcaaatgcccaagaaagcccgagtcaatctatttggaaatccaatctattttctcgtattcgtgtgggaaatcaagctatactagttgaaattcaccggaagaaatgcacgcacttcaatataccaaaattgcaaaggagaatcattcgattaacagtggaattcaaccaagaaatgaaaaggtatatataggaaatgcactccaaccaccaaccaataagtgattccgggcaatcaattctatccgcgagttgtgggtctgttcagattcattatattagaacgcgtcacgtaatggatggagtattatacaacaccattggttttgccactagtgttaactctaatacatgggggttagttttacctttaaacttggtctaaaaggatggacatatggcaatgcaattgcatgggggtcattgattcgaccatcatgtctgtccagtggcaaccccctccctcatcccctgtggtgggccccccacggcgctcgtcttctcccctgttacaaataccccaccctcctgcccagacagctcgccctgcacacacacacacactcacactcacacacgctctcaactcactcccgctcaacacagcgctcacttctcatctccaatctcatggtggccgagcaccccacgccaccacagccgcaccaaccaccgcccatggactccaccgccggctctggcattgccgccccggcggcggcggcggtgtgcgacctgaggatggagcccaagatcccggagccattcgtgtggccgaacggcgacgcgaggccggcgtcggcggcggagctggacatgcccgtggtcgacgtgggcgtgctccgcgacggcgacgccgaggggctgcgccgcgccgcggcgcaggtggccgccgcgtgcgccacgcacgggttcttccaggtgtccgagcacggcgtcgacgccgctctggcgcgcgccgcgctcgacggcgccagcgacttcttccgcctcccgctcgccgagaagcgccgcgcgcgccgcgtcccgggcaccgtgtccggctacaccagcgcccacgccgaccgcttcgcctccaagctcccatggaaggagaccctctccttcggcttccacgaccgcgccgccgcccccgtcgtcgccgactacttctccagcaccctcggccccgacttcgcgccaatggggtaattaaaacgatggtggacgacattgcatttcaaattcaaaacaaattcaaaacacaccgaccgagattatgctgaattcaaacgcgtttgtgcgcgcaggagggtgtaccagaagtactgcgaggagatgaaggagctgtcgctgacgatcatggaactcctggagctgagcctgggcgtggagcgaggctactacagggagttcttcgcggacagcagctcaatcatgcggtgcaactactacccgccatgcccggagccggagcggacgctcggcacgggcccgcactgcgaccccaccgccctcaccatcctcctccaggacgacgtcggcggcctcgaggtcctcgtcgacggcgaatggcgccccgtcagccccgtccccggcgccatggtcatcaacatcggcgacaccttcatggtaaaccatctcctattctcctctcctctgttctcctctgcttcgaagcaacagaacaagtaattcaagcttttttttctctctcgcgcgaaattgacgagaaaaataagatcgtggtaggggcggggctttcagctgaaagcgggaagaaaccgacctgacgtgatttctctgttccaatcacaaacaatggaatgccccactcctccatgtgttatgatttatctcacatcttatagttaataggagtaagtaacaagctacttttttcatattatagttcgtttgattttttttttttaaagtttttttagttttatccaaatttattgaaaaacttagcaacgtttataataccaaattagtctcatttagtttaatattgtatatattttgataatatatttatgttatattaaaaatattactatatttttctataaacattattaaaagccatttataatataaaatggaaggagtaattaatatggatctcccccgacatgagaatattttccgatggtgtgacgacgccatgtaagcttcggtgggcctggacggccagaggtgccaacagccacgtccaacaacccctgggtccccccctaacactccaaacagtagtgagtagtgtctcgtcgcgttttagtatttgatgacaaacaaagtgtgagttgagttagccaccaccaacttgcacacgagcacatacatttgtgtccattctcgccagtcacttccatctctagtcctaactcctatctagcgatgtaagcggataatttcatcatccgtatataaacctgtttgttatagttaatttcctatataatactataacagtatacattttaaaagaaaacaaaattaggataaacaggccctgctcctatccatccatggcacttggaaggaccagactcggtcatgccatgccaagccaagatatgggttatggaagagtagagaagaggagagatgagagataagcatgcgttctcctcctcgttggatgtgtattttggagggatttgtgtagtagtagcagcggcgccgcggggacggatgcggatggtggcgctttcggtggcgttttcccgggggggttttggtttggcgcttgggggggatggcatggcgcggcgtgcggctgcacgccacacacacgcgcgcgcacgcacgtacgtcgtcgtcgccgcgggcggacggtagcttagggtggtgtgttccgcgcgcgggcgcggattgttccatgccgatcgatttggcgccaccctcgccgcggctcttgtcgcgtcgtgcgcctctctcgcgcggtttgtccttgtcgcgttgctcagccggcgacgggggcacggacattggcgatgtagccctgcacgtgtcggcctctccgttgatgaatgatgatgtatgtatgtatttttttttgtctgaaggaatttgtggggaattgttgtgtgtgcaggcgctgtcgaacgggaggtataagagctgcctgcacagggcggtggtgaaccagcggcgggagcggcggtcgctggcgttcttcctgtgcccgcgggaggacagggtggtgcggccgccgccgagcgccgccacgccgcagcactacccggacttcacctgggccgacctcatgcgcttcacgcagcgccactaccgcgccgacacccgcacgctcgacgccttcacgcgctggctcgcgccgccggccgccgacgccgccgcgacggcgcaggtcgaggcggccagctgatcgccgaacggaacgaaacggaacgaacagaagccgatttttggcggggcccacgcccacgtgaggccccacgtggacagtgggcccgggcggaggtggcacccacgtggaccgcgggccccgcgccgccttccaattttggaccctaccgctgtacatattcatatattgcaagaagaagcaaaacgtacgtgtgggttgggttgggcttctctctattactaaaaaaaatataatggaacgacggatgaatggatgcttatttatttatctaaattgaattcgaattcggctcatggatttcgcgaatgtggatggtggatgcccgcctcgatgaatccgctttgtccgatagagaaatttgaatttaaatccgggacctggattttgcaatgtggacgggtgtgctttgcgaaatctgctttgttcgatagcgctgcacaaaacatgcggtgggccctgcatgagaatccgcttcttctttgttgccttggtaggcgaaatcgtatatggtcccaacgattttctttgtttggtttcaacataaatgggagtttttatgaatttaggcttatctacatcagagctactcctaacttgtgatatgatgaaccaatcgtgttcttctcatacttgtttaagttggccaatataggattaatgcagagtatccaagggttttaagatggatctagttaagatttggagaacataatctacaatcatcagcaacactaattataactaaatcaacttgccttttgagttctccgcaaatatcagaacgcttttttctttttttttcttttttttttttgaggaggtggggagcacaaaatcggagtgaaattcgggattcccattcaaccacttccaaccatgccaaatcccggatggtttttgtttcttggcactaagtgatgggtcacgttttcacagtagttgataacttgcaacttgcaatcactctatcttcagctgctccactggattcaacgtccgtaggagcagtaacttgtcacaatgctgagcagaaaataaccgctaggaatatcaaattgcacaaaattataatgtcactgttgagtgatgagcagtaactcatgaaagaatccaaagttcccatgagttccagaatgtttgactgatatgacagacaaacttttgtaaggttctcctaaataacacaaagaaatttctcgtacactacatggctgtatggattgaacataatttgcctgtgacacttgtcacacttgtgacacttccaggttccaatacaaccttacagcaatg

SEQ ID NO: 566 - DNA, 3530 bp, Oryza sativa
cggcgcgggggtggggggaccacgtgggcgcgcgtggcggcgcgaggcgccggggcggttgggtgtccggtgcgcggagccgcgcagcggatggaggctttgctgctgctgctgccgcctttttgggttctagtgtcggcctgatgcggtgcggccgcgcgcgtgtgtgggcgtgccagcggcaacggtcgacgcctctacgccgcacacgcgcgcgccacgcctggaggggagtgaagtggagtgttggagtggactcgccgagacgagatgagaactgccgccgccgcggcctggttaggcctggtatagcctcgtacgagctatagatggcttgtcttgcttgcttgcgacacaagaagaagaagaaggatctgttttcaaacttttaacctctcacatcaaatttttctatactatgttttaatttttctcacatcgtttcaatctctttaaacttctaattttagcgtggaactaaacatagccgaagaagaagaagaaaaagaatcgtcagagtaactctcatactactactccagtagatggcatttgttttttactgtgaccattgtccataaaaaagttcatgatgaatttgattgatttatgttgattttagaaaaaagttatatgcatatttctattgtttgtactatattaagtatattttaaatagacgcttgtaaatcatatctgtatatgtataaatttataagtagcttatttctgttcatatcatgtcgctagccgttaaataatctatatcaatattaacaacttcactatcgtttataggcccaacaaatatcttcaaataaaacactacaacagcatagtaaaacacgagcctatcaaataaaccatgtgctagcacaagtgaaaattattagacacactaacacacgtggccttcaggtgatggacgatgatcctggttgttctaaaaccttccatagatcatcatcactcaaccaaaccaaacaaacccctcagacagaacagaaacaaccctagagtagagtgtgtgtgtagtgcatacataaacgcgcccaatttcaccagctttccctccatggttttctgtttccctccactcgctcccctcttccctcctccattttgagatctaaatccaaatccctccccctttttcttctcaccctcaccacctcatcctccaccaccaccattccctcttcttctcctcctccttgcttctcccgccccttaacccctactgctccctcccagtagccggtgctaaccctagcttgctagctagattgctctctctggtagtagtagatccgtggagtggagatctgcccgcggatcgagcggcggcggcagagcaccagccgtgtctgcggcgcggtgtgcgcgggtgttgcggagcggcggctgagcggaggtgtgggaggagggggagtgctgcggcttccggggtgttagatccgccgatcctggcgccggagatggattcctcgtcggtcgagaaggtgaagcttccgatccgtgggttcttggggggctcgatctgtggctggaatggcgccttggctgggtggttttttgacgctcgatctgtgggttgcaggggagtgggtcgatagatccggacgagcgcacggcctccggcgagcccaaggcgtgcaccgactgccacaccaccaagactccgctctggcgcggcggcccctccggccccaaggtgagatgagatccgatctgctcctcctgctcttccctttctcgatctgtgcatttttttcgcctgggttttcggtggttgatccgcccgatctgtgtttttttttttgctttgatccagtcgctgtgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcctgaaccaccaccctacctacctacccacctagcaacagcaagagagagagaagcagaggaaaggaggcagccatgggaaagagtgatttgcttgcttaacatgcatgatctcaaccgggagagactagacagatctctacccttttttttcttctcccctgcttagtttttccagctaattagttcgatcaaagtggaagccaagttaataatgatgatgatgatgtagtagctgctgttcttcctgttactgttacttgttcttgcctagctgtaatgttactagtagtgtttttagtagagcgtgtaacgttgcaatgtaagaaagagcttatgatccatcttctttctcttgttctttgcaagagattagctcctggatctgcaccaagtaatgcagtttttcagctgaagaatctttgcctcccaggtgtctcttattgcatgatctgcacacagtgttgactgatttacttaccgctgatgatgacagcatggttgattattcagctcaacttgtggtttgttctcccgtggctgttgtgctgctcggatctatgatgtgctggtgttgtatctgttgattgatctgttgttaatgatgtgatcatggatggtttgtttccgtttattgctttgtatactagtagatctgttgggttttgctatgtttagctcttggttttgagcaatgatatggcaactagtagatcattctattttcaggtgttgtgagcccaaatagtcaggtcaacatccgtgcaatttcctggaaggggaaaagtcaagcacccaggtgttcctgtgtttctccatcaggcgtgatcagggtcttcgctgttgtgctgttactactatcctctactccgtactagcagcagtagtagcttttactaggaatggatgggatggtgttgtgatgttctaggctttgacaagaggtgtttggtgtgttttctcctttgagaggagagggttgccacaataatggatggatcattctttgattgctgcttagtactttccttgtcttgttgaagaaatgatatggattggtgtcactaatactaataacagtggtgctgattatgtttttgtgagcatctttgtgatcctggtggttggtttgttccattttgttgtcatgcaagacagcaagagctcatgatttttgctgatgttgtggatacctcattatttgtggaagaataagaagaaaaacaactcacacacacccctttgctgtgtccgagatggtgacaagtgagggagtgagtggcattgttgttagtgctacattccaagtgatgatgatgcatccatcgaagaatctcctggtaggagtaggagtaccaaatatggaaacaaactgtgaagcaggggggaggcggagaccgttgctttctccgggtgagattttgcatgg

SEQ ID NO: 567 - DNA, 3952 bp, Oryza sativa
gtagaggatccacttcctctttatttatgccaagttattttagaaccatgctccacacaagacacgcacacatgcattgacatgtgctaattttgtttcgtgtggaaaggcatggaggccggttccccacaatgtccaatcgctgccaactctgcgagagagaagggggaggaatggaagcttgtgcatggcctaaacacacactttgacacttgactttgtgttggaatccattgattagccgctcaatgcagcatccccaatgcagaggtctcccctctactcctagctctttgcaaaacccaatgtccaccatttacttcaatttctcagtcttccttgctcatgtctcccttgcccttctctcaacttgggtcaacttcattaaatttctcctttggtatgtgcaaaggctttgaaggtgtaggcctggtgcaaacattgcaaagtcaaaatgtacggtacgatgcatcgagttactgacatggtaaatcttcccgattcccgtgtaaataaactactatttcattcgtttcatttataagatgttttaattttgttatgggtcaaacttgcttaactttgacatagtttattgaaaaaaataggttagaaaacttaaattcaggaaaaaaaaataggtgagatatcctagtataaccatcttggtttggttaagacatgccttagaatagacgagtcggtcgaaacggtcagaatcggtagcatctctttagaaacgacgctcaatcgacctgtaattgaccgtatttatcatttaaactattcattgtcaacattaatacaatgcaaaaagaaattagatttttttttataaatagtcaaaaatggtacgccagtctatcgggaatttatgtgaccgttttcacccctattcaagtgcatgggcacttgagttgtaaaattgacttgatcgagataccaacgtatatacaatttacacatcgaattgccgggaaattggactttgagatcattttagctccccaaggcgatccacacgtactctaccacaaaactttggttgtttttgctatcatctcaaggccactgcagcatgcgcattgcgcacgtacgagatgctactctttccaaggaaccgatgtctctctctctctccagcctccattgcttataaatatgttcctccttcctatactggtaatggcagcaaagcaaagaaacaaagaagaagaagaaagaagaagcagcagcaaaaaagttgatcagttaattagcaagtgtgttcttctttcttttggtgagagagagagagagagagagagagagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggtcagcagattagttcagtatcgtttcttcagcttattaaccgtggccaaatttgaattctataacttaattttagagttgatgtggatgtgttattaatcatagattatttctcaacattgggttttatgccgctaataacacatatgtaaaacctttacaaacaaattatttttcggtcgctaataagcgttacggcttataattttcctagtgaacagtgcatgcattttgcaaacttcttgttggctctggttgcaacttgcaagcacgcatatgcattgagagaagagttcatacacacactgtattatatatatgtacatttgggctataagatactaaaatgaaacaggagcatcgtgttctgaaatggcgtggcgttcttgtttattttcagcttgtgtaattgctggagggcaatagcatgggaaaacactctaatctgaatctgtgacacctggaacagtagcaccattcttgatggcataatacatgtacttaaccacatgtttatcgttggaatcctggtacaatgctccgagctgcatcgatccatccatgcgtgttacctccatgtgttcgaagatgctatatatttgcatacgacaggcacagcttcatgaatgttacttcgcactgtcttaacaaactccctcagtttcatattataagtcatttgattttttttcctagtcaagtatgaccaagcttatagaaaaaattagaaacatctaaaataacaaactagtttcagaaaatctaacattgaatatattttgataatatgtttgttttgggttgaaaatactaatatatttttcaataaacttggtccaacttaactagaaaaaaaatcaaacgacttataatatgaaacggagggagaactttccaaagaacgacattatcttaattttaagacatcgttattgtttttaaaataataataggatcactagtttctattacaatatatttgtaaaacacaataatatgacaatattatagaggtagtactactttttgagatttccatacatccaatctataaattgatcaaagtttctgcttccactctgtttcgttcgttcttgaaagttttcttctaacagtatgatgatcttgatcaatcaggaaccaagcagagagaatggaggaagtacaggttccaataacaatgggcagctgcagtttgattcagccaaatgggaagaattccacacggattatatctacacccaagatgtcaaaaagccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgttgcactgtataattatttagtcatacacaactactcctggtaactactcctatcttcgatgaattttctggttttgccagacgtgacaatagtccagtagcatgcagtaccctctcagaatccctgtaatttagcaaaaaaaaaaggaagaaaagaaaagaagcttccctactactttctccgtttcacaatgtaagtcattctagcatttcctacattcatattgatgttaatgaatctggatagatatatactccctccgtcccaaaaaaaaaggcaaactgtgggttcccgtgccaacgtttaactgtccgtcttatataaaatttttttataattagtattttcattgttgttagatgataaaacatgattaatactttatgcgtgacttatctttttaatttttttcataattttttcaaataagacggacggtcaaacgttgggtacggaaaccagggtttgtctttttttgggacggagggagtatgtctagattcattaacaacaactagggaggaagcccgcgcagatgcgcggacaatttagttattatttattaaaagaatgctaaaacatgttatcttaccatattttatttaaaatccatagattatcttatctctaccctaaaattgaccatagactttgatgatacactaaatttaattataagaatgtctctcatattaaaaaaaaaacctagctggttatatataaagtcccctatcacaactacttatttttgttctcttgaaagagttgggtgcctttttaataagatagaattgattattaaaaaaacaaacttaatatatcattaatacaataaaaaaatcatctccatttcataccgaagtgcacatgtctcacttgtgtctaaatgtataaatatttttaaataccacttctatcaattaataagagaaaaccattaaaattagatataaatacccatctaacgtgctaagttggccatcgctgctaaggatttattctataatgcctttaaatatgggtgccgcattgatg

SEQ ID NO: 568 - DNA, 3270 bp, Oryza sativa
tttgtttggcacctttgagcctctgtttgttttggaaaaaaaagttttattagcagcttaaaaataatttataggtaaaacttttcttttttttgaggattaaaaaaaagaagaaaagttaatattctaatcgatttaaaagttaatatatattggaaaatagagtatgattaaataccctcaaaatcaactctaaaaataagtttcaaaatttaaattttgaccgcatgcagctgataagccaaaaggcaaacgacagcgttgtttgttgccgcgagaaaggactggaattctaatggaatttctagcttgtgaatttcttatccctaggtttctttgcccccatattttggtgattggagaaattaagggcccctttgatttggaggaaaaacataggaattttagagaattttaatcctatagaaaaatttcctatgaagccatttgaaataaaggattgaatcatattcaatcctttgaaattcctatggaatggacaatcctataaaaattttggaggaaatttagcaagagcttcaacctcttgctaactttcctttgagtctatctctctcatccaagtcctgtgtttttcatgtggttcaatcaaacggtcattcctgtgttttgcaatccgctgttttacacttacattcctatcaaaatcctacgtttttcctatttctacgttttctcaattctgcgattaaaaggggccctaaaggattgataatttttacatatatatatatatatatatatatatatatatatatatatatacattaactaatcttaaatctacccgtgttttgtatgcatgcggccgatccttataaaattaacaataatcctgccctgtctggccacttcctgtgtactgtacatgtaacatgtgtttttcagttcactgtgtgtatcaaacaacggcaagttgcaacgaaagcaagccacttcgcccgattataaatagcctccactacttctactactcgccgccacccaaacccaaagcagcaattgcaagaagcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaaggtagctagctacagcacttggattattgattgttcaattgatagtgtatgcaaattagctgacgttttggagcttttcttttcagagaatggcggtgtcaaggcagtagcagcagttgcagctgatcagcttgtgctccagctggaaggtgacaccggcaatggcgacgaggtctccgaggtgagaatcgatggaaatatacagagctataaatcttcgagtacctagctgattagacaagaattgatgaagaagcaattagtggtaactaatcttgattgttaatttatttctatcttgttcttggtcagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccaactacacgctgaaatccaaagctaatacaaggaagatcgagatcgagataaattaaccaactctatatgcatatctatctatccatctacctctgcatgctgttttcactgcatcgatcgctactgttctgcagtgccaatcactgtccgtttctgtacaatctgtgatactactagctagtagcagtacatggcatcgttttccttcaagtgttcgttggcttttacttagtccggtgagtgcttgtgggttatttctgacgagggagtgtgatcagtacgcgtactaatggtattttggtttgtcatggcatgatgaaattaagctgtggtagcaatataatgcatatatatattacctttgtctcatgtccttagtatgtagtagtggtaaatagtacatagcatgaataatatacttatcaaggaacacttgtgttttgtttaatggcgcatgtctgtcttcctgtctgtaaaaaagtgtagtacttaatttcttcgttttttaatgaccgaccaacgttaagccgagctatacaaacttggacagttcttctttcaacaatgtttttacaaatggctggaactttaccggagcaaaaaaattctgacaaataaattaacatcaatttcaacgtacaatataaagcaaacaaaagatgttatcaatcagggtttatctctaccaccttaaaagcggattcatcgtcctcctcaacatcgtaatcccgcacgtaaaaaaaacagtttcccaaaaaaacaccccacccaaagatcaatattttcacacaaaaatttaaaaggaatggatagaaaaagaacaaaaccctataattccagtgccattgcaacgtacgggcatgacacttgtaaatactaaaatgcgaataaaatataacgaaacctcaacattttctcgacactaatagttctcccaagagaaacttaatcctttttttttttaaaaaaaactaccagtccaggatcctactaagatcgattgatcagtcactctctgtcagtctgtctacagtgcccaagtcatgggcaattttgtatcaagtctttgttccagattccacatcatggtcatcagaagtcaacaccgtggatgcagctagctgctatacagaggctttgataaatctcatctgaccagcaaaaggggaacacacgaagattctccccacatgcgttggcatgcaatgattcagtcacactgctaacatagctacctatctctatctatctatccccatgacattgcaaattattgtactatgtatcgatcgagcaatttgtggttagctttttcacaaagatgctgtggtagatgcgaaagatgtcgtcgagttggagcctcgaaccagcagtcaaaaattcagaccgaggtgatcacaaagctcattagtatctgagtatctaggtatgtgtgagctaaggtcgtaggttacacatacacacgtactgtctgatcataatctgatctaatcgtcgaaatataaaattgactatcttttcttatcactttaagttt

SEQ ID NO: 569 - DNA, 2954 bp, Oryza sativa
tttggtagggtcggaaagtctcataatagaaaattatcaatgaattaactatgtttaatagtcctacaatttgatataataggatgttttttattttctaagtcaaactttttaacttgatttaatctattaagaaaatatagcaacatatataatatcaaattatttcaactaaatatgccattggttatatttgtatagttttttcttgaatactataaaactatatccaacaacgaattttattaaactaatatggcattgttgatgttgttacgattttttagaaatgggacaattttttaaaaataacttataacaaacaaaaaaaacacttgtagtataaaaattggatgaagtaaggtcattgtctacggctgattataagatataacggcatattagcgataaaaaataatttatagaactttttttactatatcctttgtgacttaaaaactaattacaatgcttgaaaaaaaaactatgttgaaaaaattatcaaaatttaaaatttaaaatttagcattgctttatatgtcacagatcaaaggaagcttttaaatcaaaagtatgctaccaccctaatctgtatttactactatggcctggtttagttcccaactttttctttaaacttttaacttttctatcacatcaaaacttttctacacacataaacttttaatttttttcttcaaacttctaattttagtcaatggaaggcatatgtccaagacgaaattggcagtttgtttgcctgtgttggcacctacacaagtgtgaaccaacaaatctactcgtgttttgtaaccacgcggccgactagcagccttagctagtgcatgcgtgtgcgcctgcctgcttacttccatctcgaattaccaatattaatcactttctgtgttctgctgttaattaactaacctcagacgacgtctcgttaatctgagttgctatagctttacgaaaggccacacctcggattataaatactacccagctcatggcaccaccacactcttcagtctcacacaaacccaaaaacccaaagcttagccaagctactagctagctcctcacttcttccagcttcttacactaatacagctcgagccacttcgtcttctcctctcttgcagcatagtttaagtttgagataggattggcgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgaggtgagaattaatcgaacaccacacagtagctgattatacaagaattgatcgaagaagcaactagtggtagcttgctaagcttgatgtgtgttttgtctgtcttgttcttggtcagttgatgggagcagctgaggaggaagcagcaggattatgcgaggaggggaacgaggagtgcgtggagaggaggatgcttcgcgacgcccacctcgactacatctacacgcagaagaggaacaggccttgaaatcttgaatcataatctccaagtcgatacaaggaggaattaatcagtagtaaacctacataaattaatctactatctgcagcctgttttcaactgcatgtatcagtgtattagtcgatctaggataatattttgcatgtgtactcaagtaaactgtcgtctgtataaccccgttatgtacatggttgtatttctttctccaaagtgttatcgaactctctgttgatctctgatacatctgtatgtgtagcatcagagaaaagatcgagcacttgtgggttatgatctgacgatcgagtgtatgaacagtgctaatggtgtagtaagtttttgcttaattgtcttggacttctcatggtgtgaaatgttcgaacaagcagaacatattccctatatcttccttggtagctggtgcttggtactactaccagcacaaatgttaccagtatgcatgtttcataaagagaaggtataatggattataaatatataaacttgcatttgttttctgccgcatgtctgtgttcctgcctgcctgtgacctttgtctgcctctgaacaaattttatattactccatgaccatacaaccttcctagtagctcactcactgaagaacagctactactactagtactgtagtatttgtttttctttaaatttctccaagacaaccaatgcgttcgatctgtcaccctgtctacagtgctagctaagattatgggctttatttttttttaagttgcaacaaatctgttccctaagattcgataccatgatgatccacatagagatgataaaaagtcaacaccgtgcagaggctacagcggctttgataaatctgaccctgaccatgaaaagagagacaccgaaagatgctccctcacatgccctgccaatgattcacacaccataccaacagtaagtatatagtactcttactatcccattgcaaactgtaattaagtatcaaatcaaaataatcataaccatgcattagctagggtaattaagcttttattttctgacagagatatgtcatatcgtatgtgtatctgtggtggtagctagctgagaaagatctcgagccttgagtagtcaaactgatcatagatactcctactgtctaaactaaacaccaagctcggttacaagcttaattaattaattactactgtaaaccttagctagctactcgatcgagctaattaagaagaggtgcatgtcatgcccacttaccatatactaaacagattaagcatagtgcccagccacttctatgatctatctcctccttttcaatggtttgtgcagatctagtggccaatagtgtgaactccattatctgaagact

SEQ ID NO: 570 - DNA, 15761 bp, Oryza sativa
ctgagccgccacttgactaatggtcagcagcacacagtgatacagtagctcaggcgagtgccgatctgtgatctctttggtgatgaactgatgagaaatgcttgcccgctaaagctgcatcataattttgttgactctaaactcccccgggccccagccagagaggcactttgcatgcatcaactgagtaactgcgcaagctaatggagggtgttgcagggtcgcttggtccagagtttgcgcccctaaaaactacggcggtttgggtgtaccgaatctggagcttatgggtatagctcttcgttccaggtggacatggttgcaatggacctcctcaagcaaaccttggcaggggctagccattccggggtcgcaaaaggaaaggaacttcgttgcagcctctaccgtctatcaattaagagacggacaaactatcctcttctgggaagatagctggttgcaagagggttgcattcggtcctttgctccgaacatctatgataaaattccaccatgcgtgcgccggcgtcggacggtggctgaggcactaacaggtcgccaatggatcaaagacatccgaggagcacttgggatccaacctattctagaatatctaaagctttggtcgcttgtccaaatggtggatcttgatcctactactcctgattcaatcatctggaaatgggagagttcgggccaatacagctcaaaatctgcctataaggccttgtttttgggtcgtgtcaccttcctttccaccccaatttggaagtcactcgctccgcctcgatgccgcttcttcttgtggttggtcacaatgaatagatgctggaccgttgaccgtctgcgcagtcgagggttgccacacccggatcgctgtgttctttgcgatcagcaggaggaaagcattgatcacatcttggtagcatgccctgaatcgagacaattatggtggtggacgcttcaggcgataaggagtctgaactgattacctgtcaacgagtcatccttccacaattggctctgtgagagccgaatgaagattggggagcggcatcgtcgaggcttcgacactgtcatgatactggtggcttggacaatttggaagaaacggaacaaccgaatcttcaatcaacaacaaaggtcttggaccgaagtggtgaaagcaatggcggaggaggccatgctttgaaagtcggctaatcacgggatccccgctgtttggcctttatgaggtcgtggtagccaaatttagcgcgagatattcctatagttttccatagcgtcctgtattggtcccttacttgttttccttttatccttgtaaataacttttatttctcttaatagaaaaaaatgcgctccttgcgtattcccgaaaactgtgcatggcatgcgatgtgagctccagatttagaatatgtgttgtccatggaagcaccttctgatcatgtcaaaagaaacatctatgatgtaaataactaggtaagacgatatttattcagtctgcaactctgcatatctgaactgaagtactgaaactgaacagtgcctggtgatccagatatccagtgatatgaactaaataaacaaccatggtgccattcctgtgctccactggaagtaagccgagttgaaacacttcatcaactagtgttgattatatacaattcactttcagtttagtggaatcacagataacacatggccaagtgccgctattttttacgctttacgaaagaggggagagcggttctgaagattatcaacagcacctgacatttgaggcatgtggtcttgacaattgacactgtctgaaacactgaacgcaacagaccaacaaacaaaccagaactgaactgctatcgacgcaattatttcctcccagtctgatgattcctctgcaaattgatttacttcgcactcttttttagggaactctgcttcgcaaacttggtaccatgttaaacaacgtctgtgatccggaggacgataacagttgaagcacctacgaaactcgagccgccgccgccggatcgtcggcggagctccggcgagcggcagccgcggccgcggattctcgagcaggagacagagaggccccgttcttgccatctcgccgacaagtgggacccatcgaccccgcaccagagagggggcaaacggtaatacgtatacgcagtaatccgccacctctcctttgttcaatctgcaccgcacaagatggatcggacggttcatttgcaccgcacaatctccgactctctcaggtaggaaagtgacggttccgtactggttgggctgcaacgggattgcactatacttgcggcccatactatttgggccaaatggggattatgttgtatgtgcggcccatattagttgggcctaaacgggcttacggtgtaacgtgctgcatatggaaattgggcctcgtaacgggctggtggtgtacgtgcggcccgtattggttgggccagcatccttccgccgcctctgccgccaccgcccttcccgtcgtcttcgtcgtcgccgccgccggcgctctgatcttttcccggtgatggcgcctcttttctcttactgccatgacgcccaaactcgctgacaacccaccccgcggccgccttcggaaatagccgagcagcgggtccgccgcatccggtgttcagacatcgcgccatgagaggcgagcttggagaatttcttcaccatgtgagatccccacatcggcgatggcgccggaatccggaggcgagggagcgtggagccacttcgcgaggctcgcacgttgctggaggagatggtagagccctcaacgtgcccccatcgcagtcgcgatcccggtggttgccgcggcctctcttcctcttcgtcttcgggctcaactgaggtgactccttccccacttctttagatgaatcagggatggggtacaattgtttttccaatattttagatgaatttgttgttcatgagcactagatcgctgaactgaatataataggaatggactcaaatatctagtattatagtttcggaaacgatgacagggataaagattcatgagaggatgtataacttgatataatgtgatagctgataacgataaaatgtggtcaggtaaatgctgataagtgtctgcagctagaagcttcagaatcaatgtactgataatcgcaattggaaatgaacttagctgcccccaaaattcctgatgccagatgaactgtccaatccagtgtttgataggtagaaatagatgtacgtattcaacaaaacaaggtagaatcatgtggagcaatgtttttttttttctcaacgtatatttggatatcttgaattcttgatccttgagcattagccttttttatgggcttatatgtgcagcagctggtcaaggagaaagagccatgaagacgtagcaaaattcagccaaggtgtgtcataagggagacccatcagcccatgactcgatttgctgaacagatccaccatcagcctggtatttcctatcatctatccatttattatttgttcttgctgccatcacccaccagctacatgagtaatacaatatgcacatgattatgtaaacttagcacacatgtttaatagaaagaagctatctgaacatccatagttaatgtgcatcacttaaaaaaaaacattagtatcgatgctatctgaacatccatagctaatgtgcatcccttaaaaaaaactttagtgccgatgctatctgaacatccatagctaatgtgctgatagtgagtgaactgtcataaaggtctgcttaacccagttgagggctactggaataaggtgcttgtagtctgaaactacaagttcagtttcttagttcttaactcttgcacactagttgcttcagaattattttctcatccacgatatcgcactggaaacaccaaataatgcaatccaaacttggatcggtctctgttgaccttctgatcaaacaatagctattaaggttaattaaagagatattaggatgcattgcattagctatgatctgtgaattgcagcaagtttgagaaaacatgtcctggctcattaatcatgcacagtctatgaaaattacagaataacatgtctagtccgctcactttggaggataagatatgaccattgcaacctccaagtccaaccttacaaattactgtgctctgtacttcgtacacaaaatgctcttcttttttttttcaactcaggcagtgtgccaacaaaagctgcaggcaagatgaacactagtcctactaaaaacgcattcttggcgatgaacattccttcaggaccaccaaatctccacccatctttgagagctgaagcttgtacaataatatgatatcttgctagaaaaagccagcctagacctccatagccatgggaccatcagtcccatgtaccggcctgtacgcttcgaccataccacactccacactctcctactgctattagccctaagcttagaattttccaaataatgcaagggtcgatggttgacatctgcgcttctcccataggctttcccatttcaggagaatttggctaaagaccagctccatgtaactattctattccttctatatgcttctcgtgtttgacgcgccgaaaagtcgccgcgcgcgcatctcgacggcgcagcaccttcacctgccagatatatgtatcaaaatcgctaaccccggcgaacaccacatggggaaagccgtcgccggtgcgtccaatgaaagacctgtaaaccaagggcatttcctatattatcagcacggccaagctgacgaatccctagctgatccctgcatcgctttgcttgtgctagtagctagcagagtacttacaaatggaacagtgctagtggtgctcctcatcagtcgccacgctgacttgacagtgattgggatcgaggctgagctgcgtcgatctctgaagtcggcaggtagaatcgatgatacaagattggccttgtaaacagtggccaaacagtggtccgtggaatgatctgatcttttcccatgagaggtatcgtatcgatcatcatctagctcctgctggcattattatcttttttttttaaactaaaccggtaggggagctgccaattatattttcaataagcaggagtaaaaaccctagacgggttacaagaaaagaaaaaccaaccaccgaactcactaacagctaaaaccactgacagagtccaatgtaggatgtcgttaccaaggttgaccaaaacaacataggaggttccgactttgcaaccgtgtcatctttgccgagcttgccgccacgcgacacggcagctcctacttcaaaccggatgcaccatctaaacctagatgctgcaaatgatcaagtagcttcgacttcccacgatgaacatcagccaaagccgcctaagcgccacaatctatttacggccaacaacaaaacccctagaaagaaaacgcaacgtgtcatcgttgcccagtttcgtcaccccgacgaagcagctccgactccacctagcaaaatcaaacaaagagcgaggtcgtccactgcaaaacaaaaggtggagctagaaagcaaaggactcatcaaaacctagggctgaaaagattcgaagcaaatgcatagacaatcaacgacatccttgtacgaataagtttctccaaagcggtgcccccaaggaggacgcgacgtggatcgccgccaccgctcgttcggaagccgaagcaaggttttcacccggagaatggtaaggaaaggagaggggtacgctaaaacgacgcctccagggaggggaacgacgccaaagggcgtcgccgccgtcagccagccaaacggctcagtgaggcttttgccagcgattccctgtccaaacccacacaaccaatccgcacaagaaggatcatcgccggtcgactacattttccctttagcgatctagcctaggccactgccacagatcttctcgccgtcgacgtcacgcccacacccggtctccttccccgcctccacatgctgccgccaacaacgacgcactgtcagccccttcggtcgtgatggcctgccaaccatcaccaccactggcgccaccatcgctagccgccaccgtcgccatccgccaccgccgccagccggccagatccggcctgggtggcgcggatctggaggtgcagtgcgcagcgcgggtcatcagcgtcatggagggagcgtcgacgagggcggcatgccggaggtcgtggcggcgaggtccttgacgagcccggccggcgtcgcgacacgcgccgcggcccgctgccgtcgtcgccatctccttcgccgccatatccgccaccagcgtcgtcgctgccacaaccgccaccagcaccgccaccaccaccgtcagcccccgccgccggccacccccctgccagatctggccggacacggcacggatctggtcaccaccactgctgccatggacagctcccccggccttcgagcgcaacgtgggcgagacgaggccccgccgccgccgtccttgcggccgcgcggctttgccggcgcctgctcaggcggcggcgaggcggaggaggcggggagaggaaggcggcggtgggcgcgtcgcttcctgagccgcctgggggagggcgacgcgggggcacctgtgcattcattattatcgatcagggaattagttaactatcttttttttaacaaaccggcacttagagtatgccaatttaattgaatatagtaggaaaaaactgtacatgaatagttttatacaggtttagaagaaaagaaagcgctctaaggcactatgttacatagtactttcgcttctgtcatggtccaagtctttgccttctctttgatctttgcaaccaagtatgttgccgatagttctttgtgtctaaacactccctaatttcgctccttccaaaactcccattatgccaggaggataaagttgcacaagcctttctttggtacctctggggtagaggctagatccatccaccactcatggaccgtcacagggttatttcaatttgatgcctgaatttgctcgtgggagatccaagctgatattgatccccaaattctctgtgtacctgtatttcactattaggtgtagggctatcttcagagtataccggcagaatatgggaagtaggcgttgttatgtcatccgtgggccacgaggtgatccgacgtctatactatgtaacatggtgccttagagccctctcttttcttctaaacctgtatagtaaaacatcttgtgagcacccacagttttacggttgctttctcgcctgaaccccacatcacagtacatcgattacgccttctttctcccgacagggctagttgattatcatctcttatccagtctgcacgtacgcaaagctagtgtaggcaaggagactcttccagtagtcgtttgctagcggtttgcagggcaagcacacgttgcaggccggcacggcagacttgcgcaaattgacgacggtgcgagcacaagctgggcaagctgtctctcgtctcgtcatggatctcgctcgcacggatgccgttgtccatggcatgaacatgagacggcgatggcgagaggacgtacatgtggggatggatagatggaggagactggactgatcgatcgagtgtagtaggactgtacagtactgtggtggggggatcgaacaaggataatatgccggatgccgacctcatgcgccacatgcccacatagcaagcagcagggtgtgtcgtcgcggtccggtccgctgtttgcagctaggggggttacgttgctgtctggaagtacaggttgcaggaaagatctggagaggaagcagtgacagcagtagcttggtgtgttgcgttatgccagggggctttggaacttggaagttgaaagctctctctgaagaaggatcttcaggttagttgcaaaggacggagcatattcttcccgtactgtgagattcgtaatcgacattccgactgtacgcatgttgtactactacaaaatggagtatgcgcctaacaaattgaggatctcttggctaagggcctatgtagttcgtgaaaaaaaaaattttaggtgtcacatcggatgtttgaccggatgtcgaaaggggttttcggacacgaatgaaaaaactaatttcataactcgcttggaaaccgcgagatgaattttttgagcctaattaatccgtcattagcaaatgcgggttactgtagcacttatgactaatcatggactaattagactcaaaagatttgtctcgcgatttcccccctaactatgcaattattttttaaatttatatttaatgctccatgcatgtgtccaaagattcgatataatgtttttgggaaaaatttttgagaactaaactaggcctaagaggaaggtgataagtatcgagggtagtatcattttttatctgtagtatcataaaatcgggaaactatcagaatttagaaagtatatacttttatatggaatatagaatatgttgtataaattaaagtatataatattaattttgataaatttaattggttttatgtaaacttaaccatattaattcatattattttgaatccatctttttataaatagtattttatagaatcgtggggatcgtagaatcggtatactacctaagatttcgtatgatcgtgtgaaaagaaagatcaaaatactatgaaaagtaggatactagatagaatcagtatcattttggtttggtaggatcatataatatcataaaattggagcatacgccccactggccaaacctaagatatgtttaaagaatgggggtagtatataacggaatcccgttttcgaatgggatgatcccgagtaggtatcaggtgtgatacctttcaagtatcagacgattctacacacgtttcaggtgatacttgcaagtatcatgcgatacttatcaggtatcatgcgatttctaccacgtatggcgtgatactcgcgaggtatcatgtgatacttgtcaggtatcagacgatttctaccacgtatcgcgtgatactcgtgaggtattatgtgatacatgtcaggtatcagtcgatttctaccacgtatcgcgtgatactcgcgaggtatcatgtgatatgcctgttaggtatcagacgatttctaccatgtatcgcgtgatacttgcgaggtatcggatgatacctaccaggtatcaggtgattcctactagatatagctgggcatcccgttggggagcatcccgactcgcgcgcggccggcctactgtagccgtcccctgtagacgaggacggcacgggacggcgcggcggcggcggggaacggcgacggcggcggtgggggatgggcgcggcggtggtggggggggacgacgatggcggcgagggacggccgcggcggcgggtgagcaggcctggtgcgcgttgagggcttcggccgcgtcgcatgggtgagaatcgtgttgtggaggaggagcatcccgttgggggacagtatcccgtcccgtagcattcccgttaaagaattcggtctgtgctcttggctaaccaaatctaatacgggaaattctggtcataaggcctcagttaaccgttgacggattgagcagaaatatagcacgaaaccaagcaaacctaccctgctttttttattaagatatagatatatattttgatttctgttcgcatactttttaaaccgctaaaaaggtacgtttcgtacggaaactttctacatagaaattgctctaaaatattaactaaatcaattttccaactagtaataattaaaacttaattaaccattagtaactttctttttttttatgctcttacttaatcttaatctttattagtttcaagcaccaccttattttcatctttatccctagctcgtcttccccaacagtcactggctaagtcccagcacagtcgcactctcctcccatcttgtgcctccgctccctccactagcttgtaggtggctggcgacaatgcctccaggccgctgaaggagagtgcctgaaggaggagaacgacaactacagttgtgggattgaggaattgcaggcaaaatttactctcaaaacatgtatcgaaattgatcggtcagctcggccatgaccgaagaccgaactataaaaatgatagaatattttaggttttacggttttatattaaatttcgatcttgattttagaggctgaagttttgagaggaccgaaaaaccaaacaaaattaatcggtcagactgaataaccacccctactcacccacgtagcgataagaatgtgtgtttagaaattgactagagatatctaattagtagaattttcgttagcgcttctaatctaaactgataaatttggttttgttacaatgtattgccacaacgtaattttagttttgcagatatatatatatatatatatatatatatatatatatatatatatatatatatatatatatatagcactatcatgtcatgttagcttgttggtccaggtgcatccacggtctagtaccattattgcgtagttaatggacggaatagctgctagtggagatgggggtgtacttcagcagttaacccccagaaacgtgattagcatcggtgcaggcgcccctcgtgctggttaaccaaggcgggcgccccgtacttacccgcgctaatgccgggtttaaggaagttaacacgtgattctggcacacgcgtcgggcccgaccaagtgcgatgggatccgttgcggcgcggtcgtgacacttggtgccccaacttgccgtcgatctcgccgcgctgtactttatcttagctaataactcttcttctccccctggaaaaaaaaattaacaaccgggtttcttcctttgaggcattgatttttggatactctctcgctggctgcagtgcaagcgaaccagtgcacggtattcaaacagtctgcaatacctgggtaaatctgagtcctttgattttgatctggcgaacataatatgactgtttaaaactacagtcaccctacttattgcagctgaaccgtcaaattatagcttcttctagggatggattgggaattttcttacatgttgagtttttgaacacctgactagacgatctcacgatatactaccttcgtcctaaaatatagtaatttttagctatgaatttggacacacaaaaattgctatattttgggacagagagagtagtcagatagttttatcattcttaagaaggtatatcgagatgatggttttttatcgtaaaacttaatatctctagtaggtgtctcgaaatatcgtacaagtcctgcatgtactttcttaagtaccataaacttctctacaatttaagtagggtagaagcacccccgttgaggtgtagctaccacaattttgggttcctcaaaagtgtgaggtcgatcacaagtttacactatctatatctagaaacatcaattcaatatttacaatccgtatggcgcatatgggcgtacggtagctggagttgcaaataccgaattttctcttccgaagaaagtgcaaattccattgtttatatatatagctgtgtcctgttatcattccatggctcacctgttgagctggtaacccggtttggagtcatctataaaaggaaggtaaaggaagtgacatgccagatgaagtatagcaagctatcctacagccagccacgctgcaccgaaccctccaatccttggaacttgaaccccttcaaatcacacccagtaggctactagtagtacttctctgcaccaattccatcgccaatagcagccactacaagtcttacatctctcctttcctcctctctctgccattgctaggagcttgcatttcttggtagcttcatcagctagctgctttctccctccccaatctctcattcttcaggccaggatatgaaggtaaaggctcaaaccatcggtgtgattaatcatttcagagaggttaatagatttgaagtgttggtagtgttgatccatttcttgatggcatcatgaggcttgggttttctctgcagattttcagctgggtagccaacaagatcagtgggaagcaagaagcaaatcggtttcccgcaaattcttctgcgccttaccgtgagtgtacctgaactttcagtttccttgtaaattctttcagaactaaggtgattgttgttcaccaggcttcatgctgttcttatgaaatgtttccctgttccttgaggggagagggagagtacggacagtaatttggaagccgtttcctaatttgatattttctttctgtcattctgctgcagttataatgtctttacctcttagcagtttctgcttaggcatcatttgccttattcatttctggatacgatgatactttattgctttgtcctaatttaatcttttcctgctgtcattctgctccatttatggtgtctttacctcttagcagtttccgcttaggcatcatttgccatgttcatttctgaatatgctgatatactttgttgtcttggtagccatatacaagagtgaacgatttaaaggtttctcctaattgctagtaacagaacgcttttcgctctgcgattttctggattaccatcccctgattcctgagtaacctatcacaacgccaatgtgatggagcaaacattgatgtattatgacaatgttgtttctgatcctttgagaaaattttcttatatgcacttgggtgttgtttggaacgcaggaatttcactggaaacagttcaattatcgcacttccggaaaaaaaattcctgcattttaaacggcgctttaagttcagtaggagttttcaattttattttcctcttccctagcacgaaaagtgagagatttttgtgcatatgttatacccccaaaggactatttcatggcctgatgcccgccacgccaatatctctgtaaagcactgcttccaactagtcagtatgggtcaaagtcttgactaagtgcaaccctgcaagcaagtgtttccaactagtcagtatggcttcaattatttagttgatttataaccccaaccctccacttgtgaccaagaagaatttgatttgagcagacaatatcctgacctcggatggtttcgtaaatcgtactaaggaatcagatctgagccactagtccagctggactacagtacattatttatctctcaagattacataaaaagactactattgtacagagaatgcattgtttaagtggtaacaactgctgtgataagttattcctggtatacagaaaaatggcaggtgaaaacatcagggagtggagtaagcatgggcagacattgtacttaaagagtgataggccaatgagaatcactgggtgtttaaggattaaaaatttgtggtccatgctctagacatccaatttatgctaatatgaacttaggaccatatatttatgtttgtttactgatcttgcggcttaatcgagttctaatgcgcaggtgctaacgtgtcagattgtcgaaaggatgaattcagtgattggccccaatcattgcttgctattgggacatttggaaataagcagattgaggaggtagctcaggtggagaattcatccgacaatgtgcagtcagtgcaagataccgtcaaatttacagaggaagaagtagacaagatacggaaagaattcgaaacgctactagcaatcaaagatcaagcagaagctcaacgctcgcatgatgatgaccaagtaggtttacaaaagcgtgccgatggggaagacaatgagaagcatattagacagttgatcaacaaaaggatcattgtaagtaaatcaaagaattcgttaggaaagaaaggaaatacactcaagccgagatcagtcgcttcgttgctcaagttattcatgtgtaagggtggctttacctccgtagttccagaaccaaggaacacatttcctcaatcaagaatggagaaggtacacagtgaaattctttttttcttatgtaacatgataagttttacatactttctcgtcctcttattatcttatatgatgttcattgcagttgctcaaggcaatattgcagaagaaaatacacccgcaaaattcttccacgctagttgctaagaggcatttggactggaagccagatgagacagaaatcaatgagtgcctggaggatgcactgcgtgatctagacgatgatggtgcaaaatgggtcaaaactgattcagagtgtaagtagcatacttgcctatcatgaattgaaccttttcttttgccacttttgtcaatggagcaactgactgaatatgaacttttcttgtttccagatattgtgcttgaaatgtaaagttgggtgaatatgttagttcgttcatgccaggtatatacctttctttgatccccaaattttcaactcaactcaaatgtgaattatccttgatctagcatgtctctctgttttgatctgattagtgtgattccaatctgcaggttccaaaggtcctggcaagcttggggtttatggtgttactacgtaatgatataaatatgggatatagttagcaatgaagctctatgatcatgtaatgctcctccattatttctgacatgaaccatctgtaatttgaatcatgataaggaggttctgggacaaaggcctattccatgtgtctactctcttctgccctgaaactgtaaagaacgcattcaattttttcaactatcttctatgacaattgccatctgttgattccagagttgtctgccatatccaattcaattcactagttaaattcacatcatctctaacacttgctgaataactgtttgatcacctgatttctacactccaataaagagtaataaaacggtaagattgacaacgttgttggtacagtacgggcagagcgtaatatcttgtccgtgtggcagagaagaaaacgcacattccatccgttgcaggcacggacgcctgtctgtgttgcgttgcgttgctgctgtacgttcttgggagcttgtggttggacacgcttgacatcggcgagattctgccggcccgtaccccggccatacgtgatggccgggcaggattccctcgtccacgagagagcatggcgcaaccgctgctccggtgaacctcccccctacgttagatctggcagaagagcgtattctcgtggcagctccatcaactctctccttgacttacctcaaaaaaaaaaaaactctctccttgacgcagattaagcttagctcgactagttggattacttgcggtggaaccaattcacccagattgaaattctagaattgatacatatgttcagctaattattttttcattgtggtggaaccaattcacccggattgaaattctagaattgatacatatgttcggctaattattttttcaatggtagggtagacgtacctgtcgatagcgagacgcctatagtgacttcgtcctcaaaatatgtcgacctagttttccgaaagtacttatatgagtaggatgtttgagtgtgtacgtgttacgagcgtctgcgtctgatatgtgttaaaaaaaaaactctccttgacgaatctactgcactgcagaaataattcgcgttcgtgcactcctccatcagacgagtagcggtccattgattgtgcgattgtcccagccacataggtgcgagaaggccggcccaaaaattccttcgcgaaaacgagccgattccgctgtgaaatcgg

SEQ ID NO: 571 - DNA, 4778 bp, Oryza sativa
gcttggctggtgagagtcatacgcatcttcaattcccaaatgaacgagctgattggaacacccggtctgaggatgccaagtggggcaagtgatccccatatttatcatgtgatagcagctgctccagtcggtctcttatagctctgagaagcaaaaacaactcactggtgatccatgtccatacgattgagctaaccgaaacgttgatcgaatccaattttattcagcaccagcggatccattgcaagatcatgcaaaaggagaaaagtagatatgtttatcagctccagcagcatatgaacaaggtgctagtatgcagatgccccctgtgcgtttagacgcagacagacgctcgcttgccatgtgaaatttgcgagcgcaaacccgaccctgattatccaacggcagcttcggagaagactgatgtatcaccttaccaacgcaatttgcagaccaggcgacaggttccaggcgactccttcgcccgagactgacaacagtgcagccaagtcaacatctcacaatttaatgagaaaatatcgagtcgaataatacacctctgcaactggaaacaaaaccaatattcctctgaaattgccatggcactgcgtggagaatatatctcatgttctgaaatctgaaggtcttgtgtgtttgttccgatttgctgctcaatctgtccattcacatttggcagactggggctaacaacacacgacatggtggtacgctacctgaccggccatgctttttaagattggaagcctgaaacgagaagaccaggactcccaaaaaaaagaacctttgcaagcactaggagatgtctgcatccaaatgtgcaagcaaaggaagcaaccagtcttcttacggattctcccgaacagtgctaggattggttgaccataccacttacgacgatggagccccccctgaggctgagcctgcgtggccggccggcctttaaatctccctccctctcctccctccttctccaccctccccttacctaccttggtggcctcctctcgctctcgctctccttctcttcctgcacctgttgcacccccaacaactctcactcactgccagtgtcaagcaagattatacagcttggtctcatctcttaattccaagcttgtttcaccgacctgccaaactcgattgatccacagatagatagtacttctggttgggatcttgagcttatatagaccaggaagcatgcggggagccatgaagccgtcgatcgtgcactgcctcaagctgctcatgctgctggcgctcggcggggtcaccatgcacgtccccgacgaggacgacgtggtcgcgtcgctcggggcgctgcgcctcgacggccatttcagcttcgacgacgcccacgccgccgcccgggacttcggcaaccggtgcagcctcctgccggcggccgtgctccaccctggctcggtgtccgacgtcgccgccaccgtcaggcgcgtgttccagctgggcaggagctcgccgctcaccgtcgcggcgcgcgggcacggccactcgctcctcggccagtcccaggccgccggcgggatcgtcgtcaagatggagtccctcgccgccgccgcagccagggcggtgcgggtgcacggcggcgcgtcgccccacgtggacgccccgggcggcgagctctggatcaacgtgctgcatgagacgctcaagcacgggctggcgcccaggtcatggaccgactacctccatctcacagtcggtggcaccttgtcgaatgcgggggtcagcgggcaggcgttccggcatggaccgcaggtcagcaatgtcaaccaactggagattgtgacaggtctctgacaaacccgccacgcacgataaaaacatatacagccgctctaatactactactacaacaacagcataggaattagatgactaaatttgttcttgctatgaactaccaaatgcagggaggggagaagttgtcacctgctcgcacgaggtgaactctgatctcttctacgctgctcttggcggcctgggccagtttgggatcatcaccagggctcggattgctcttgaacctgctccaaagatggtaacatcaagcaatcaattttgtgtcaactcaatgatggaaaaactggccattatttgattcgtttcattggtgcatgttcacgtactaattagatatacaatgacaggtgcggtggatacgtgttctctactcggactttgagaccttcaccgaggaccaggagaagctgatcgcgtctgagaagaccttcgactacatcgaagggtttgtgatcataaacaggacaggcatcctcaacaactggaggacgtcgttcaagccacaggacccagtgcaggcaagccagttccagtcggatggaagagtgctatactgccttgagctgacgatgaacttcaaccacgatgaggctgacatcatggaacaggtgagctgagttaattattttctctttgcatcaagatgttgacgtatcaggaaatatatatataggatattagatagcccaggccgtgcaggtgttttttaattaatggttggtgtttgtatatgtatttacaggaagttggtgcgctgctatctcgactcagatacatatcgtccactctattctacaccgatgtcacatacctggagttcttggacagggtgcacacttctgagctgaagctgagggctcaaggcctctgggaagtcccacacccgtggctgaatcttctgatcccaaggagcacagtccacaaatttgcaaaggaagtcttcggcaagatcctaaaagatagcaacaatggtcccatactgctttacccagtgaacagaaccaagtaaatataactagccaaattgcagtcctatactatactatccagtttcaagttttggtaactaaaaaaagtttaacatggttgatgcaggtgggacaacagaacatcagtggtcataccagatgaagaaattttctacctggttgggttcctatcttcagcaccatcatcctcaggtcatggtagtgtcgaacatgcaatgaacctgaacaacaaaatagtggacttctgtgaaaagaatggtgttgggatgaaacagtatctagcaccctacactacacagaagcagtggaaagcccacttcggagcaaggtgggagacatttgaacggaggaaacacacgtacgatcccctagcaatcctagctccagggcagagaatatttccaaaggcatcactacctatgtccttgtgacagtatatgctgtgaaaaggcttttgtagagcatatgttgtacaaaaatgtagcgaaaatatcctttgtaaagacgaaatctacggaaggtagcttaaagaacacagcggggcaaccagtagactagaactcaagaagtagtggaagatacctcacaaaagacttcaaagcaaagcagcgtggccttaactctggttgcagctttggaggcaaatgattggaggattacagtggtcctagcaactgaagtccagctgttgttacagcatagagaagagctgtgctacctcaatgatcactaaatcactgactagtgtaactcatgttaagttgtttgtgttcagctaacaacactgcagaaggtagcatcagggtagacccttgattagcaaataacacagcctgttgcatgtgagtactatctgcataaatgcagcagattacattagtttttatgaatcgaatgttatgtttgcaaatgttaaagaaaaaaacagcaaagtttcttattaatcattcgtctccaagaataaatgggactgaatcattttataattcccttgatacgataatcaccgtatatattctccatttgaggtaatataataaagtaagagtggagctgtgagatttcataagatgtgacacagttttcattcggtgggatggcgcatcagatagaaagtagtaacattaagtgtggggtcagaaccaatgtatagtgcaaaattcttctgacgaggtaacaaacaggcatattgataggaaaactgcaaaccgcaagcagacaatgccatgctcctgcatattatagcaatcgagcatgatctgctacagtaacgtaattatcatgtcagcaaaggaaaaaaaacagctcaataatgaactttttactggaatgtagccccttatatgttttaagcctcataacatcctaagaaaacatcctactattgacagtcacactcacacccaacattatccagaccttcactttctgtgatacttttgctgtttgaatgtgacattgaacttccataagaatcccttcaaacaatattatcagcagaactgaaatccagacaggtactcacactcggctagagataatgttgtatggatagctcatggaaggtgcacaacctagttagtttgtccaactacatttttggaaggaaaagatcagtgtcatatgaaagtgcacagttcaactggattcaaagtggaacataagcagattacctgctagtagtacaactacagaggtaaatatagtgacaggtaaaagcatttgcaactttgacaaatctatgtactgatctaatcaatactacagagtacagataagaccaggtttggctcataccctggcctgaaccgtcctaatcagatgcaatctttcaatgtagagctctgatactactagcagcagcatcacctgtcaatgagtattgcacatactgttagcaacataaacatcactgctctgttcatctgaaactgaaaacatcac

SEQ ID NO: 572 - DNA, 3240 bp, Oryza sativa
agcagagtgacagaagttcagttgctctgtttcaatctttggtgccacagtttaagagttggtgcagcttaaggcacaaattgcatccttttttaatcaaataagaaaacaacatacttaaactaccagttgataccttattgctagattgttttgtcagaggactggacatatatgcctacagcagaggaaaaataaggactagtacagcacacaaaaatattttcctgataacttagcaatgagatgtctctcacaaaaaataaaaccagttctttcccatcattgattgttcccttttccttgtgtcccttgaggaaaaaaaaacccaagaacaaaaaaagaaaagaagaaagaaaagtatgagacctatagcatacagcgacaactccacgtcttgagccatccatggccaggtgatgtatgaatgtgtgtactacaccatacatccaaaattaaaaaacccatttatccccaaatttataaagtgaactgtgctagctagtctcacagcagccaagcccaactaatcacaaaagaaatcattgcagaagcaggcaaaggagataaactaacaagaccaaaaaaccaagcaaatgatcgatcgatcgaacagttttcttttccatttttattaatttaaaaaaactgaaaaattaattagtcccaaccacacctagtttagctataccccaattggttgtcctttgtgagtactagtactatggctgtagcttagcttctcctctggattagcagagtggtagtagaagtagaagtagtagtagaaatagcagcttagctccagctctctccaattctgcaaatggggcataaaatttagaaacaaagaaggagaagagctcaaaataatggagctggttgcccattggggagacaagatcgattttttttaatcccctggccctaatccttctccatttctctccccttataagcaaccggtgcagctgctgctgctgcatcaccaccgcctcaacgaagaagaagaagcagcataagcagaagcacacgaaggagctcgagatcaccggagcaagaagaagaagaagaagaagcggcggccaagatgacgggatttggatcgccgtgcggcgcgtgcaagtttctgcggcgcaagtgcgtgcgcgggtgcgtgttcgcgccatacttctgccacgagcaaggggcggcgcacttcgccgccatccacaaggtgttcggcgccagcaacgtgtccaagctgctcgcccacctgccgctcgccgaccgccccgaggccgccgtcactatctcctacgaggcgcaggcccgcctccgcgaccccatctatggctgcgtcgcccacatcttcgccctccagcagcaggttcgtatagttcattcgatcgatgtgtcgctcgtcggcgtcgctggtttgctgatcttggtgtcgcggcgcgtgttcgaacaggtgatgacgctgcaggcgcagctggcgtcgctcaaggcggcggcggcgcaagggatacaccaccaggacgtcggcgccaccaccaagggcggctacatgagcgccgccgccaccgccgccgacgaccaattagggtacggcggctacaaccagtggtgcggcagcaatgggggcggcgcgccggcggcgtcgcagccgggcgcgtatagcagcaatggcggcgccggccacggccacgactccatcaccgcgctgctggcggccgggtcggactacatgcagcactcgctgtaccacgcgttcgagcactcggagggcgccggcgccgtggacgacgggcacgcggccgccgcggccttcgaggcggcggcggagtcgtcgtcgtgcggcatggcggcgtcgttcgccgccgacgagagcgtgtggaggtcgtcgtcgtcgggataccaagattgcgaggatctccagagcgtcgcctacgcttaccttaaccgctcgtaagatcgaactaagaactactactagtgcagtgcagaatatatatcatcacaagatatatatagagagagatatatatctcaatctcattaattcctgatcatgttttggacttgatatgatcgagtctgcagcttgggccaaatatgtgagagagtttcaaagcttagctagactcagatatgatcgatctctgccagcaataattcggatggatcgatgtgagagttcattggtatcgatcgctgtagaaacctaattaattagaaagcaaaaatttctcttgtcatatgatcatatgcatgtctggtgctgtttctgtctggactactgcatgtgttttcttctcgagttctgtttgtagtttgtgacagatcacaaatcatgcagaaaatatatgttgcgatcgaagaggagaaaacctgctatgctacacagtattagtgacagacaactgattcatggccggcggccacacatcagaaaatccaactacaccactgttttcattgaatccttaaacagaaaactctttaatggcgcaaatattatactttaatttacagtgccattttccggttgtaactggagtagttcattgatcttatatagtgatctcttcataactaatatgtgtagcgtgttacatgcgatgatgttgcagtcaatatgtataccatgatcagtttcatcctacaaagtactatatatagctagcttatacaggctctaaactgtaatccaccaaaaaaacttcaaataaataccttcccccagtatataattattctttggaggattcctgaggatctgtatatatttaatttgatcatatatagaagcttataattaaatagtctttttatcaggaatatatttatagagccggtatatcttagatatacactatagtcctttcaattccttcttttcatattctattttgatcatgattacctcttataactgatataagtcctaaatacacagtttttttttttactttgtcaggaataagtatgctatcatattttaaagacaaagtaccttgatgtgagaataaccataaagtgtaatttcctttggttcattaaaaatgagaaacagggtcaactaaagtgatatgattcgcacaggcacaaataaaggtcaacttaagtgataaaaagttctttccaggcaaactaaagttgtatgctccacgcagtattgtatttatacatgcatggactgagtagctaattatacattggatcaatgcaatataatgaaaagcaacaaaacaacaa

SEQ ID NO: 573 - DNA, 5521 bp, Oryza sativa
catgcttccttcctagttaaacattatattactgtgtttgcgatcccgtgttcccaatccctctcccttgttttccacgcgtacgcttttcaaattactaaacggtgtgttttttgtaaaaagtttgtatacgaaagttgcttaaaaaaatcatattgatctattttagaaaaaaattagcaaatacttaattaatcacgcgctaatggatcgctacgttttccgtgcggggagtttagttcccaacttcccatatcctaacacagcgatcagtccaaagtacctggagttcaactgcgatctgctgccttttcctattcgatcccaaacactgaagcagaactgcagaggaagtcagatagtgcagcaacttgactacataacggaacaacattggcgatttcggtttaattatagctcgatccaaatgtttccctgtcatagggtgtcatagataatgacttagcaccaaatgcattgctactctatcaataatactagcaagaaagggacaggaaacataaaaatgtcatgtcatcagtgcaagtccagtagaaagaaaaatggaaaacggaaaacgaaggtacgcagaaaaacttgactacactaaggctgtgtttagttacttccaaagttgaaagtttgagttaaaattggtacgatgtgactgaaaagctatgtgtgtatgtcaggttgatgtgatggaaaaagttggaagtttggattaaagacagtctaaatgaaagttcaaactcccgccgtatttcagcgggaactatttaccgtgctataccttctgtttgtagtgactatgtacatgcccgactgctgcctggccaattaaagccctccatttgtagtacttgttgacatatcttttgtaaatatcacacatacaatattactcattgatatactccgtatctttgtaaacaaggatactacacacatactacctattccccggggagtaggtgggggacctgtgctgatacttgcgtccttaaggttggccgctgttgtctctcaaccgaatcgttgatcgcgcggacgacacccccatgtcgtggacgcagagcgctaaggacggctgccgcagccgagccaaggcatcagcggatcgagcgcgattctgctctgcggggagccccgacgactggggcggggttggaggaggagaacagcacggctgcctggcttgcctggttgtggctgctgctgctaccgttgaagctgtcggttcaccggcagcgcctgccactggatggcgctactgctctgggtgttcagctgctcgctcttctccttgtggatcctctcgttcatgaggtcccaggccaccgaggcgcgccacgggacgctcgccgtcatgtgcgacgagcgcgcccggatcctccaggaccaggtgaaggtgagcatgaaccacctccaggcgctcgccatccttgtctccaccttccaccactccaagagcccgtccgccatcgaccagaccacattcgcgcggtacgtggagcgcaccgcgttcgagcgtccgctgacgagcgggctggcgtacgccgctcgggtgacgcactcggagcgggagctgttcgagcggcagcaagcgtggagcatcagagcgatgaacttctcctccaaacggccgcgggcggaggagtacgccccggtcatcttcgcgcaggacgcctacaagcacgtcgtctccatcgacatgctctcgggggcagaagaccgtggaaatctactgcgagcgagagaatcaggcaaggttgttctaactgctcctttccagctgctcaataaacgcatcggagtggtcctgacgtacgcagtgtacaagtctgagcttcccctgaatgcgacggtgcatgatcgtatacagtcttctataggatacttgggtggtgtctttgacatagaaggacatgttgataagttgcttgaaaagcttgcaggcaaagagcccatgacggtgaacatatacgacactaccggtgagagcatgattcgtatgtatggttcttcgaatgaatcagccagtggcatgtgtcatgtcagcacgctcgacttcggtgatccattaaggaagcacgagatgcattgcaggttcacgcaagggccaccttggccatggctggcagtagcatcatcgtacggaaccctcgtgatttctttacttgttggatacatctttcattttactgacaaatggattgccaaagtcgaagatggttacaaggcgactgacatgcagatgccagcaaaggatgaattcgcggccacagagaggatttcagatatggaaagagatctgaaggaagatgctctgtttttcgacacgaccaaaagccccagtctgttggagatctcgcgtctgctgaaccatcgtgatccagctcagaatgttcaccaggaggagcaagagctcaaccttccattggaggcgcaagacaaactgaaagagactgagaggaagctggggaggatgtccaagttcattacaaaggttatgaaattaactagcgctagcattcgctgtttaccttctcgatttcactgcttcaacaagaaggtatggagcattagccttctcggatttttactcttcattcttgtcattggagcttttgatcagccatacaatcaacctttgggcatgggaggggagggtgacaataacatgatgctgaagaattttgggttctctcgtggaaggttgttaattgatacgctccatggtacatggactaaacgcggtgtgcagagtagtgacacgatcagggttgatctcagaaagatgacaaggaataatgacagttctgggcagcagctcaagcactggtcttcacataagtcaagtgagatcccggctgtcctgtatgttccgatgaatggaaagcaagttatagtccactgcaatctaattgtagatgagaaagcattggtaaattggatatcaaatggtgatactgatcagtcaagcaagtatcagaaagaaactgcagggatacaaaacagaacagacaagcctcacctgccagcaaacaagtcacacaaaacaacagtaagcccgtggattgtcttacttccagttatcatgcttgtactccttggcagtattatatggcgccggtgcaacgaccataggaggagagttcaacaaaaagagctggaacttttgggaataatggggcctagtcgattccaactacaagatctggtagccgcaacgggcaatttcgcagatgagaacaagctcgggcaaggagggtttggccctgtgtacaaaggctacttgagggaccaggaccttcatgtggccatcaaggtgttgtccagaaggcaatcttgtcaagaacaatcggcgcaagggttgagggagttcaaggcagaggtgaaagtcatgacgcaactgaggcacagaaacattgtcaagcttgtgggctggagcgacagcaagaaacagctccttctcgtttatgaacttatggctcaaggaagccttgacaagcatctctacgaccctgagaaaattttaacttggcaacaaaggtaccaaattaaatttgctaacctgtttaattcaactgacaagattgtacttgatctgggctctgctttgctctacctccaccatgactgcgagaaatgcattgtgcatggagacatcaagcctgcaaatgtaatgcttgatgtgtcacacaatgctaagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcagcagcaaatggagcgtgtgatcgtcatgggtctctgctgttcacatcaagacccgatccagcgaccgtctatcgtgcaagctatggatgttctgtgatctgcagacgcagagttgccggtacctcccgcagcacatgatacaggacacatccggtccatgcaagaacaggcttatgccgacctgccagttgaggatcattctgtgcatactgtcacccgaagtacgtattttacttccaaggattcagtttatctacttgctgaaggataacgaattctctcttttgaatagcaatattagttatgtttacatgcgcctgtttagattgttttgtcaacaagattgctgataggcacacatctattttgttcatagttttgtgctatctatctatctattatccatctacacatgtagtataaatgatagtttcatatgaaccagctctattgttagcattaatcctgacttacatattttaaatatctgcagtagttagtcgtgtatgtgtgtcatgcacgtagtggagtattgcatatatgatgcatgcatataggagattagatctgtcacagccatgtacttggtgattagttgaccgagtaattagcttgtgtagttagttgagtgcggcaagttagcagatagttagttgcatgcatggttagttggacgagtgggtctcgtaatgcatggagttagtggctcatgtattcaggtagtgcgtgcgtgcgcatgaagaccggcaacagttcgtgcatgtaaggctatttaagccgtgctctgatccattttcagttaagtgtgtgagtcacagataaacagagaaaagggcatttgttgccgcaaagcttgcttgtgttccctgtgttcatctgagccatcgcgtgtgttgtgtgctcgcgtgagtttacgccgaaggtagttcgttgctccccggcagtttgatccctgggcgaaagtcaacatctattgttgcagcattttttttctcataaatttaagacgacgtgattcaagtaattttactttacaatttttaacaatctgtgctctagaataacgcagcctagcccatccaatcggcacgtccacttataaatatcacctcacatacatccttagtatacaagaaaaaaaatactccatccatcccaatataagcattcttagaatagtggcaaatcaaacttttaaattttgactattaatagcaaacgaacaaaaacagatcaatcatgtaaatttgatgttactagatttgttattaagcaaattatcataatgtgtaactttttttatttaaaacatcttacttttatagatattgttgatcaatgtagcatctcgaagacattgtcgaagtccaacaatgcttatattttgggacggagagagtattacttaaaattttaaattagagaaaatccataaaatgccatcgtacaagtctttttcttccagaaatgccatcgccatcaacgcaccattgattccacaccatta

SEQ ID NO: 574 - DNA, 4545 bp, Oryza sativa; identical to SEQ ID NO: 369

SEQ ID NO: 575 - DNA, 5301 bp, Oryza sativa
atcaagagttaaagccaatgatgtctcccaaacacgagagcatttcttaattccatgtgtaatgatgcatgcaattgctccagggggtttctcattccgagtggtggtacgggggagcacttttgatgaattaatattggtcacccccgtttgtaaatacatatcagtttgactttgactgatcatgctttggctagcagtaataattctcaaattaaattatagatttgcgatgtaaagtactttgttctctctgtttaatattataagatgttttgatttttttaagtcaaagtttaaccacatctttagaaaaatatagcaacatctacactaccaaattaatttcgttaaatcgaatattgaaaatattttgatactacatttgttttgtgttaaaaatgttaccatgtttatatataaatttgatcaaagttaaaagagtttaactttaaaaaaagtccaaacgccctacaatataaaaaatgagtgtatttttgtatagctcacaaattacatgtcaaaattatacctattaaagtcagcacctgcaagtatttatgaattgatgtagtagtaagtttgccaaggtaggggtagttaactgataaaaatattctaaaattgttaaggagacatctttgagttcttgtgattatgattgaacctgcagtcagtgtgatgactcatgaggagggccccatatgcatggggccaaatcatgaccatgcacaagattagaaagaaaaagaagcaaataaagcaaagaggagtcctgtcctccatcccaatcaaatctcagcccagctgctccttttctgaacttttgattagccccatgcacagtatcagccaaaccatctacttagagcaaggttaatagtgtcgcccgctaatggctgaaaaataaccacatcagcctcttatagatattgctaagagctaatgtatacaataaacaggtttacatcgactattatttattttttaatctttagctaacttccccatccaattttttagtcttattgccgttgtttcgtccaaccattactgcatcgcgtcagctcacgtggacccacaatcgcatgtcccaatcaaagctagcctggtgttgctgcacttgcgttgggacgtgtgtttagccggcaacaatttagtcgccgactcatgctctctctcctatttagctcattgacaaatccgatgtggcagttttatcgccggctaaactggcttattgtacttgctcttacttgactgcttaaccaactgagcactgttgtaattaaatcagtgcatggctagccctaccaacttcacttcagagctcagactggacctgtccctctgaatatttgttttggttgttccttgctgtagaggtagggatcaggctctgaatgagttgatgatagtacaagggagaattgattatcagcatggcaatggaggaacatgcagacatagcaatagtgaaactagctgagtactataactgctactagcagttgtgccatgaatattcaccagtcagcatccagtagtagcaggaggaggagtaagtagagactagagagcagcagttatcactggtctccttggcttggtttgcacgggcattattatatgtagctgttggctgatgctgccattgccaggccagcaccataactactcctggtactatagttaaataggagtatctgtcatgctcatgacatgcttgccttcttcttattctccttccctatggtcttcttcttcttcttcttcttcctcggagctcgttgaactcctcccgccataattgcatcccctattcttcgccaccaccatcgcaagaatattctttgaagtgttttgtgttgtacttgcattcatctctctgatcaaaagaggaattggcaacagaggaggatactaggatggtggaggcagtggcgtcttttcggagaggaggcgttggcattgccgggatgagcagcagcactctggaggaggtgcagatgcaggagacgctcatcttctctgataccatcaaggtcagtagtcccaaagttcagagttcaggcatattctgttcttccctttttggtttcccttcctcttctttgcctgcaaaatcatttgtcattgctcaagctttaatcacagtcaaactcaatgaaaatatgatgaaatattgtcaaattggatttggtgttgagcttattaagggaaaaaagaacaaatattgcttggctgtttctttttcagttaggccgtatagtatttcgtttcttttctttttctcgttgacattaggcaactaaagaaaatactgcatagtttgatgagatttgagtcttcaccggtaaccagcaacacgttgcgatcttcttatttcaggatctcaagatgctgaagtcgcagctgtactctgcagcagagtatttcgaactagcctacacgcaggaagatgacaaacaggagtacgtgatgtaccgattctttctttctttttttctgcactagatcatcaagcaaaaccccagctgctgctagaataattatctcaaaatgtgtacgaacaatattatttgtagggtgatgaacaacctgaaggagtattccgtgaaggcgctcgtcaacactgtcgatcacctgggatccatatccttcaaggtttcaagcctcatcgatcaaaggttcgatgaggttgacgacacaaatctccgggtgtcctgcatccatcaggtactaattttcagagttcatcacgaatagtacctgaattcagtactgcgatctagtatagttcttgaattaacaaagtgatgatcaataataataacctgaagagagcccaagtgagccaagcatgcatggacaaggaaggcctttcacagcaatcattggtgatcacagctcccaagtatcacaagaggtacatcttaccaggtaattaaatatgtatacctctccttttgttttggtccaacttgtcagcaaattctgatggcagggagtaaacaagaattaatttgtgtgagacatttcaatcccgttattcattaatcgcagcaggagatggttcaatgcctaatgctgtgcccaacttcagcgagatgaggaaggccaagaacagagctgcacagatgcaacaggtcttcagcggtaagggagcttaaattgtactccctccgttccaaaatataaaaaaaattagaatactattaatctggacagggaaaatcccttatattttggaaattttggaacggagggagcaatcatgagaattattgcaactcttctatcaatgatgagcatgtactagttgtctcgatctccttttgacctgcaatgttttgccgctgcagcagcagcagcatcccaagcaaaagccaaagagaagcaaccttcattcaggtcagtctgctatgcacaacagcttggacgtttgtccatctccagcttggaagttggtgatctgaaaaattgacaattttgcagcaagcttcggtcgatcgcccgtgcaccttcgcaacgtgcacgctcgtcgtcaccagcacagcgcccaccttctgagaatacaatacccaccaaacgaggtaaagcaatcagcaactcaccgtcagaaaaaggattcccttgaaacacaggaacttttatggcattttcataggatttagcccgattctagcaaaatttcctctgtttcaaaggaaatggtgcttatatctttgatcagatttgctcatgtttaattgcacatgctcgtttctgcagcagataagaggtcagaatcgccaattcccaggaccacgccactcacaaggtctggatcacttccacaaaagccatccttgttgaaaacttcaagtgtcagagttcaggtaaaccacacggccttgtgaatacagtccacctaagaactggaataccctgtcaataaacctgaaatatgttcatctgtcgttgatgaagatgcacacatcagagcacaagaaattggcatcagtgaggtcacaagctgacagaaacgatgacaaggaaggcgagcagactccaaagaagggcaagaagtttctcaagtcgctgctcagcaggcgcaagtccagaaaagaggagcctttgccctgttactttgatgattactgagtccctttgagagatcccatggcacagcaagaatctctgaatactttttacatcgttttcttcccatgaaaaagtttgtccttgatatgaaaaacttgtcattgtatagcataatagtaaacagcatatataagttgttgaggatgattactggagcccaagaattctggaagttttgcaagagttttgttggtagctttgtttgatcacctaatacttagcattcagcacactggcatactgccagccagtctccagtttacaatgctgagctccagatcaaataagcagcaatgtctatcaactgtgtctgtgtcttcctcggtacaattactaaccttgtccaccaaaattaccagaacacggcacagaataataacattaactaaatacatgaaagttatagagatcgtagaaccacaacaacaaaagaaactaaaataggtgctcatacatgtgtcatcgagaaatagcattgggtacagctaaataataactgagcgagccaattacatgttacattaatcttcagaaaaaaaagatgttacatcatatgatactatacataaaattcattctcttaaaatatgatccacataaatgtagagagtcagcctgatgtctagttgccaccgcctatatgtctatagcatgaatcagcaaaagagtttagcaatttcatacaagtgaaaagaccacaagagaaaatgattgtatagtatgtcacccctgctagtttacagccttgcatgttaatcattgtcatcctggtaaacaaataaacaatgctatccagatttatggaaaattttgcatttccttgtatatataatggacatgcatggacaaacaaaaatcgacacctacatgacctaccgcatacaagacgcgagttccatgccccacatccagacagctaacaggagtacctttgtatacaaatcccattaaactgttcagattctgcccagctcttactttatggctacattcttgctatgccatcccttgcaacagcaaaacatctcatgggaaaacaaaattgcagaataagatcaattgatcaaaggaacaatctgaacccaccacaacaaaaccatcgctagcatatctcctcccttctgtttgttctaatgtgggcgtacatctgcaaaa

SEQ ID NO: 576 - DNA, 12649 bp, Oryza sativa
ttgcttcaggatcttgacgacatgatatttggcaagaagggcggcacctcatctcagcaggacaggaaggaacaaaaggacgatttcatcagtttctgaccaccagatccagatacagcagggccgcagggagacacttgatatggatttgtgtgatatgcccatcttgcttgaatgtatcccagggattttgtttggtttaatgtcttgggcatgactagtttcttgctgtacaggaatagatagatgtagcagtcccccttactgtgtcaagccagtcagattttggctcatgactactatcagtgtcagaggtttcattacttgctgtacgctcggtgaagggtttgatgctgagtttttttatggtacattctactgctagtatatactaccagtatatttgatttgacggtgtaaatttatctgatttccctcctaattatactgcagtataaattgaatagggtatatttgtctttttatcttttttcatggggggtatttttgtaaattaacacgagctcacttagtcagatccgtttcacatttcaccgcatcgactcaaaccgaatccgctcggctcgcatgggcgaccgccaccgctgtcttctgtcggcgccgccctcgccgtcgacagccacagtcgctgccgccaccgggagccaaaatcggcgccgccgccatcgaaatcgattcgatttctctcctttcctcctctcgtgtattttccggccaccgaaaaccctatctcttccaaaaaaatccccaaatcggcgccggctgctgggtctacgggaggtcgccggctgctgggtctacgggagggcgaggcctgctggggaccttgactgccgcatcggcaggggcagccggccggcggtaggtggcagcggcagggcagcatgccgcagcagcagcaggccatggctgtcgcgaggcagaccctcttgttgcatgctatggctctggctctagctatgtcacagcgtgaacaggccctataccgaagctgccgatggaagaaagcaatgtcatagctgcagcacaacagaggtacattttttttgagaatttcagaacattccaaatagaaaggtttaaatttattattgaacttgcagttgtgtaattgtttgtggagttttgattagtctaaaataacaccgctgatactagagtatgttgcacaaaatggtacacgctcaattgctctggacagactattgaaaatactaactccttatattaaaggaattagaacaaagtcattgatttcgactagtatcttggaaggtgtaacatccattagtttatctttttatccttcttctgagcaccccccaaaattgcagctaacttccttctaaaatattttatatcttcctgcaaaattcataaaggtatttgttagatagaaacaatcaattgaggacttgtaaagaagatgcaaaaatatttagtgcatcttacatgcgtgtattccttcgacaacctattgccttgccagtgctccatgttttttagtacaaagagcccacatgagacgctggaagaattgaattatattagagaagtgataacatacatttaggtagtgaaaaaaactattattgtagtggctgcataacatacagatctccttgtaatggcaaattctgtatgaccgtgacttcccaggaagtaatatgatggtcaggccattgtgttgctatgtgcttttcttctggttccaacagctgaaaatattgttgtaatccttctagctgttttgtgagaaaacgtcattactgcggtatgttcatgtcctttttggtttatttctaagtagaatacttacaacttttcttagttccttgcgttgtgtggatgaattcgccatggagtcaagcacttggatgatgcggcgtttggcgtgtatgactgccaggtaccgatgtttttcttttatgttcatggggaggaaaatctgtacaaagaaatcatttgtaggatatattagtagtataaacttgctgaaaatttgatagtattgtggcataaatattaccatatcatgctttagatatctatttgccgttgctttagccattgcccgatcgatgatgtctttggaaacatagtgttcgccatctctttgtagcaaccttgttattaacggtttctctaggaacaccgtaccttctgccctagtccctgtaccttccttcatatctttctcacgtagacaagtaacgtatgcatcgattatttaaaagtagaggaaaatggcaggttatgattgtgctagtagttgcatgagagaatagtttcacgggttagtaaacttacgtgatcatccaaatagctcgtacttgattcagtcactggattagtcagaatttgcattgttttttgggaaattgagacatcatcgatatgcaccactagttgtgattctggtgcactcattatacttttaatggtttcctcatcttctgcggtgcacttgaactctgccattgaagttaaatctgtaagtgaactgcaacacaaaaattaagcagagtaggatgtgatgataattataggacttttaccattggatattaaattctttgcttgcgcattctttggtttcttctttgtagcccctaaattgtagatgaaatcagaatttgatttaattgttgatttacgcaatcttcatgttgatcctgaaagtgacttggcaatgacgggcgtttgagttggtgggtttggtttctgctattcaattggcattttaaaaataattagtattaaatttgacagacactgaagaagtaagatgttgtcttaccttttttttaattatatgtgtttctttgtcgaaacttttgcaaacatttggcttagagttcttggaagttggtattgtcttttcctctttgaatgcagctattatgttggtgagtgattgaatttggttatgcatggactgttgattctgcttcatctccttcatctcctttccttgctcttctatcagcatgattagttttcgggtcagtgactcagtttctggcctatcctgcataatatgtgtttgttaagttttgagacatatgctgttgtaattcaaataaatagtaacaaaagtataattttttgactaccttgtgtgaagtggcatgtgttgtgctgtcgacgcgtttttctgatgtttttatgtcgctgtcacttggtatgtcttggacattctatgatgaaatgacatttttaatggatattaaaccatgcgttgtgatgtataattaatgcaagtacaattaaatgaaacgattaccttatcagtatggatgcatgactctgattgtttgctcttcttgctgtcactcgttatgtcttggacatcctacgatgaaatatcatatgtaatggatattaaaccttgcgtagtgatgtataattgaatgtaagtacagatgaattatttgattaccttatcagtagggatgcatgattctgattgtttgctctcctcgctgtctcttgtaatgtcttggacattctatgatgaaatatcatatttaatggatattaaaccatgtgttgtgatgtataattcaaagtacgtagagatgaataaaatgattaccttatctttttggatttgtgaggatttggagcattctatagcaagtgtgatgtcgtcaacaatctagtacataataactcattcacgttagctggtccaaaatagtgctcgtacatcatgcttatccataagttattttcattgaatccatacttcgctttatactcaacccaacatctctcaaagtcatcaacatccatagcatcataaaggaatttcttaaaatctgcaagcttttgccgacggaggtgacgtttcatgttctcctcaatgtgccaactacacaatctatgatcagtattgggcataaccttcctaattgccttcgccattgatgcatccccatcagtgatcaatgatttcggatgtttttggtgcattgcctccaaaagagtttgcagcagccaaacatatgaagaaacagactcatttgacaatataccacacccaaaaataactgtacttcgatgatggttagctccaacaaaaggaacaaatggaagattgtaccggttcacacggtatgtactatcaaatattaccacgtcactgaatgcttcatagtcaagctgggattgactgtcggcccaaaataaattcctcagacgacccttttcatctatactgtatctaaagaaaaaatctgggtcttgttcttgctgagccatcagatggttcaccacgagatcagcgtccctaccttcaattctcttcttcttgtaccgggcaaaaaaattgtacaagtctcgcgttacgaacccaaccttatcatacccaccattattattctccattacttccattatttgacatgttcgaagcccgccaactccaagctccacggcctcagctttttgagcatcatttacctcacgatgagatcttaagaaagctaccaggtcaaggttagcaagtctatgtgaatgtctagcttcaaaacctgatacaaaccacattcctgtctctccattgagctcaatttcaagcattgccttacacccacagcgggtcaacgcacgtggctcccttttcctattggttctctcaaagttcttcaacgtcctgtaaccttcacatgagcaataaaatcgcctccagaacactagctcggtaccactaaatcgcttcactttgtcccttctaatgctaaaacctttacaccttgcatattcattgtaaaacttgtaaccatcttcctcgcttctaaaaagcttactagcaaccatgttatactcctccatctcctccaagctaacttcgtcctcgtccattgtgcaacactgttaatacacagtaaaaatacacaaagagaagaaccatatcagcataattaaaatataggttaacatcttgcgtttcatacatcactaacaaaaatctttacaaatttgcaagtcttcacataaatcaagtatctacaaagatgagatttttcacacacagatcacaacacaattcgaaaattgcatgtaagaataatgataaaagtgatacaactttgcgaaaaacatcctgcaaattacaaagtaataaaggcttgatagactgttggcaaatattaaaacaaatgatttatgataacctgtgatataaacgttcgatggaaccagctttattacatatatggataataccttaatttaaaccaaatttaagttgcaaaatttgcacctctgctacattaattttacatagcacactcatctagctatatacctaggattaatgcgattctagttgcagaatgcagattttcatcctacttgtctcatcaaatacaacctagtgttctaaggcagatcgtccaaaacaaagtcaatcaacaagataaaatctcacctctttttcataatgagatagtaaattttcatatcgacattaaggttaagcacaacaaaaattgcagaacaaaacaaccattgcataaattaatcaatacaatagtaccaaatttaggtcagcttcttaccaggagcactccagtggctgcagggcaggcagggcaaccaggacggagatgggaggcgtggggaggctgccggctcgacgagtgcactctcaccgccgtggtttgggcaaagcacaagctgtgggaggtcggatgcgggagagaataggctagggctggaggcaaggcgccggggcgagggagacaccgggcgcgtggaggttcggcttctctcggcgccggaggaatcggtacggaggcatcggcgcgggagcgatgtgcgccaggggcagcgacgccggagacgcgagaggcatcggcgcgggagcgatgtgcaccaggggcagcgacgccggagacgcgagatgtgacgagaagaaacagatgacgacatccccaggaaaaactaacgaaggaaaattaatccggctgaaattaattctctaatttaaatgaccaaaaagcccttttcagactcttacctaataccaaaattacccttgtatatactgctagtatatactagcagtagaatgtaccgtaaaagtcctcttgatcctgaggcttttatattggcatgactaggtgctgatttttgcgaatacatataagattggtatcaggaataactgagtaatctggtttatatacaactattgatttgtcaggttataaccttttgtctgaactgttgtatcagatatatatccagaataaggtaggtcctttgtctttataaaaaacctggataaattagctagctgaaagcaagattgatcgtgcatgcaagttaagagggaacatgcggagtcagtctagtaatgctatggcatgatgagcacaatcagtgaacccatcagcttgttaatatccatccatgggttggattttggatggagttgacctctggaaggtcgtctgaagaaagtcgaaaaccaataacaccaccactgaagtagtaatcaagttgacagggtcgagcggctggatttactgtttgttttggactaactaaacttatttatagcagcgaagaaggataagaaatttatttggaaatggtttgaaagagtagagagagggagacacatgtcatgcctgacctcgaactttcacaaaaaagtcatctcccgcccccttgaagggacactagtttattgattgattggtcagaagataatttggcatcaaatgcttgtatgcatgtatctgcgcatgttgtcatacaaatacagtagtatacaatagggaggttggattgcgtcgcgtggcattattttggtttttgacagacagacatttcaagaccgaccgggagggaggtagtcgcgagcacgacgatcttgatttggattccttgtgttgttgtgtgtgagtatgaagtctgactgaccacgaatccattcacgatggggggaaaacagcagcaatttccaagaaatctgcatggctttgcttgcagtggcaatcgacacgagcgagaccgataatcccatcgtgcgcgccaccaactaaactcaaccgatgatggaacaactaagaagaattaaggaagcaaacgatcgagcaggagggaggccatgaagggagcaccaacacacgcttgctgcctttggaccttcaaataacactacgccctctgatttctttcgacatctctcctcttctcttgcactgcggcttccactgaattctttctttcttggacctatctgctgtttctctctctcagactacccaaattaaactcgtccacctgcaatgcattgccccacctgaagaggaccaacaggtatcgattgattcttcttcttcttcacctgatttgttcatgttttggtcgatcaattgccactacaaattaaactagcttgatactgtatgtaatgttagtaatcctcgatcgattctcagggggctattataatgttgcatgcaaaataggaatgtaccaattcggccagtaaattactgcaagttttcaacccgcctgcatctaatttgtttccatttccatttaagaagcagagtcacatttttcctattattaggactgatgattttggatcgccattactggggtcgggtcaaagccacccaaaatatgcttgatgcctgaattgctgatgcttgattcaattcattcctattcatattttctagctagctagctgcatcacgttgatcggcggcgagacaagctagctagctatactctcttcttgttgttgttaccaataccataccaacacaagagaagagagaaacatagcagagcaggggagctaggtgttcgatcatggcgtcgaagggcatcctcaagaacggcggtaagccgccgacggcgccatcgtcggcggcgcccacggtggtgttcggtcggcggacggactcggggcgattcatcagctactcccgcgacgaccttgactcggagatcagcagcgtggacttccaggactaccacgtccacatccccatgacgccggacaaccagcccatggaccctgccgccggcgacgagcagcagtacgtgtccagctcgctcttcaccggcgggttcaacagcgtgacacgcgcgcacgtgatggagaagcaggcgtcgtcggcgagggcgacggtgtcggcgtgcatggtgcaggggtgcgggtccaagatcatgcgcaacgggcgcggcgccgacatcctcccctgcgagtgcgacttcaagatctgcgtggactgcttcaccgacgccgtcaagggcggcggcggcgtgtgcccggggtgcaaggagccgtacaagcacgcggagtgggaggaggtggtgtcggcgtccaaccacgacgccatcaacagggcgctgtcgctgccgcacgggcacgggcatggccccaagatggagaggcggctgtcgctggtgaagcagaacgggggggcgcccggcgagttcgaccacaaccgctggctcttcgagaccaagggcacctacggctacggcaacgcaatctggcccgaggacgacggcgtggcggggcaccccaaggagctgatgagcaagccatggcggccgctgacccgcaagctccggatccaggcggcggtgatcagcccgtacaggctgctggtcctgatccggctggtggcgctggggttgttcctgatgtggcgcatcaagcaccagaacgaggacgccatctggctgtgggggatgtccatcgtgtgcgagctgtggttcgccttgtcgtgggtgctggaccagctgcccaagctgtgccccatcaaccgcgccaccgacctgagcgtgctcaaggacaagttcgagacgcccacgccgagcaaccccaccggcaagtccgacctccccgggatcgacatcttcgtctccaccgccgacccggagaaggagcccgtgctggtgacggccaacaccatcctctccatcctggccgccgactaccccgtcgacaagttggcgtgctacgtgtccgacgacggcggggcgctgctgacgttcgaggccatggcggaggcggcgagcttcgccaacctgtgggtgccattctgccggaagcacgagatcgagccgaggaaccccgacagctacttcaacctcaagagggacccgttcaagaacaaggtgaagggcgacttcgtcaaggacaggcggcgggtgaagcgggagtacgacgagttcaaggtccgcgtcaatggcctccccgacgccatccgccgccgctccgacgcgtaccacgcccgcgaggagatccaggccatgaacctgcagcgggagaagatgaaggccggcggcgacgagcagcagctggagccgataaagatccccaaggcgacgtggatggcggacggcacgcactggccggggacgtggctgcaggcgtcgccggagcacgcgaggggcgaccacgcggggatcatacaggtgatgctaaagcctcccagtcccagtcccagcagcagcggcggcgacatggaaaagagggtggatttgtcgggcgtggacacccggctgccgatgctggtgtacgtgtcgcgggagaagcggccggggtacgaccacaacaagaaggcgggcgccatgaacgcgctggtgcgggcgtcggcgatcatgtccaacgggccgttcatcctcaacctggactgcgaccactacgtgtacaactccaaggcgttccgggaggggatgtgcttcatgatggaccgcggcggcgaccgcctctgctacgtccagttcccgcagcgcttcgagggcatcgacccctccgaccgctacgccaaccacaacaccgtcttcttcgacgtcaacatgcgcgccctcgatggcctccagggccccgtctatgtcggaactggctgcctcttccgccgcatcgcgctctacggcttcgacccgcccaggtccaaggaccacaccaccccgtggtcctgctgcctgccacgtcgccgccgaacaagatcccagccccagccccaggaggaggaggaggagacgatggccctccgcatggacatggacggcgcgatgaacatggcgagcttccccaagaagttcggcaactcgagcttcctgatcgactccatcccggtggcggagttccagggacggccgctggcggaccacccgtcggtgaagaacgggcggccgccgggggcgctgacgatcccgcgggagacgctggacgcgtcgatcgtggcggaggcgatcagcgtggtgtcgtgctggtacgaggagaagacggagtgggggacgagggtgggttggatatacgggtcggtgacggaggacgtggtcaccggctaccgcatgcacaaccgggggtggaagtccgtctactgcgtcacccaccgcgacgccttccgcggcaccgcccccatcaacctcaccgaccgcctccaccaggtcctccgatgggccactggctccgtcgagatcttcttctcacgcaacaacgcactcttcgcttcctcaaagatgaaggtacctagcttgctattcgatcgattatttttcttcttcttcttcttccgctgccgccaaacaaacaattatccattgcatttgcaggttctccagcgcatcgcttacctcaacgttggcatctaccccttcacctccgtcttcctcatcgtctactgcttcctcccggcgctctccctcttctcggggcagttcatcgtgcagacgctcaacgtcaccttcctcacctacctgctcatcatcaccatcacgctctgcctcctggccatgctggagatcaagtggtccggcatcgcgctggaggagtggtggcggaacgagcagttctggctcatcggcggaaccagcgcccacctcgccgccgtcctgcagggccttctcaaggtcatcgccggcatcgagatctccttcaccctcacctccaagcagctcggcgacgacgtcgacgacgagttcgccgagctctacgcggtcaagtggacgtccctcatgataccgccgctcaccatcataatgatcaacctcgtcgccatcgccgtcggcttcagccgcaccatctacagcaccatcccgcagtggagcaagcttctcggtggagtcttcttcagcttctgggtcctcgcgcatctctaccccttcgccaagggcctcatgggcaggaggggaaggacacccaccatcgtctacgtctggtctggcctcgtcgccatcaccatctccttgctctggattgcaatcaagcctccttctgcacaagccaactcacagctaggaggatccttctctttcccctgatatacatatattctcattccacacacccaatccagactacctgtctctctgctatctgcttgcttaggattcattcatatgctagctggtcgatcgagctaccgcagcctagggaacatgatcatatcacccacagtctgtttgcttcatggagcaaactgcacttcaccccagtccagatctgcttcttcacagtgagtgagatcactatttttgcttgtttgtgatttttttttctaaaattgtttagagctcattgtcatttgaatggcattcctagaaaagggagaaagaaaagacacttgacatcaacacaggtgtaatacattgttactagagaatcggcaatataatgttactagagtatccaagctcggaacttggaacctgttcctattaagtctgtaaaaagaaaccacacgtttgacaatatttcttctatttttgtcaaaaaggttgaggaacaaagtaaactaagaccatggccgatggaagctataccctcatgaaaaaggagatgccaagtgggatgaaatcacacttgttacataagccacagctctatcttatttttgcatttcagcacctgtcagtcgattacattttccatttaaatcctcagattttctattcatatataagtccaatatttgtagtacgccccccaaaaatcacaaacatatataaaggctcaccccgtccctcctccccgtcttcctccgcctccccttccctttctccggtgacgccaccttccctttctccggcgacgccacctctcccctctctctctcttcggcgacaccgctaagaaggcgggcggaggtggggatcaacgtggcaatggcggatcgaggcggcagaggtggggatcgacacggcaatgctcggtgtggccgagtagcaggaccggcggtggccgttggtggcagatcgggtagtcggtggttggcggagcttcccgggtaggcccttcttctcccccattcactccctcgccatcttcttccccgatgcgggagttagttgaccgcaacggcttaggttttgtaccctgccataaagaagaggtcagaaatcatgagttgaattgatggcataatcaatgtacaaaattagaaagaagaaaccttaagattcaatccttatcgaaacaaagacctataagtttagcagggatttgttcatagtgagtgttaacgtggcagttccttttgagcatttcttacagtaatctcggtataggtccagcaatataagcattagattctttctgacagtcagagatacataaaacaaaagtttaagtgag

SEQ ID NO: 577 - DNA, 5861 bp, Oryza sativa
atagaacgatatatgattatctttttacaaacacgcaaattaaaattttatttatacaattaaaaaaaataacaaagtcctattcataaatcaatttgttatttttgtttctactttataagttgattttgaacatgcatatttatggaatgacaccacatattaatctttcttactacttttttttcaattttttatgactttttaagtgcatgcaaaaataagaggacatcccttaaaggatgaatggatgaatagagtttcccatagttgtatactctctccgtcccataatataagggattttgagtttttgtgtgaactgtttgaccactcgtcttattaaaaaatttttggaattattatttatttatttttgacttactttattatctaaagtactttaagcgcaacttttcgttttttatatttgtacaaatttttgaataagacgagtggtcaaacagttcaaccaaaaactcaaaaatcccttatattataggacggagagagtactagataaaaaattatatttcaaataactctgcaattacacgcgttaaatttgacactactacaatttgaaaattgcacatatttactgcattaggaattctatatctatggtttatgatatacccaaaatgcagattcccctgctgtacatgtgcatgagtgcatctgcattttcctccgtgcttatttgggttttcccccaacacagagacaaacaaaccatcttcttcaccaatcaccacaagctccccactaaacccgggagctccctcctctccttttcctcctaaattcgcttcgccttaatataggccctcctctcctcccccatgcacgagcacgagagatcccctcatatccctccccttctctcctccacacctggttttgcacgccgtcgccatggacgagacgaccaccgctctgcaagaagcagacgctaattaagctataggaggaggaggaggaggaaatttcaagagcgatgtcgacggggccggggaagaaggcgatccggaacgccggcggtgtcggcggcggcgccgggccgtcggcgggcgggccgcgcgggccggcggggcaggcggtgaagttcgcgcggcggacgtcgagcgggcggtacgtgagcctgtcgcgggaggacatcgacatggagggcgagctggcggcggactacaccaactacacggtgcagatcccgccgacgcccgacaaccagccgatgctgaacggcgcggagccggcgtcggtggcgatgaaggccgaggagcagtacgtgtccaactccctcttcaccggcggcttcaacagcgccacccgcgcccacctcatggacaaggtcatcgagtcgtcggtctcccacccgcagatggccggcgccaaggggtcgcgctgcgccatgcccgcctgcgacggcagcgccatgcgcaacgagcgcggcgaggacgtcgacccctgcgagtgccacttcaagatctgccgcgactgctacctcgacgcccagaaggacggctgcatctgccccggatgcaaggagcactacaagatcggcgagtacgccgacgatgacccgcacgacggcaagctccacctgccgggccccggcggcggcggcaacaagtcgctgctggcgcgcaaccagaacggcgagttcgaccacaaccggtggctcttcgagagctccggcacctacggctacggcaacgcgttctggcccaagggcggcatgtacgacgacgacctggacgacgacgtcgacaagcttggcggcgacggcggcggcggcggcggcggcgggccgctccccgagcagaagccgttcaagccgctgacgcgcaagatcccgatgccgacgtcggtgatcagcccgtaccggatcttcatcgtgatccggatgttcgtgctcctcttctacctcacgtggcgcatccgcaacccaaacatggaggcgctctggctgtgggggatgtccatcgtctgcgagctctggttcgccttctcatggctgctcgacatgctccccaaggtgaacccggtcaaccggagcaccgacctagccgtgctcaaggagaagttcgagacgccgtcgccgtccaacccgcacggccgctccgacctcccgggcctcgacgtgttcgtctccaccgccgacccggagaaggagccggtgctcaccacggcgaccaccatcctctccatcctcgccgtggactaccccgtcgagaagctcgcctgctacgtgtccgacgacggcggcgcgctgctcacctttgaggccatggcggaggcggcgagcttcgccaacgtgtgggtgcccttctgcaagaagcacgacatcgagccccgcaacccggacagctacttcagcgtcaagggcgacccgacgaagggcaagcggcgcaacgacttcgtcaaggaccggcgcagggtgaagcgcgagttcgacgagttcaaggtgcgcatcaatggcctcccggactccatccggcggcgctccgacgcgttcaacgcgcgcgaggacatgaagatgctcaagcacctccgcgagacgggtgccgacccgtcggagcagcccaaggtgaagaaggcgacgtggatggcggacggctcgcactggccggggacatgggcggcgtcggcgcccgaccacgccaagggcaaccacgccgggatcctccaggtgatgctcaagccgccgtcgcccgacccgctctacgggatgcacgacgacgaccagatgatcgacttcagcgacgtcgacatccgcctcccgatgctcgtctacatgtcgcgggagaagcgcccgggctacgaccacaacaagaaggccggcgccatgaacgcgctcgtccgatgctccgccgtcatgtcgaacggccccttcatgctcaacttcgactgcgaccactacatcaacaacgcgcaggcggtgcgcgaggccatgtgcttcttcatggaccgcggcggcgagcgcatcgcctacatccagttcccgcagcgcttcgaggggatcgacccctccgaccgctacgccaacaacaacaccgtcttcttcgatggcaacatgcgcgcgctcgacggcctccagggccccatgtacgtcggcacgggctgcatgttccgccgcttcgccgtctacggcttcgacccgccgcgcaccgccgagtacacggggtggctcttcaccaagaagaaggtgaccacgttcaaggacccggagtcggacacccagacgctcaaggcggaggacttcgacgccgagctcacgtcgcacctcgtcccgcgccggttcggcaactcgtcgccgttcatggcgtcgatccccgtcgccgagttccaggcgcggcccctcgccgaccacccggcggtgctgcacggcaggccgtccggcgcgctcaccgtgccgcggccgccgctggacccgccgacggtggcggaggccgtgtcggtgatctcgtgctggtacgaggacaagacggagtggggcgaccgcgtggggtggatctacggctccgtcaccgaggacgtggtgaccggctaccggatgcacaaccgcgggtggcgctccgtctactgcatcaccaagcgcgacgcgttcctgggcacggcgccgatcaacctcaccgacaggctccaccaggtgctccggtgggcgacgggctccgtcgagatcttcttctcccggaacaacgcgttcctggcgtcgcgcaagctcatgctgctgcagcggatctcctacctcaacgtcggcatctaccccttcacctccatcttcctcctcgtctactgcttcatcccggcgctctccctcttctccggcttcttcatcgtccagaagctcgacatcgccttcctttgctacctcctcaccatgaccatcaccctcgtcgccctcggcatcctcgaggtcaagtggtccggcatcgagctcgaggattggtggcgcaacgagcaattctggctcatctcaggcacaaaacacacacatatacacctccattctcttccttcctcacacgatgatcaccgccattgatgacgtcatcattgatgattcgcagggacgagcgcgcacctgtacgcggtggtgcaggggttgctgaaggtgatggccgggatagagatctccttcacgctgacggcgaaggcggcggcggacgacaacgaggacatctacgcggacctctacatcgtcaagtggtcgtcgctgctgatcccgcccatcaccatcgggatggtgaacatcatcgccatcgccttcgccttcgcgaggaccatctacagcgacaacccgcggtgggggaagttcatcggcggcggcttcttcagcttctgggtgctcgcccacctcaaccccttcgccaagggcctcatggggcggcgcggcaagacgcccaccatcgtcttcgtctggtcgggcctcctctcaatcaccgtctccctgctctgggtcgccatcagcccgccggaggccaactccaacggcggcgcgcgcggcggcggcttccagttcccttgatccgtccatccgtccatgatttggttaggttcggcgattgattgattaatggtgcaaatagaccagtcgataggtgtgtcaaaagttggttgaggttttgagttctctggtagaattgagctccaaacatttgggggaggctttgatcagtgcttctataggtgaagtgaagggcttgtgcagctcatgttgaattgaaaatgtatatcagagggtggtgtgatcatatgaacactaaacttgtttatcctttttcttcatttatgtattatatatgtactaacttgtatatttcattttccttgaattcatatgatattaattataggagctaagcgtttgtattaggtgctggaaatcataaaattgttactctgcatatgtaagtattgctactctgcaacttggctgaaagataacactaatagagtgataggagttctgtaacaaaatgcaggtggttcagtgcaatccttacaaggctgataggcgcattgcttttgaagatatagagcagtaaacacctgttgcaatgtaattctaagtgtagttggtgccaaaagaatcctgttattctttggctgtaacaataaatttgtagcctatcattcatgatcatgtactagcaccatggcttcttacatatggaccactgtcacaaggtcaaaattttctatacatggacaacagtagcaaaaggtcctaccagttgtatatgtacgctggggagaatgcagaatgttcaccagggatttaagcattgctgattactccaatgccttccaagttgaaaattttctgacgaattcagatgctgaccatgctgagtaaggacattattcatacttttgccattcaaatgcattactaacaagtcaactttgtggaatgctccagattggcatctaaatctgtccaatccaatttccataagtggttcttaacctttctaccatgtcatctcctcgtaaccaaaacctcatcaatactcagcttcataattgttattactgtgttttatcatctgatggacctgttgctgctagcagagaagagagtgatggcctcagcaaaagatacaatgaaggtcccacaaaagggataagtgccaagggcagaagccaagagccatttttcctgtcagccaaataataattcacccaggtcatccaatgcatgtgtttggtattttcgtattaggtaaggtacgatgtcattcatgacagttctctacacaaagtgagtatcagggcaagtgtccgtaccatcgccttgctgtcaagtcgttgtagacccaaaatggtgagaaggccgagagcaaacagaa

SEQ ID NO: 578 - DNA, 5550 bp, Oryza sativa
tcagctaatattaattgtagggttcttggaaggtgctaaccatacctcagggatgccaagtactatcaagtactccatcctgatcttaaaaaagtcaaaccatatagattatagattttgatcaattccttttcaacttataatcacattttatgctcataaaatatgctaatagactaacatcttatggtttttaatagaagaggaaatgagaagattaagaaaatatataaaattaaaatgggtgaactattagcttataattaattaagtaataccttttttgaacttgaaaaatagattaatatgattttttaaaacgtaccatttagcactttgtgaagtgtgcgaatgaaaaaaaaatgtgagaaatcttctcactttcatgcattgccaagcgtagcctagcgaagttccaaaaaattataggttttatagctattgaaagctcactgtatgataacaatcaacgattaaagtttaaccttgtttttttaaaaaataaaagtctctatataaaaatcaatagatttagtggtataatttactatatccattcccaaatataataattaagtataagattagatataatctagtactataaatctggataaaatgtgctactacgttgcgtttaatcctatattagattgttatatatattatgtgatagaggaattagcaattacttatattaacaagaaagggcggttggaaaaactagtgagctgagcatattaattaggcatcacgtactctttacaaatgtaccctaccaaatggaataaagccctataatcatggggtgttcttttctctgcacggagagcagaaaaagattttgcatttcatctagcctttcaattcctttctatgtctaaatatccacctcccttttctcacaagcattcaaaagctactcctcactaagggaaaagaaaaactccattaaaaataccatttaaagcgtctataaaaacaataaggccccagaacctgctactatagccaaagcaattcacactcgcacgggctcgagacggcagcacagctccactccactccactctcccccaccacaccacactgcactgaggcataccgacgaacacctttggagccatggctccctgcctcctcctcgtcctcttcctcctcccggcgctcgccaccggccaccagcacccgtccaccctcggctcctccgccctctccgagtggcgctccgccaaggcctcctactacgccgccgacccggaagacgccatcggtacgcatccaaagctagctggctctctttggtcatctctgcatctaggaacgaatctgtccttgcgcttctttaattctccataactacccctaaggccatggaagatttctcttcccgcatgtcccgcggacgaaatttccctcaaagccgcacgctcggttacttgaattatctgcgcgtacggttggttcttgaattggttgcttcctctatcatggtttcatccgtaggagcgtgcttgatttgtgccgtgctgttgggcggattacaggtggcgcgtgcgggttcggggatctggggaagcacgggtacgggatggcgacggtggggctgagcacggcgctgttcgagcgcggcgcggcgtgcggcggctgctacgaggtgaagtgcgtggatgacctcaagtactgcctccccggaacctccatcgtcgtcacggccaccaacttctgcgccccgaacttcggtctccccgccgacgccggcggcgtctgcaacccgcccaaccaccatttcctcctccccatccagtccttcgagaagattgcgctctggaaggccggcgtgatgcccatccagtaccgccggtacgttcgattcttggctgcatcctttgattgctgctatctttagtctactttgcactggattctagactagatctgaggtttatgtttcccattttcttaatccactttgtgtggaaatgtgaaagtgcttagaattgcgtcggttggtagaatgtgggatcccagaaaagctgaattataagtggccgttgtggaggaaaggaaatgggccgtcttccaatacggtcaacttctgttagagcacccgcaatggtaaagtaaggtgctctctataaaacatgtacatctcagcaatagactagattaatagtaaaccacctcaatagtatgtctacatgggtatctatagctctctaatgcattgcctcgtttttctctatagactatctccaggttagtagatagctttgctctctctcttcatttaatctcttcaatgtaggaaaatatgctgacatagatatcttgtagagagcctatagataaccattgcgggtgcccttagggttcagttggatagtttcatggtcctttatgctgtagtgtgtttaggtgtctaggttaggagaaaaaagggcagtacttttaaagccttcagccatttgatgcaccattttcgtaagtactgttagagttctaactgtttcagttgatttgcttctggctcagcagcacaagaaactggtttccaaaaaaaaaaagcagcacaagaaacttggtgtatgcttcagttaaaaattcatatagtttggaataatattttgctggttggaattaaaacgatgcaacttacatgcaccattgatcagaaaactagcagtaacttactattgtcatctaaatgtcgctcgtgagaattcatttattccattactctactagtttaaggttgctagctagaatccggaggctgtgagctatggacctgcaggtaacagcaactcacaccgaatttatgcaaacagccttcctcatatctgagttagtttacgaggttttcccaggctaatcctaataatcaagactcaaaagtacacagttctgggtaatttccagcagtttttttaatctgtatcggtaggcactaaggaatgttagtctgctccattacatagaccgttttccatcacgcttaattcctttctggggtacattagatgttcctttaagctttcaatgaccactaagttagtcccacaggttgaattgctgcattatttgtggactgtagctgtccttaatttgctttctgtactagcaatttataccggttggtatgtctttcaagtccttcaataatttgatctgttatcaaaactaaaatagtgttaaacagatcagttcatagtcaggcattatcttttcctgcactagatttttcttcacatcttagtgctctagatctaaataggttacaatcttccagttgacgtctgtaaattagtgtacgtcatttctagtaatattcaagaattaattttacgaaccccctaatgtgatgctgaattaggttgcctgtattactttctcaaatattctgaggtatagttgagtaatgcaatatccattatgtgcgtttaagttggcatcaaatgtgcgtctaagttggcatcaattagatgttcaacttcaagatggtttcctgaatatcatactgtcatatttatgtgcctatcatacttcctcaagatcgatgttccaggacattttgtagagaacatcaacctgcagcgcttttaaattatttcaggcttcaccatatgttacagggctcagttgttggcaggatttccatgagagtgacaatctgtttgaacggattgtttcactgagcagtgaaccatcacaaggacagctgtacaaggctatcagtaacatgatagcctgtagatagaaagcaaaattattgtagattgtaaattggtcagcaaaaattgtcaattgtcactaatcttggcgtgtttaatttgtatgcagcgtcaactgtcttcgtgatggtggtgtgcgattcgcagtcgctggtcgaagcttcttcctgacagtcctaattagcaatgtcggtggtgctggcgatgtccgatcagtgaagatcaaaggaacggagtccggttggctctcgatgggccgcaactgggggcagatatggcacatcaactctgatttcaggggacagcctctctccttcgagctcacctcaagtgatggaaaaacattgaccaactacaacgtggtccctaaggagtgggacttcggcaaaacatacactggcaagcagttcctgctctagagaggaaagggtaccaatagcagcttacagttacaaatttttttctgatcctatgagttggattgtactattgtatattcctctgaggaacgataatagtatcattagagaaagaaatgtttagtgcagagcctccaatagtagtccaacatagaaaaggtgctcataaatgtggcatgtaccatttggaactctgataattgcactacagaggcttgatgtaccattcaaaatagaaggctgtacctgttgtctcgattgtatggtaattatttgtagcaattaaacagtgtcatacccttgtctgtagatctttgttttgtggaggctgcattaagactttatacatgtaatgtgacatggtaacaaggagcaactgagcaaagtactaactgtactactagtaatttgcaagtttacaaacaaggagcaactgagcaaagtactaactgtactactagtaatttgcaagtttacatcatgctagaccaaacattgtgttgtactacttcaccaaggagttcacaatattcagactgcaatactgcatctcttcaggtacactttggtcagtttcgattggctttcaggaaattacagatgcgatgcacaaggcatgacgcattgagaggttggacagattcaaacagatagccatgaaaaaatatgcatcaaacctccaaacctccatattttcggtcataaacaaggtttcattgaacagaacaaggtattacatccagtcgaccagaagtcgaaacttgatgaaacacaccgacgactagaacacaaggagtcacagacacaacgacacacacggagcacacgacataataatgctagcgctgctacgcccaacaccatcgaatctgtactcgtctagcctccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatgagcccggagatgcgcttgacgccgcccctcctcgccagcctccggatcgccggcttggtgatcccctggatgttgtcgcggagcaccttgcggtggcgcttcgcgccgcccttgcccagccccttgcctcccttgccgcgccccgacatcgccgcagctaaccgctccgatcaccgagagatttggaatttgggtggagatgtggaagaagccttgtgtggaattggggattcggccattcgggggatgaatatataatggtggatttgggagggaatgcgaaattttgggttgggaattgggagggctgaggcgggagggtggtttcgggggttggatggatccgtgggagcgt

SEQ ID NO: 579 - DNA, 3299 bp, Oryza sativa
gcgacgagaacggtggtggtggtgacgagaacgccgcgagcttccatggcaggttcttgtcgcgtccggtgcgggggaggaggtggcgtggccgccgtgttccgtctcgccgccggcgccatccatcggtgggcaccggtcgatgccatccacgagagagagaagggtgaaggccgaaggggaagatgaaaggtgatgaggatagagatgacatgtggggcccacgtgggtcccaccattttttaattattttgtgtgtgaagctgacatgtgggtcccatgggttttattatttttttcatatcggattgccacgtaagcgccacgtcaatgccacatcagatgaagaccgagtcaaattagccgcgtatgcgccacgtcagccaaaacagcagtctaaaccgccgagggacctcgtttgcaccggttttgatagttgagggatctattgtatctggttttccggttgaaggatgaaaaccggattcgttgacaagttaagggacctcagatgaatttattcctctattctaagaggataaaagtccattcggccctagaagttggccttaaccaacccccctcccctaaaaaaaaaacttttaaaaccgtgtactagaccttcaaaatttcaatacgagggcatctgacctctttataacgttttcaatcttttttttttggttcttctggggataagattcaaagaaaattaagctcaggaggattattgggatgcctgcaggccggcatgaaattaataatatatctgacttaatatgtaggagtaatatgcgtggcgagcatgtcctgcaagcattagtcacacacattttttaaaaaaataaaaatgaaaacaaattaatcgtgcgctcatcaacatttggcgcgatcgatcattaacgtggcaggcaccaactaacaagagctagctagatcgatgtacccatgcatatatactccagtagctagctacaatcaaatcatacgtacgctagctgcacatccctcgccgccgatcgacgacaatagcatggccagcagctggaataatccggccatcttcctcgccgccgcgctggcggtggcgacggcggcgcaggtcgtcacggccggtttcaccacagacttgtactggcagcaacagccggcgcctggtgccgtcaccccctacaagacatcggactggcacgacggctccgccaccttctacggcgacccctccggcatgggcgacgacttcggtacgtagtatcgtcttcatttcatttgcttttctctccggccatgaacgccgacgagctatataacgaatgcatgtactactactgctatataggtggcgcgtgcgggtacgtgtcgaacgacatcgtgtcgctctactcgacgaagacggcggcgctgagcacgccgctgttcgccgacggcaacgggtgcgggcagtgctacgagctgcggtgcgtcaagtcgccgtggtgcaacccggggtcgccgtcggtggtcatcacggggaccaacctgtgcccgcccaactggtacctccccaacgacgacggcggctggtgcaacccgccgcggcaccacttcgacatggcgccgccctccttcctcaagctcgcgcagagggtcgccgggatcgtgccggtgcagtaccgccgcgtgccgtgccagaggaccggcggcgtcaggttctgcctccaggggaaccactactggttgctgctctacgtcatgaacgtcggcggcgccggcgacgtctcctccctctccgtcaagacctccggtggcggcggcgcctggatccaggcggcgcacaactggggcatcacgtaccaggtgttcgccgcgctggacaactccgacggcctcaccgtcaagctcaccacctacagcacgccgcagcagaccatcatcgtctccgacgccatctccccctggtggatcaccggactctgctaccagggatccaacaacttctactaatcatcaatcgatcgatcatcagatcgagttcaaagttgcagtggttcatctcttcattttgtttcttcttcttggcttgctctgctatgcgatgcgatgctagctattgtcaaagttcatggactctctgtttctttcttttgttcatagaacgggatgcatttctagttcaatgtttatgctaatccatcttctgttgagagaattctttttccctttttcaaaactttcaaaaatggtggattgattatgatgtatacttgatctccgcataagttcagtaaatatatatatccctgaaaacaaagtttggtttcctctctgtgtatagctgtctggactctggaattcgtgccaccaactagatttgatcgagaatatcacacatatatcaacttcttttcaaagatctaccaccacatacataattgatatgattattcaatttgattggtttatgtatatccgatccgaactgcacagcatgtctgttggtcaaacacaagcctgaatacaatgctgcatgtataggcgccactaccttctcctcatagcaagattatataatatcgacaaataaatttagcaacttgctacaaacaaattgtgtataactcgctcagtcaacaagttgatcctcatcaacacattcacttctcttctgtgaactgtttccacaaccacttctgtaaaatctgaatattttcaccgtcttccaatgaccagctcagtgtcaacatcaatatcctggacatgctggttctgattcatctcgcgcgctggagccccgattggagcatgttgcaccttgccctccacaaacaagaacgaacaagaagaaaagattcatcatcatgcaaaagctgacatgtatagatggatattaacaccggtcactgtaagttgcattggatagatagcgccttttgccccacatgtcagtgacattattggcagattaatccggcagctagtaggtgcagtaaataggcgtgtggttgatgatgagttttttaatgatacctgatcgaggagcagtgcgttctcctccgacagaatcttctcctgcatgttcagtttcgtcagttaatcacacatggatatatagataatcttttgagatttgtatttgtatcaacatcttttgtaaagcagtacactccaggaagagacggcttgttgaggcgaacaagtgtttccatctaatcatactgatgtattactaacaagttatgcaaaaatcctctttcagaacaataattcttgtcagccatgctttgatatatattatattcagatacataagtgcatacctg

SEQ ID NO: 580 - DNA, 4927 bp, Oryza sativa
atgcggtagaagaggtgaaaccgcgcgcaaagcaaaagcagtggccaaaacgaaaaggagaagccccacacaaacgcaggagaacgtcaagccgtcaacctgcacaggccaccggccatccagagccacagccgcggctggccggccggcagcgagagagaggtgcagtggatggaaatcggaatggcacaacttgcgatggaagcaaagcgaaaggcgagccaatcaacgccccagccgtttgctccgtgtccacgaacacgcgccagtggccgcgccgcttttggtctcccctttccctccgctgccgccgctccgtgtcatcgcggccgtccatttagaacgaaggggatgacacatctgccactggcgtgtggggtccccgctgtttacaccggctgcgcgaaaggctggagcgcgaatgatagggccaaaatctggccgtgccaatgccattggcgaattcgcgttacgtctacgaaaatgtggtgttgaacttcttttttttgttcgagatgacagttacgaattccaaacggatcgttggagattgtcgtgttggtgtttgatgggcaaagatttatgactcgtgggctcataccaggatcctgtacgatcttgcagccgattccgccgtgcatcatgcgatcggatcacaacttcacaagcaatgcaaggcaagaggtaattggccgtggaatccaatacgatccgagttactcaattccggatccactgccctggcttccaacagattaatcaccaccaatcggtgaaaagagaacaaacacttcgcatgcatgcatgcacgcaaagattaatctgctcatgcttttgctttagttcgaaccaagccaaaaaaaaaagaaagaaaaaggagaatgaatagttccaactgccccgcggtgcacgagatgacggccgcagcgaggaggcaaaatcacagctgtggcagtagtacttgtacgtacacacacagtagtagtagtgtactactgctattgctactactaccacgcagcgggtgacacacacacacacaaaaagtcacaaatctctacgttttttttcctcgcgaggcgtagggcgcgcatacgcgacgcgcgccattatttggtccgcctcgtgcctccataaataccgcctccgtcccgtccgcctcctcccccacactccactccactccactctcgccgctcgccgttgccactcgcactcacaatgtcgccggcgccgcgggtgttggtgttggtggtggccacagtggtggcgctgcaggtgtcgccggcggcggggcggatcccgggggcgtacgggggcggggagtggcagagcgcgcacgcaacgttctacgggggcagcgacgcgtcagggacgatgggcggggcgtgcgggtacgggaacctgtacagccaggggtacggggtgaacaacgcggcgctgagcacggcgctgttcaactccgggcagagctgcggcgcgtgcttcgagatcaagtgcgtgaaccagcccgggtgggagtggtgccacccggggagcccctccatcctcatcaccgccaccaacttctgcccgcccaactacgccctcccctccgacaacggcggctggtgcaaccctcctcgcccccacttcgacctcgccatgcccatgttcctccacatcgccgagtaccgcgccggcatcgtccccgtctcctaccgccggtaaatataatctctcaccaccattcttgctgctagtactgcatttcttggtgacgacattcgccttggttagaggagcaggaacagtagtacttctaggcttgttttcttggtccaatggaagcttttgttttgttttgttttcatttcatttcgcgtcttttgagacggcgtggggctgctgctgctgctgcttctgcttctgcagcgttttggactccagccacttctgcttccgcactgctttattactgtagtaaataaatttgatacggtatactccagcgcgtagtggctgcacggccaggtgagtaatattttccgagtgggatggaaatgtgcaccgacggcgcggctttaaaagcggaggagcgtgatagtagcggctagaaacgctgctcactgcccgtaaaaagttggcttggtacgtagctataaatggggtgtcccgtgttcgctttgcccttgtgcatgtactcgtgtaccggcgctacgcaccgtggctcgcattgagccgagcccaaactctgcttagcgcttaatcactgccaattttttttccatacatttgcttgtagtagatctcatgctagtggttacattcccatgctttaattaacagtacagtagaaaggaggagtagatttttgggagcattggcctgaataattgtaccactacaccataaagggacacaaaagatgtacagggaaaaaacagcactgttactgtgcaaatgtgtgtagtgtaagaccactgggcgcactggcagcagcgagaggcccagagaaacatccaacgcgagtcaagcgtgtagttgggaggagtagtagaattccgtagggccaaggcgcacaggcaaaacgcgcacacgcgcttttgacctttttcgctttccgctgtgttgtcctggcccggttgggtggttgggttggtgccgccccgtgatcccgctccgtacccgcgcctccctcgcttcgctctccgcaaccttggcgtggcgtctcgccgtctcccatgccctggcgggaaagacgacggtgtgaggtgatgaggtgaaatggcaggtctgcccctccgttccttctgtggctggtcccctactgcaggggccttcccgtcctttcgtcctgccggcacaacgttactacgcgtgaggaggctgtgtggccccatctctgcatgaacgactgcactctcttcctggtcatatgtccttgcctccttttggctccttgctacctatagttacagcgaaataatatttgctcctactactagtattgttctgttgatcttgattttaatgtgataataatgcgtggttaatgagtgatgaaaatgttggcgtgtgtgtggtttgcagggtgccgtgcaggaagaagggaggggttcggttcacgataaacgggttcaggtacttcaacctggtgctgatcacgaacgtggccggggccggggacatcgtgagggcgagcgtgaaggggacgagcaccgggtggatgcccatgtcgcggaactggggccagaactggcagtccaactccgtcctcgtcggccaggcgctctcgttccgcgtcaccggcagcgaccgccgcacctccacatcctggaacgccgcacccgccggatggcacttcggccagaccttcgagggcaagaacttccgggtctgaattgaatgaagcaaaactgcaatataccctcttatttactcatctagtaattactgtcattatagcgagcaggtgtgttttttaccttggttaagtttgggttcttcttcggttggtggccttgtcaaagtgaggggccgggggaaaacaggtggtaaagactagtactagtgtcaattagggttaaactggtaaattgctagtactgctgttactcatcatcatcatcgctagtggtcactgctagtagtagttgtgctagtgcatgtatggttatggatactgcatcatgttggttggtgatggattttgtccatgttttgccaaggggtttggtttggagttgggggtgatggggaggatttgtgctcaaagagtggctgaagtggctgcaaagctgcagctgaatttgggggtggtgagtgtagcccgcagccgcttgtgccgtgtcatttgtctctatggcacttgatgtttatcatggacttgatttatcattatggtgattggagcttgtaagaagattaattgcctctgttcctctcgctctgtgtgtgtgttttatgtgatgttctggttgagcatttcagctttgtagtgctggaatgatgattcttgccggcttctttccgtgaatgcattctctgtgttctccgtgagttgctcgatgggggagtgccgaaattacgtgaaagggataaaggtgaaagcaaaagtgcgatgcgagtagaccgctttgggaatgattttgcctgttccgttgcctcagttcagatgcaagaatggttcatgattgcgatggcgtgatcggccattccattcctaagcacggcttgcagcatcatgcattcatgctggccttgcaattgccatcggagggctacttcaggattgggagttatcagtctgcatcatcatgggatggaagaaccaaatgcgcaacctctcttccttaaagtcaacatgctggatagccatcatcaggtgtgttggggccgaaatcaatggctttgacagggaggttagcatttgacagtgtggctatagcccatagctatttgataaattgttatccatctcgccggagatttcggcccaaaccacttcagcatgacaccatcagaccactgaacacaacagtagacaccactcagtatgatccaatgatgtgttgatgacaatgtacctatggtgcatgctgatcgatgagctaccaggaaagcttgaacccattgagacagccacgccagatttgtaacatgagctctactttaatgccatgagtttcgacatacaacagcatctagttagctgaagttaagaagctcatgataatgcacaaaaaggacttgttgccaaaagactgatgacaacaaggaatatgcacaacatatttacaaactaccaaataccaactaatgacactcacattctgccttgctaatgggagcggaccaatgctgttggattcggaccaatcttttcccgagtttctcccaagcttttccgacgaggcttaccgctgttcttgctagcatttgcagt

SEQ ID NO: 581 - DNA, 5712 bp, Oryza sativa
gaatgtgagctaagctcaatgagagaagctaggattgcaaattgctgaagtactccaactgacatgagatttttcaatagtagcaggtcagttttgacagtgaccatccaagtgcaacgtcctctgctctgacattgcttagcattgctaaccgaagcatgcacactgcgtaatagagtggttaggataaccccttattgtaatgtcacctttgcaaatccttaactgctcggatatttcaatttggtcaccagagatggcaatcctacaattgaaaatttgttcagttgccacggatccatcattaatctggcaatggcggcaacctctgacagggacaatggcaaattcggccaatagtaaatttcggtacggtttatcctagttggcattggcacacatggttcgtctcttctacgagtatagattatgaaaaatgtcaacttacaacaggtgacgaatttcgcaaaaaaaacgtattaacattcggcatggaaaacgtacgtagaatgaccaaaaatatccatccctatagtatcatttctttcaggggagcccccaatctacaaaagaaaaagaatttgttcgtcacccatatatcggcgtcatgacctcgacgtcgcgctttatccaggcatatagtttacaacaccttgtgaattgaaaacccacaattatttcagtctaacagcagacagaggcaacgttgctctcgttgtcgttcacggggggatgacgcgcggttttatgccctcgacgagaatacaaaatcaagtatgcgtttctgtttctcggccaatgctgatccgacaacgtgtttgaacggattaaacaaaatctgaatccccgtcgaaaaattagaccagaaacaatgatcttatgctgattaattagggctaatgagctatgcatgcaagcactgtacccagtggtgctccgacaagtaggcctgcctaatcaaaaggcagtgaggactgtaactactagtacctgccacctcccagttgctcaggcttctcaaccttagctagctcgatctccctataaatactcctgctcattaccacaacgagcaagcgatcgacggagcgagcgagctagccagccagtgttagagcttgagctgcttgttcttcttctacctcctgcactcgcgtgctgcacaagtagctcagctagatagagcgtcagaaatggccagcaacaactcgagaacaaactccagggcgaactactccaacgagatccacgatctctccacggtgcagaacggcaccatgcctaccatgtactacggcgagaaggccatcgccgacttcttccctcctcacctcctcaagaaggtgaggagtctggagctgaatgattaattcttcagactttcagagctttatctgtctttctctggttgcttgattgattcgagatcgattgagctgggggggagctaatgcgtgcacgctgcttggatcgccatggctgcaggtcgtgtcggaggtggtggccacgttcctgctggtgttcatgacgtgtggggcggcagggatcagcggcagcgacctgtctcgcatatcgcagctgggacagtcgatcgccggtggcctcatcgtgacggtgatgatctacgccgtcggccacatctccggcgcccacatgaaccccgccgtgacgctcgcgttcgccgtgttcaggcatttcccctggattcaggtatgcagatgcagcaacacagctacctcaaactgccaattcttcatatatattacttcttgcatcaaaatatatatgcaatataatagttagctatgtgtacgacttaagccatgcactacttcggcatactagctagatgctttcttagtttctttcaatctgttctttgccaaaagatgttagcagagacacctaaccaattgagtgctgattgaatattagtagtcacataagaattttttctgaaacgaccttagcttgttccggttgtctttttacatatgatggtatctgaatcttgttaaatttacctccgatagctacaattttcagagtttcgtcagctttgatcctctccatttttttaatttttgacgcaaccctcttcattatctgaaaaactttttaaatctcaagagagcaaaatcattggctaatttagtcctcacttaagtacttagtttattcacgcgttcttgtcaagatgttgccatggatttgattctgccaaattaaatctctattttaggcatatatgccaaattattcagtctagcttatgtcgccggccagaaagaaagtcaaaaggcaacgagaggtggtatatgctcatgtaacttgttatccgaaccaaccaatcacatatctttcaaggtcattaaacttatatataccataatgatgcacacatccgcattgtataaggaattaatgtcgtctcttctgtcaacaacatatatcgaccttaatccataggtccttttcactacacatttgtctagctagctggagcctgaaagcaagcaaccactccatatcagcaacacacaaacaatagtacagccagacaacacgttgggcagtagcatgtgatcgatcgatcaccagattaattaagctcacatcaatcaaaaaatcagacatctgaaatctagcatgaaaccgccacaaacaattcaggctcgtgctaattgaacacgagcaatcacgcgtcaaaaccccagcacagccaaattaaagatgaagccactaagctgggatacgctgagttagttgccacggatcacattccatatagtctatttttacatcgcaatccacagggcacttctgctgctgctgctagtagaagacaagagtatgatcgtggtcgaggcttttttgttgccactgcacgtaaagctagcagggacaagtgtccgtagcgatacagtacaggagaaccggtcgcgacgcaagaattcatgtaaaggcggtggcgtgcgtggtggttcatgtgccatatattcggtcgatcgatagggatccgccggaaatcgatcgcctgtggcgccgtcgtccgatcgatcggcaccgaatccggggctaagctagttgccgctatctgctatagtgctatatatctatctatatattcactagcacacacaccggtgaggctgaccggaaccgattcgatgttcccggcttcaacagagacatctcgcaatgtgcagttagatactactgcgactgctctagatcgatctccagctagaggtgcagggttaaagcgttgaaatgaaacatcttttcaacctattttttttctcccttacacaggttccgttctactgggcggcgcagttcaccggagcgatatgcgcgtcgttcgtgctcaaggcggtgatccacccggtggatgtgatcggaaccaccacgcccgtggggccgcactggcactcgctcgtcgtcgaggtcatcgtgacgttcaacatgatgttcgtcacgctcgccgtcgccacggacacgagagcggtacgcgtcgtccacggctttcacctccttgtcgtcgatcgatgatgactgaattttgccgtaaaatacatggactcttgaccggtgtttttttccatatgcaggtgggtgagttggccgggttggcggttggttccgcggtttgcattacgtccatcttcgcagggtaaatacgctagaaatcgacggcccgttaatcaatcagctattcaattcgttcattcatgttcatgaccaagaagattagtactagctaattaggaagtaattaacttggagctagtagcaagaccaattagttaatttgtagccacttgactcctgacaagtgagaggggggggggggaaaagtcaaactaacctggctaatcaacattatctttgatcgatcagtaaccaaattaataaatgtagggaaacatacatattgatcaggcagaacgtagaaactaaactagttgagcagaatatacaatggagactgagacgcagcgaaaaacgagtggtggttgcagggcaatttcaggtggatcgatgaacccggcaaggacgctggggccggcgctggcgagcaacaagttcgacggcctgtggatctacttcctgggcccagtcatgggcacgctctcgggagcatggacctacaccttcatccgcttcgaggacacccccaaggaaggctcctcccagaagctctcctccttcaagctgcgccgcttgcggagccagcagtccatcgccgccgacgacgtcgacgagatggagaacatccaagtgtgataggacgacgagatgtcgtcgatcgtgtcctcttactcggaaaattaccagtcgatctcggtctcgtcatcactagctacgtctttgtgtgtgttttgtgtcgtgtcactgctgcttcgtacacgccggagagagttacataaaacgcgcgcgcgtgcacgggggagtggcgctagctttggttgcttggtggttcgtgtggggtacgtagattgctcgctctgttaattccggggctggagcctgctaattttgggcgtgtgcgtgtgccgcttgtgcatcagtctctgccgtcaaattgtgcgtgtgtgccaggtgtactatctctccagcagttgcttgttccacttcaattcacccccaaagtaattaaaaggatgtcacgttctctcccctatataaaacatctgcgactttatatattgttgtgggggttgcatgtcttgcatgtgcgttatcattccgtcaatgattaactgatgatgtcgctaatgatcgatagagcttggttgacctgaacaataccgtggggcactggaaagagtattgtcatgatatcggcccctgtcgcgggcatgaacacttgttgagaaaaccgtacaaacagcactaaaacagtgtgttttcatgggatatggcaccttagttttctcttctcctcttctccacgtcaagaaaaagctatacggcgaagcttaaaatgacacatttactgcttttttttcatgctctaattaatgaactgcttgcttggagtaatcatttagagcctagctgcctagatttatcaacttcacttttatggcgtacttctcaaaattgtcggcagtcggtgcagattttttttttttatcgacacagagtgtacttcccggtaaattggtcggcaccccattttcttcaactatctacatggcatttgacagaatacatatataaggctgagttcttttttcaactttcacaactcacatatctcgttttccacgcgctcgtttttcaaactactaaatggtgtgttttttacaaaaattttatatacgaaagttactttaaaaattattttaatatatttttttaaaattagtaaatacttaattatttataagaaaatgtgtcgctacgttttgcgtacgcgggaggtgaacctcacctcccgaacacagcctaaaaatattgtgaattctaaaccgttgaatcattttgaagttgtgcaacatcccctccccagcctctcctaccaccgtaatattgcgtgcagatgctccctcgcctcctaattgccatctcggcagaccagaaggtgtcaacccccccccccccccgcgccacccctcatctccttagtcggctggcctcctcccttcccatgccccctctttcctaagctggcggcggtaagtgcctgtaacatcccggcct

SEQ ID NO: 582 - DNA, 7060 bp, Oryza sativa
aagtagcaaccttcttatctatatgtttacgtagtatcctgatcagcacctaaatcaacaaaattagtcatgtaatatccttttgaccttagttcgcacgcgcaagataagttcgtgtaccgcattttacaagttcatgtactagattgcacccacctaacaagttcgtgtaccgccgatgcaatttactctttgcattgtcggtacacgaacttatcaggtgggtgcaatctagtggacaaacttataaaatgcttgttttagtgcacaaacttgtatggtgcgtgcggtggaagttaaaaaggacactatatgactaatcttattgatttaggggctgattaggatactatgtaaacacatacatgagagaaagttaccattagacatcatattcaataaaatatagaataggatttagtgatagtagaaaaatattaaaaaacgagcactgatataagggttaaaaacatatgaaattcatcatttcaatgatgaaggatgaaatagagactaaatttataaatattacatgtcttatgcatactcactacacgtatgcacgtcacatcctaatcaatatcaacttcgtaaaattaatattgccaagttattttggtcctcgttcgcacgaactagctagataagttcgtgtactggaacgagtattttacaagtttatatactaaattacacccacctaacaagtttgtgtactaacaatataatttactctaaaatatatttatattgggtagttgttaaagtgttcttaacctaataataagtagggggtgtttaagtttcttcagccatgtttttaatccgttggtcgcaatttgcatcattattccgcttttctttcttcaaagttctggcgcacacgttgccactctctcccctccccagtccccatggaccaccatcccagccgtccaagttggccgcacacacggccgaacaagaaaagcctcccatggtggagtccgcggcgcgcgtgcgcctcaccgggccgcgcaccaggttctctctccccccctccccatccctcccctcccctcaacgaaacgaaatctcgatcaatctctcctccattcccgcatcctctctctctctccctcctcaccctcacctcatcgtcgcgacaccgaggggaaaaaaaaaagcgatcgccccaatcagattcccccccccccctcctccccacttccctcgtcgcctccgaaaagccaagccgctccccgccgcgccgatcgcgccgccgcagccccaggtacgcctcctctcctcccatccaatctagtctcagtccacgccgtctccatcgatcggccccggttggagcctatggaacaggagcggacgagcgcgtgcccgccggggagaagctgggggtagggggtttttggtttagggttttgatcgcgacatgtagggcgtgggagtttggtgggggggagctgctgtaccgcatgctcgtgagcggacatgatggtgttggtacagggaattatggggggttgattctgtgagggtacgaaccgggggagcttcacggcagaattattaggtagtactgtggagtggtgtagtgctgtgatggtttgcttccgccctagaaacaggatattctagtgcttaaccattggttgccgtactgtgagttaatcggtgcaggcgtgatagagaagtacacatttcatgtgtgtgtgtggcaaaaaagtcttaggtaaagagttatttgcttgatagtaggaaaagatggttggggccagttgtgccaccactattcaggccatcattatggcgccctgttccacagagttctgcatgtgggtttgctatgcaggaaaaatatcactttatagcttcaagaaaaatgttaactgaataataccttggaactggaatttgcggcatttttgcaatgtagctagaagtcgaacctgcatcgcaggtattacattttaacttttccgaaagtatccggtttgtaatgctaataaatgaggtttatgcaatgtaatctaccattggagtggtcaaaatattgggggtgtaaaatttgttgttgtgcatcagtgtacaaaaggtttacacctagatgtacatttcatggcttagccgtttttgttttctgcttgtgtcatctgcttgacactagcaacactgctgcttattcatgattagttccagcatgcttaaatgtgtgaaatattatttacagtctatatatgttccttacaattatactattatttccatgacctcaaaataagctcacccctttaactcttcatttcttaatcatgtacagagtgatggactaacattttgggcgagtttgatctgtagaaaggcattcaaactattttatgggaaagaagcaaatcttatgcactatttgcagaattgcagtgagggaagtttgatctgaggcagttgcaaaacaagtatttctggagagatgtcatcctccttgcctattctaccgaaatctttgaaagatatcccaagatcccataatacccagaatattctgatgccagggcaactgccaaatgattctatgcctttgcaccagagtgcaactcaatcttctatttcgcacccaagagccagtgttgtcagatcatcatattcagcaatgttaggatatgctgctaacccaattgattctgtgtctagccatgaggggcattttatggctgctccctttatttctcagtcgtcgaatgctgaaatgctccagtatttatgtaataataatacccatgggggacacactgtgccaacctttttcccagctcctgcctgtggcgcgccagattacatggatactataactgtccctgataatcacacccagagcggctcctctactgttacatctgatgctgctaaacaaaatgaatggtgggcagatataatgaatgatgactggaaagatattctagatgcaacagctactgattctcagtcaaaggtatgtaactgcaataccataaagagtaaagttgtatccctttcttgtgttctggaagtttagaaatacacctatttattttaacatgttgacgaaagtttctaacactataatctattgagagtattttgacatcatcctactggtaatagtggtaccatctgcctacactctaacccggttactaatttatatgatcgtgattaattttagagaaattttgcctttccagcaacatacttctgtaaccatggcggtatttttttcccttattacacaagggcattttgttagtttatctattcatttattgaatgctcgaaacttgtgtgagatgtcatttgttaaagtgattacctgtacaagagcaatgattacttgttccttggcttgaagagattgtggctgttggtagattaaatatttgattcaatgtgttaaaaatcctgtaacgaattgttcatgttcttgacataggctgctcctggaaattctaagcaatgtatactgcatcttacctttaacgcattttttttgtccctgatgctatagatagcgctccttatgtttctaccctggtcagaatgctaaatatttatggatctcttttgttacagtccatggcccaaccttccaattctgctgcatcacagcctgctttcaatcagtcaacttcatcccatagtggcgatatttgtcctgtcacaagtcctcctcccaacaacagcaatgcctctgcaagtaaacaacggatgagatggaccccggaattgcatgaatcttttgtccatgctgtaaataagcttggtggtagtgaaagtatgtcctccgtgtcgtaaataccactcaagtggttttctcttatatatacgaatcctattctggcatagtctaatagttttttttttttaaaaaaaaaaaaccttcagaagctactccaaaaggtgtgctcaagcttatgaaagttgatggtttgacaatctatcatgttaagagtcatctgcaggttctttttttaatctttctaaatgtcatatttgctgaaaggagacttcagttttgactttctttatctgcacttatttttactgcagaagtaccgcacagctcgctacaagccagacctatcagaaggtttatatcaattgggttcctctctgacttgcattttatttatacatattcttacatacgggaactcatttttcatggcaataactttttttttagaacttcatggcaataacttaagtacaattttcatgataatggcaagggctgtgaatttatttgtaaaagcatattttcatgatgaaatattaaatacttagtgtaagatcccttgttgcaaaatagcacgcatgcaaccatattctagtttatgtgagttgttaagacaactctgaccttttcttaactcatcatgcaggtaaaacacaagaagggaaaactaccgatgagttgtctttggacctgaaagcgtgagtggatattattattccatcgtctcttctcctgtttcattgtacttttggtacacttcacatggcgctaactaataagtagggtactgtgtggtttacaaatcaacatgcatcaaagttcagatcaagagcgtaggcatgactggatggcagattgcattaccgactaaagtaaataattgccttgagaaaaagttggtcgcacatatatatttgtgattcacttgctagcatggtttcaaaataagagtagggattcgcctactagtatggttcaaatctacagtttgctcatatagcacaatagaagatatatccattttacttcaaattatgtttaggagttaccattatgcattattgagggaatggtggtatttcatgttcatttttctgttggatcagtaagtgcaccatgttcttcccagtcaccagtactagatacccttgcattatgttgttttgcttatgtaggagcatggatcttactgaagcactgcgccttcagatggaagttcagaagcgccttcatgaacaactcgaggtactaattcaaaagcatgtgcactgactctaaatttggttgaaataggctcatgccaaatgggcaaatggcaccttaataaactaaaagaggcatgcaacaattgctacccttttggggatacaaatatgagactcagaaatgttcctttcgacactagtttgtggcaatgaacaaaattgtgactgcaggaatgtggcatgctacaattgcactggtcttaataatataggggtaggacatgctcatatacttcaaattaaattcccatgacctgaagcacatttgattgctctattgcagattcagaggaaattgcagcttcgaattgaagaacaagggaaatatctgcagaagatgtttgaaaagcaatgtaaatccagcacacagagtgtgcaggatccatcgtctggagatacagcaactccatctgagccaagcaattctgtagacaaggacagtgaggctgccttggacccaaacagaataggagacaaccaccctaaaaattctaccaatgtaggtgccaacctgaaaactgcagcaaccgagtcccctgattccccagtaattgcaactgatggatcggagctcccccaagagaagcgtcgtagagtgcatgaatcttgacagttaactcatctgaatgtagagtgcattcagattatagctgttctgcccatgtacttggtaaaagaaaaatggttccatctatattggctgaaattctagtgctgatccaagtctattgagctgaactatttaaaaggaacataaaaaagcctaatagagaaggggaactgtttggtgtccgcttgtattataattcagtagcaataactcaaatttatctccggtactatgaaataaggagaatttgagatctagccatcttcctgggtacaatttttatttcagggagtcagttgtaaaaggctacggaactccctcttcctccttgcagctcagaagatattgagctaggtactgaaatgtcccgagttactggtatctcttgaatgtgaaccaatggtttttttttttttttggaagtacatgaaccaatggtggtaaggttgaactaaacctgtttgaagctttcaagtcaaatagtcttatggtgatttctcctcgaggaatccaaactaaaactgcaatagcctagccggctgtatgattcagctgcttccaacaaggcgtgagatctccgtgcatgtgtcggctgtcggcacggccccaacgagcgtgcaatggcacccacccgccatggcgctcgttgatgtgtccacggccagtggttcgagtcacagcagtcagcacggccattgatgaggatgccctcggatggggagggccggagggggtggtgcgtacgttgcatgagcatgatggatattgatcaggggcgggtatatatagcagtaatggaatccacaaatgaattctcttcctagcgtttctttcaactactatatacttaaaatttcccttcacaattcaagcgaaagcatcgcgaacgtttaggctagagaagacatcagtaggatgacttaacaatgatagcggtgtagctgaaatgtggactgcgacagagctaatttcaaaaagggtcgtgattagagtagcctttagatgatgtaatcgaaatcggggtaccatggacaatttagccaagtcacagggcacaaggggtgccaacgagtggttgtgggcacatggaacgacaccctggactaaggttcatagggacgcactgaagacgaaaacggtaacttaatcgagacagtcgtggaagatgacgtcgaataaccgaaattgtcaaaccgtgaaggattagacatcataccggctttaccaaccctaggaacaactcaaaacaaatgcgtgcactaatgttgccaatacgcgcgaacaagaattgaacggcgtaaacaacgttggtagcagaggggctaaaccactggtctagaacggtaacagtggcatcatgagaagatgcagcggtggtgctcgaagtaggtgaaaaagaacctgacagttgacaac

SEQ ID NO: 583 - DNA, 7618 bp, Oryza sativa
ctagtactctctccattaattaatatttgatattattgatttttttatacgtttgaccatttgtcttatttaaatatatatataattattatttatttttatgacttaatttatcatcatacagtctttaaacataagttacatttttatatgtttgcacacaaaaattgaataagttgaatggtcgaacttttattaaaaatccaacttcatcatatactcctatttatatgagtaattaataactatttataagattttcactattcctacggttgggaggtgcggctaaggaaaaaaatggttgagaaggatatcactttctaagagaatatttcttggtctgtcaaaaaactttcaagatttaccaatttaattatttattgacgtcgtagatactccctccatcgatgcgatacacgacagagtgtctaagatgtgtcgcatcgcttatattacgtgggacggagggagtacagcatgaacacaaaacaaatataataaattaaaaaagacagtagaaatgcaaaacggtaccgttgggtcggaaatttcgtgcgcgctcgtgtgcgccgcgccgtatccgaaaggcatcacttggccgcaacagcaacctcgccctcgttcccctccccctccccatttgtggacgccaagacggaacccaaaagcgcaccctcccccccgagtgtcaaaccgctcccgcgactggtccactgcaccaccacccactgccaccgggccccacgctacgtatctccaatggaccgggtccacccacccacgcgacccaagttgacagaataatttccccatcaccggagagaccacccctgccccgctccgcgtacgcgcgtgcggtgctaccctccacacggccggcccgggcccacccctcccggccccacctgtcagcggctcgcgtggcccaggggctggctcgtgcgggcggcggtccgccacgcgaaaggccgcctcccaccatttctccccacatctcatccctctctctctcctcgcttctctctctatcgcaggcgaaggcgaaggcgaaggattcgggctcagctcctccgcctccgccgatctctcgccggaggtgaggcctcctcctccgccgtctatctgtatctctgtctgtagctcagcgtcgggcccggttcaatccacagctcccccggggtcatctgcgctcggctcggtgaggaattgttgggattcggtcgggttcgttggttgggttgggttggggggtacttgacttcgttctggttgtatggtggaattgtgcggcgggtgtgattagcttgatgagattaggctggggtttggtttggattggtggagtcgtgtgaggagggcgtgttgggtgagggaggatatgggtatcttgggatcgtgggattcgtggcccctctgatttgaggctgatcagttggttatgttacgcatagagctttttcatgtttggatttgcgcgaaattcggcctaacctttgacgagaagagagatgattataggcttcaaagccgtgactaaggaagtcgtgttttttttttgtttaattggagcaataggctggggattgataattttcatattgacatgaagattctgctgtacactactgaaatttatgcttccatacccttttgtgtggtcagaggtttcttttgtcatgattgggttgaacattcttttgttgcagatgtgtcagccctaggagaggagaagctttctttttttggaaaatcgagtcaacaaaaggtcttgccaattaacacagtgaaggataattctggcttgagtgtttgtaaatggagagaataagcaccaatcagctctacaattctggaattccggtgactgtgccatcgcctctgcctgctataccagctaccctggatgaaaacattcccaggattccagatgggcagaatgttccgcgggagagagaattgagaagcacacctatgccacctcatcagaatcagagtactgttgctcctcttcatgggcattttcagtccagtaccgggtctgttgggcctctgcgttcgtcccaggcgataaggttctcttcagtttcaagcaatgagcaatatacaaatgccaatccttacaattctcaaccgccgagtagtgggagttcttcaacgctcaattatggatcacaatatggaggctttgaaccttccttgactgattttccaagagatgctgggccgacgtggtgtcctgatccagttgatggcttgcttggatatacagatgatgtccctgctgggaacaatttgactgaaaacagttctattgcagctggtgatgaacttgccaagcaaagtgaatggtggaatgattttatgaattatgactggaaagatattgataacacagcttgtactgaaactcaaccacaggtatgacagtttctgctattttggtggctgaacttggggagtaattcttcattatctaagaacaattctactcttatttggctaaactatttcctaaattaactgttatttcatgctgtgatgtgttctttgttagtgagtttgaaatgaagcatcatcttgattattgactttctaaaattatccttttgtttctgcaacatccaattgtccgtgacattaccgtgtttgatgcatattatgtacgatgtgtttatcagattagtatatttcgttcttcgtatctccagctcaaaactgccacttaataaattatctttagcattatggcagtctagcgaccccaataagatttacatgtttgcgttgacaaatgcaattattcttatatgtgacatgcaagcaaaacgtctacactttgctttgtttaacaaatgtttactatagattggatgttttcaattgggcatgcttagccatgatgcatttgacacctagatagttaaaaaatgcgattatgctcaagataaaaggatgcagttgctgcaaccttgtagttttcctggctccatataaccaagcaaaaaacatgatgactttactgtatgtagaattgtggagagtcatcttgaatgagcttgggcaggcttgacttggtttgaactgcatgtaggtttctgctcttattatgtataagtatgaattatagggattttcttgacagaagctcaaataggctccatgtttgctcaagagaagctcaacaggtttaataacatatcataaccaaacttcagatcagctaaaatagcatagtgttgtttaaactaaaatttatacgaccaagttgcttgacggcttggttgccagggaactctctctctctctctctctcttttttaaacaaagaaaagggtataatattgacatacttgtgaagttttgagcttaaccaagaattttttttttaaccctgagatgatatctaaatttctttctggttgatatcatcaggataagcttaggcttgtttgggtgggtgctgccagtttccagttgagcttgaattaagactgtgggatgtgtcacatgtagttatccctaagtgccctatgctattcattgttgatgactactgcaaattctttagttcctagtcttctagacgcatccaacatgtaattgagtggtgctctatttatcttcaatataggttggaccagctgcgcaatcatctgtcgcagttcaccaatcagctgcccaacaatcagtttcatctcaatcaggagaaccttctgcagttgctataccctcgccctctggtgcctccaatacctccaactccaagacacgaatgagatggactcctgaacttcatgagcgctttgtagatgctgtcaatctacttggtggcagtgaaagtgtgtattgctttaagaaatgttacatctcctatgattgaactaattatgcatattgacatttattgtgaattgttgcagaagctactcccaagggtgtgttaaagctaatgaaggcagacaatttgaccatttatcatgttaaaagtcaccttcaggtctgttagttgtccctattgcatgatatttttgtgaaaaaaaattattcttatcttttcattttgagttaatttattttgcagaaatacagaacagctcgatacagaccagaattgtctgaaggtctgccacgttccactttttctgtgttttgctgcattcttttatttatttattttgttgccatgtattatttattttattgccatgttcatcaatttgagatttttcaggttcttcagaaaagaaggcagcctcaaaagaggacataccatcaatagatctgaaaggagggtaagtttgaaatcttcatgacttcattatgcttctaccttgcgatctcactgctgtgttctcttttattcatttggaatcctgtattcaatcatattattagcaaaactggttcagtgaaagattctccattaaaaggggctttcttggtataacaaaaggaataatttgttgatcaaatgcttaagatattttgttgatcagcaaactgtttttttgtaataggacaacaatactcgttacagcactgtgttctatattgaagtggcttggaaacaattctttattaccaatagatattcttattcaaactcgttgactctccttggtctccttggaactttctccttttgtattttctgttatttatttgtatcaaatgcaattgtgtctagtgaacagaaagcagtgatcttccacaataaaaaaaaaatctatctggtctttgtctggtctaatgttagtccttcattcttgcttgtattttgcctactaatctgatcgcaaatatggaatgtcctgctgtttttagccaacttgtaccgcaaatatgcaatggcctgctgttttagccaacttgtttgggcatccttaacattagaccatcttgtgaggtccgagtgttcattcttgtattctgttgcaggaactttgatctcactgaggcattgcgtctccagttagaactccaaaagaggcttcatgaacagcttgaggtatgtagcatactaatgaattgtttttcatgctttatatttcttctgaaaggaaggtggggaagggctttggtatgaagttcagaataaagtaggcaagcttcaagctatcatatagtactagtgtaagctgacttgtttgagctccatgcatataaagcaaagaacgaattagcgctttatggagttctttctattgtgaattatataaccgaccattaacatcatatgtggtaagcaaattgattggagtattaggtgaaaaaggatgccttaggaaaaaaaatccaaaagtatttcaaaccaagaccaaccgttaaaattagcatatggatgcagttattattttgttcagggtttagttttttttccgtacatgtaggttcttgcaatagagggcatcacagctcattaggaaaatatgaacttagctgttaatttctagtacttttttgccatatttgtattgttttcatctgtttttcttatcctttcatatcaacagtcggctaaacctgttgttgaacattgtctctgctcctttttactagacattcctagaaaaactagtttcatggattagctaggtctgccataacaggggccagggcattgaaaatctgctaagtctgctttagatgtttttgtctatgagatgcgttaaaagtgaagtaaccaaattccttacctagttgattaacatggattatgaaggaagctagaccaacatcaaagtgaacttctcatttccccaagctgttgactgcagggtgttgaactttctgaaattaacccttttggttcaatgcttatttgctctgcagatccaaagaagtttgcagctgagaattgaggagcaagggaagtgccttcagatgatgctcgagcagcagtgcatacctgggacagacaaggcggtggatgcttcaacctcagcagaaggaacaaagccatcttctgatcttccagaatcttctgccgtgaaggatgttccagagaacagtcagaacggaatagccaaacaaacaggcatgagaatccattaaagtcatattcatgctgctgataccagcttaataatgttgagattgagataattgatgatccttaaatttttgtttcagaatcaggtgacagataatgaggatgtgatgagggtctctccaagatgtggacccaagtggccattgaatgggctcgatggctatctgactgatgtttggcaaagctaaaattaaatcgtttttgccttttcacggggaacagaacattgttgtgaacagcatatcaaagcttgccccagcgcttgtagctagactttagttgtacagtaccccaaacacggcagcgacgattccgtgttaatgggatgatctttaggtttcagaaggcagcacaagcaaatttgcactgatgtactctttgtcaggtggtttgacttcttgctttctttgttgttagggactggatagcatggattaggaatttgattatgatgaactaattcaagaaattgccataatctttggtaccttgtgcgcctggaacatgtaaatggtaccaaacaacaatatgatatgtttaccttcatgttctatttggcttaatgattatctgcgcgggaaaaaactcttaagtagatcacggttattttgttaacacgacaccagcggctatgacctgtgattaatgttttggtaatcaaaccaaatatagaccagaaaaatcatcatcgtcgcttcgaaaacagaatcaagaaaccatgaacttactcggttaaagaacaaaaaaaactgcgaacctatagtgcagtagctggatagaaacacagaaaaatacaattggtaataacacaaaatgataattaaatttttaagtaatacagtacatacgtaataatatcagctagctctgcctctactcttcgacataacgtcaacagaacattattgccgtatagcaatttttgaaaataataaggatgtaaagaggagcaagggaagtgccttcagatgatgctcggtcagcagtgcattcaggaaaaccatacggtgaaaactatatatatatatatatatatatatatatatatatatatatgcagtgcaaacttgaaaactaccgttagattgaaaaataaacgtctgagattcgtccacgtcaccatgagtaaaaaatttacttatgagtaaacctattagtaaaatttttacatttaatgacgtgaacgaacctcgtatgtctatttttcaatccaagatttgcactacacattttcccgtgcatacaacaaggaggtggatgcttcaagactttatgatattttaaggaagatggaattctttaaagaaaaagaaagaactttcagttaaatttatctaaatgaaaatatttgtctctttcttaattggatttatgttgtaccaattcaacagaaaccttttatatttttatatttagggttaattagattcatccactacgaatgtatcattttagataaatgctattattattcgtatattcgtatccatgccatttgaatatgtacaaattgaaatcatgccattgccatcatgttttctgataaactcttagctccagtcg

SEQ ID NO: 584 - DNA, 5652 bp, Oryza sativa
aatcagtgtcctggaaggctgggaccaatgggtggggtccaccggaacacaaaacgaactcacatggaaagttggaaactatttctgcatgcaggctgatttttttcccctaatggaattttattttcttccgactccttttggaacacaccaatttcttctgatttttcccctaatgaaagtttcattttgcaaatttgaacacaccaatttcatagtacaaaacagtttgattccgtggagtttttcaaaacccttcattttgtatgtttgaagttttagtgatttgtggtctaggaaggaaaatccacatgattaagctttttttttttaagaactcacatgattaagcttaccctacccatgattaactcaagcacacgcactagctagtacagtacaccctttccaaaataagttcatttataaatttctgtctccaacgcttgaccgctcgtctttgatttttttcatgaatatttttattgttattagatgataaaatatgaataatattttatgtgtgacttattttttataaacttttttaaataaaacggacggttaaacgttggaaaaaaaaccagaaacgaatttattttgggacgggggtgcaggactatagatggcttgaaatcttaattaatttgacggcatcacacagtttaattatttggtcaacccgtcacgcaagcgacggcttcgttttgctttggcatttacgctaggctaatctgaatcaggtcagcaagtttttgctttcctattcgtcacagcttagctgtgatttacaaattacaataatcaattctgctaccaccacataggataggaggacttagcttacaagaaaaatattcgtgcggttgattattaaaacaaaatgtgaacataaattgagggatttgtaaaagcatcagactttgacaaaacttgcttgagtttcttcagaattaggcatccattttgctgcagattgcaggtgttgagacactgcagcattttgtgcaaaagcacagtagcacaaaagcaacagaaagcaacagcgtgcttgtatcttctactactacttcagactctttcagagtgaaacgagaacagtcaaaacaatcaactatccatccaaggtggttcacagaaatgactaatcatttgcaggcaggagtaatttagagagagagagagagggagcgagagaggacagtttggataggagaagagaggagagagggtgcttgctgtggaaggagaggactgacaggttcttgtttctgaatctcttcaactcatcttcttgattatcagatggagttgaatcttccatcttgtttgcattttcttacctggattcacgccttcttggcttcgttctttcttggatttgcagtcctaggttgtcttgttctcatttctcaattctcatggtgcagttgcgttttttagtttatttgtgtgcttactctggcgacagctgcctatctccttttgctctctttcagatttctgttcttcccctttctgcttttcttcccgggcatcggttggaattgtcatgattttcttttgaagtgcgcaactctttctgaggaaaagagaatgccatgaccttaattgatgtgattttacctcaaaccatacaatattttcataggtggcttgtatatgtttctatttttcttaaatttgatttgagtttggcttctgaataggaaagtttgatgtgtgctctgatgtatagacaagacttttcttgtcacttaaaggttggctgctgttagattgttgaaaggttcaaatcatttgtccatcttgttttgtccagaattttactatattcagcatattagtttaagttagcatggttttatctcttcttttgtctccaagttatctttctgatagaagccaagcccaatcgacaagattgagcttctgtacccatatttcttaacaaaatttcaatctatttatgacaaaaaaaaaacacacacattttggactacatgctctgataaggcttcaatttttcagtgctattgactggatatttacttttgtagtgcaggcttggagcaagcattccatctcagttctcatattaggtgtgaatgaccaagaaatcaacaatctcaaggagccatgagcacacagagtgtcattgctgtaaagcaattcagtggccctgacaaaatcgcacaagcatacactgttccacagccatcagctcatgtgctctccaacgctaactatgactatgatctctgtggttcaacaaatagtacctcattatcatgtgctatccaatcctcaaacattaagaccgaatcaatcagttcatctagcctgccaaagatccttccatttagtactgactcaaatggtgaaagttcactttctcgcatgtcgcaagccgagttttcggacccaattttgtctagttcttctacattttgtacaagtctgtacacctcatcaccgatgaactctggttcatgccgaaaaaccggttatttgcctttcctgccacaacctcctaaatgtgagcagcagcagaattcagctgggcaatcatccagctctctgatgctccttgatgctgatctcagaaatagtggtcatgctgatgatgaacacacagatgacctcaaggactttcttaacctctcttcagattgtagcttccatgggaaatgcagtgccatggcttataatgagcagatggagtttcagttcttgtctgaacagctcggaattgcgatctcaaacaatgaggagagtcctcggttagatgtgagttccttagcttcatcattgatatttttgtactaaattatatgtttatttatcctctaatttaatgggtatcaattactacttgcaaaaggttttttcaatgttcacttgtgaatatttatcatggcttgatttgcattttaatcacttattttcttgttccttaggacatatacgacagaccaccgcaacttatgtctcttccagtgtcatcttgctctgatcaggaggatctgcaggatgcaagatctcctgctaaagttcagttgagttcatctcggtcttcatctggaactgcatcatgtaacaaaccaagactgaggtggacaccggagctccacgagcgtttcgtagatgccgtgaacaagcttgaagggccagaaagtagggtgatcactctagttcattgagaggaatttgatcttgagaaaataaaaccatccttttatgttctatttgatacatcttgtagaggcaactcccaagggtgttctgaagcttatgaaggtagagggcttgaccatctatcatataaagagccacttacaggtgctttagtgaattttttttgatccatagtcaaattatttcatataaaatcattatttataatggttaaaacactacttgtcacaatgcagaagtatcggcttgcgaagtatcttccagagacaaaagaaggtaaggcaattaagccaaagaggaagtttaaatatcttaggaaatatgaaataattagctttgtcggtaattattaactattggttctgatgcatgctcgatctagacaagaagcaagaagaaaagaaaacaaaatcagtggctaatggaaatgatcatgcaaaaaagaagtgagcatctcccttcctttcaatgacttactgcctaacattgaacatatcctgctgtctgcatgcataaactgtaaaacttcatactgttttctgtttcttaattaggagtgctcaaatggcagaagctcttcggatgcaaatggaggtccagaaacaactccatgaacaactagaggtaagcatcagacatgtcagggcagtattttgaaggctaattaaggtgacactgtatgttcatatgtttgcagcagccctgattccagattatggttacaagacttagtatttacacagtattctttttggagcaatttacacattattttttcgggaatacgcaaaaggattgcgcacctttgtattaaggaaatttacacattattgttcatcaaagcatgcttacctgaatattatatatttagataaacttgcagtgttaacatctttcttggtcatcaggtacaaaggcaattacagctgcgcatagaggaacacgcaagatatttgcagaagatattggaagaacaacagaaagcaagagaatccatatcctcaatgactagtacaacagaaggagaatctcctgaattcgcaccgatggagaaaaccgaggacaaagcagaaacctcttcagcacctttgtcaaagtgtagaattacagatactgatgcagaatgccattcaaaagttgataataaaaagacaaagcctcaggctgatcttgaaatggtgcatgacgaataatcatggtcgcaaccttttacaatatagtgcttggacttgtatgtttgttttattctgatgtgcctccatgagttagtgcagaaattggtctttgcgattttatggtatacttttttgaagactttttttttgtatatattactaactcagatgaaaatggagccagtaaagagatggtgccattggttccctgtatactttatttcactctgtaaatctgattaccataatatgaatacttatcccaaatttacaaatgttttttctttgtgctatctctgccagtacaatagcaaggtaactgctgcctacacaactgaatgatcatgtttgagcttctcctcagtttctgcttatctacaagactagatgtgcttgaaagacctctaaatgtgaggactgaagcacttgaaattcagttaaaaataacacaattagttcctgttctgactgcaaatgtgttcacacactagagatcttgtgcatagtccacctgatattccaggtattgttagttttgtggaggcttctcacttgctggacaaaattcccagtgttaatggattataaaaaatgtccaaattaaactttcttatttctctattgatagcgagtttatgctaaacaaatctcagattcgataaacttacccttggaatttggatcagcatgtacataaaaactggcagctactatcagataacagagaaatagcatcaatcctttcacacaatttgaagtcccatcctgaaagtgtgtgatttaaaagaacgttttaaaatcatgtgaaatcaaactcattttgttttaaaagaatgctctctttgcacaatgattttattacctgcaacaaaaatgcaacaaccagtacagttgttaagaggcttgccgtctcaaagagatggaagtttaggtccattggcttgcccatcatccatcccatcactacacaaaatggtatctacaaaatgaggtaagcaaaaatcagcttttgatgatcagatcttgacagctagtaagcatagtccaatctgataggcaaaagacaacccaccccaaacatggatatctgtatcgatgatcctattgccactccaagagaaatgtcctgtacaaaaacataaaaaaacaaaaatagaagtttacatttttagtgtaaataaaatgttattcaagattgttgccaattgcaagctggtgcttactaatttgtctttcactgcaaacatgacagcattagcatgtcctgctgaattcccca

SEQ ID NO: 585 - DNA, 4078 bp, Oryza sativa
atatcctgttctgcgtcacgagccatgcaaacaaaacacacacatctctgcgtcattcgcggggagtagtttcgctcgctcgctagggcatgcatgcttgtcaagttgctcgcaagagttcatcgtcaagaagcttcgctggaaatttcgtcgacctcttctccgattgttgtagcgaaagggacatggtttgttctctagctgaagtttcagccccatgtcaattccatcaccaaaacgagatagcgacaagccagatcgtattagctaggcatgtgccatgtggaaaaccaagaaacaagagaatttaagacgggaaggcccaagtgtgtactgcaactactgttgcgagctgtgcgtccaccctaccgaaggacgcctatgaactggacttcattgagccagtagtgcagccagcccatgctctgcaaaatcctaccctcgcatacttcaacggcgatgacttccatatcaaagaaagaatgttcagtcagaactactccggctaacaagtacagtagtaataaccaattgaacaaacacggcattcagctgctgatttccaagcctatccatatactccctctgttttttaatagatgacgccgttgactttttcttacatatttgaccattcgtcttatccaaaaattttatgtaattgtataagatataaatcacacttaaagtattatgactgatataacaactcataataaaataaattataattacgtaaaatttttgaataagacgaatggttaaacatgtgagaaaaaatcaacggcatcatctattaaaaaacggagttagtacttggttcttgctcagcttgtcgctgtcttgtttcaacctgctaatgagaagcgattgtgttacgtactacacagtacagactacagactacaaagtatccatctcaacatgcttcgtcagtaattgatgaagatgtgccggttaattactgctccaaacgcgggaagaacggagaccaaaagacttccagttttgcagtccgccccctctactgtgcccctgctctgcttttgataagaacggcaaccattagagttgactagtttgagcattcaacactggacctgcgactgcgagtagtatatatctgcgtccagtagagaacagtcagttcagcggcaaagcaaaagaaaaagttagatcagaggagagctcagagctcaaagagttgggaagccatggcgggagggcagctcaacgtgctgagcacgctcgaccaggcgaagacgcaatggtaccacttcatggcgatcgtcatcgccggcatgggcttcttcaccgacgcctacgacctcttctgcatttccctcgtcaccaagctgctcggccgcatctactacaccgacgattccaaggacacccccggcgcgctcccgcccaacgtgtcggccgccgtcaccggcgtcgcgctctgcggcacgctcgccggccagcttttcttcggatggctcggcgacaagctcggacgcaagagcgtgtatggtttcacgctgattctgatggtcgtgtgctcggtcgcgtccgggctctcgttcgggagctcggccaagggcgtcgtgtctacgctctgcttcttccggttctggctcggcttcggcatcggcggcgactacccgctcagcgccaccatcatgtcggagtacgcgaacaagaggacgcgcggggccttcatcgccgccgtgttcgccatgcaggggttcgggatcctcttcggcgccatcgtcgcgctcgcggtgtcggcggggttccggcacgcgtacccggcgccgtcctactccgacaaccacgccgcgtcgctcgtcccgcaggccgactacgtgtggcgcatcatcctcatgttcggcaccgtcccggcggcgctcacctactactggcggatgaagatgcccgagacggcgcggtacacggcgctcatcgcccgcaacgcgaagcaggcggcggccgacatgtccaaggtgctgcacacccagattgaggagagcgcggaccgcgccgagacggtggccgtcggcggcgagagctggggcctcttctcgcgccagttcctgcgccgccacggcctccacctcctcgccaccaccagcacgtggttcctcctcgacatcgccttctacagccagaacctgttccagaaggacatcttcagcaaggtcgggtggatcccgccggcgaagaccatgaacgcgctcgaggagctctaccgcatcgcccgcgcccaggcgctcatcgcgctctgcggcaccatcccgggctactggttcaccgtcgcattcatcgagatcatgggcaggttctggatccagatcatgggcttcgccatgatgacggcgttcatgctcggcctcgccatcccgtaccaccactggacgacgccggggcaccacaccggcttcatcgtcatgtacggattcaccttcttcttcgcgaacttcgggccaaacagcaccaccttcatcgtgccggcggagatatacccggcgcggctccggtcgacgtgccacggcatctccgccgccgccgggaaggccggcgccatcatcggagcgttcgggttcctgtacgcggcgcaggaccagcacaagcccgagcctgggtaccccagggggatcggcatcaagaacgcgctcttcgtgctcgccggcacaaacttcctcgggacgatcatgacgctgctcgtgccggagtccaagggcatgtcgctcgaggttatctcgcaggaggtcgccgacggcgacgacgaggaggcggcctacccgaagtaatttgaccgcgcgcgtgatcacgcagggagtggttgccgctaaccattggtgtcatctcttttcccaactgtaacaactctagtcgtcgcttccgtacgagtggtagttttttctttttcttggataagtttgtagaaatttcaattagtgactagtttgtagtatatgtgagtgagatgtgtgtatatgttcttgaagaattggtgaacttttccctggatttgaaagaaccgtgtagtttgaaaaaagaatgcaatggatatgctagtagttcaggaaattgattgtttgtagcgaccacacgcaacatatccatttttctagtactccgttcgtcctgttcgttgactgatcaactcttggctagcttggcatctaagactacagtactactgaggagaaaatgacatcaaaatcgtaactttggggaccatatataagaagcagcacacaggttagcaaactttgtaccgctgtcaaggcgtcagctgtgtggattattgggaccaaatgaggcgtggtcgcgtggaagctggaaaatgccctcatggattatcatatgattaatcactctatttttaatcagctggtaagaggttgacttaggatacctatggagagggtgagtaagaggaatctgtacgtacacacttattcttttcttttaaaaaatcaggtaattttacttactcagcctagaaatccaggcggaaaaggatacagagtgaacaaaaacaagcatcatgtgcggatggttgtatatacgtaggacacataaggtgtacttccttcgttttataaaaaaccaaattttagagataatctggatatttctctaaatttaggttttttattaaacggagggagtacatgcgtctgtgaggatgtgtgttgaagctacaatggtgcattcggttggacctggccgatctgttgttggtttggactgcatcattgatggactttttccttgatgtgtttggtgcatttgtttagttgggccgtacgagttgtttgttacgagaaagttcacttgacatctctgaactatgggtcgagtttcattcatatccatatcgtaaaaccgtttatgaaacatcacttaggtggtgtttgaattcttgaagatgaagatgaagattaaatatttcacgcaaaaagagatgataataacatgtgattaattgagttttaattattgtaaacttgaaaaatggattaatctgatattttaaaacaactttcatatagaaagttttcgcacgaaagacaccgtttag

SEQ ID NO: 586 - DNA, 6717 bp, Oryza sativa
aggatgacgagatctattctaaaacaactaatctcaacatagatatgtgcggtcagaaaattacgtactccctgtctcgctccgtttcaaaatataaacatttttaaaatagtgccaagtcaaaatttttaactttaactattaaaaaaataaaaatgataaaacatgtaaaaatgatattgctaagtcaaagtagcatcataatatatataacttttttatttaaaacatcttacttctatagatattgctagtcaaaatggtatctcgaaaactgtgtcgaatttcaaaaatactaataatttttaacggagggagtatagccaactactacctccaaatcatatataatcaatttaatagccaattcatatattagttacctataaatatatactacctattaatatccggtcccacaacttgtgttgcagctggctataaatttatagaccgttgttcatctctcttctttcatattctcgatatatgtttatagctggcttatagtctgctactgtacatactcttaccttaaataaagctataaatgtgtagcctactgtttatctctatctttttttcatcttctctctatatatatttatagctggtttaaagtatgctattgtacgtactcttaccaagtaaacatcaactcggcgtgattgttctagggtgacctatcttcatgagcggccgggcatgcagaaccaagcctatccatccatccagatttgaagcgagcattgcccctgcctgcaatgcaactttgcttccaaggcggtcaaggataccgccggcgccgaccgcaccctgccctccacctgtaaaacgccacctcttcaccgctgccaccacacctctcctctcctctcctctcctactagcggccaagctttcaaagccatggaatagtagtactagtaaaaagcatctctctctctctctctacatacatggcgcctcctcgaaaccctcatataaatataccgcgcctcgttgcctgtgcggcgcccctctctctctctctctacagactacagtgcgtcgtcgtgtcttctctttcctctattttatcaccatccaccgccccattcctgctctcttcatcttcaccttcacctagctgctgctgctgcttcttcttcttctatctgctactagtagctcgcagaaaaatactcgcctcgatcgacaagctctcgttgttaccttaccatggacatggacacctcgcaccactatccatggctcaacttctccctcgcccaccactgttagtactcattctacttcgttgtctgttcatcgatcacatgtgtgtgtgttcttggtcattttttggagtaagtgccgtgcttatgcgttggtatgtgtgtgtgtttgtgcaggtgaaatggaggaggaggagaggggcgcggcggccgagctggccgcgatagccggggcggctccgccgccgaaactggaggacttcctcggcggcggctgcaacgggggatcaagcggtggcgcttgcccgccggtccagacgacggcgccgacggccgccgagctgtacgagtcggagctcaagtttctcgccgccggcttccagctgagcggcgcggctggggcggcgccgccggtgcccgcgctgttgccggcggctgctctagagcagaccgacgagacgaagcagctggccttgccgccgcaggccgcggtggcgccgccgccggagcagaagaaggcggtggactcgttcgggcagagaacgtctatctaccgcggcgtcacacggtaagctatagctaagctaagctgagatcgatcagtctatgcatgtgtcggccataaaatctaaaaataaattcttagctagctcgtctaatttcttgcacgcaaactaatcatctcgtgttcgtgtgcatccttcatatatagattcacatgcatcatcgatcgtattaataggatttagtagtagttttttttgttaatgggagtagaagaatcaaatgaccaatatttgttcagagattttaattagggcataaaaaatccttggttatgtataggcatcggtggaccggaaggtacgaggcgcatctgtgggataacagctgccggcgtgagggccagagccgcaagggacgccaaggtcactactcaataattttactactgcattttgctagctatttgcatctaatctcataagtgcatccagctaacttcgattttcttttttgttctgtcgacttgttggcaatgcttcttctcatttatggctgatgtttctggtgtcttcgatctacagtgtacttgggtaagaaaagacacatgcatctagtctcttggccagctactagctagtagtagcagctattgtaactttgcatcgtttggaacattttaaggtgaatgatgcagagagtttgttcgatgattttacaggtggctatgataaggaggagaaagcggcgagggcgtatgatcttgccgcgttgaagtactggggtcctagcaccacaaccaactttccggtaattaactctcatgcatatatataaagatggatttattacatatttacaatgcatgcatgatcaaaatatatagctcctgattgatgcaagtgtgtagtaaaagcatgtgcatcatgcgtatatgtgtgtgtgtttttggttgatgtatctttatggggcaagctgtttataatctttcaggttgccgagtacgaaaaggagcttgaggagatgaagcatatgacacgccaggagtttgtagcttcacttaggaggtacaagctaatgatcactctttagcaatgtttaattatatgttgtgatattccatgcatggccattcatcaaagtatatatgctcccatgcaaagccattctatgcatgcatgtttcatcatgatcacctgtttttttatatgtatgtatgtagctttgttaatttatttgttcatgtcagcttgatgaaaaacttgtactggtgcatgcaggaagagcagtggattctctcgtggtgcttctatatacaggggtgttacaaggttcatatatatattggtcttgtactaatctttcacttgtagcctagctagccatgtttggcctcttgcacgtaagtctcaggtaactgatgttttgtgtgatgcaaccatgtagacatcaccagcatgggcgatggcaagcaaggatcggaagagtggctggcaacaaggatctctacctcggaacattcggtaattaagtttgtacattaatttccatgttgaatctgtcgtccatgttcattttttttgtttagcagaaatttgttaagcctttttttgttgccctcttcttcaacaaatgtatgacctgataagaaaaaatgatatcaataacccaacaaaacctctcaacatttgactaattatatctgggtgatgtttgcagaaaacacgcatgtaggcaatactttcatgcatgtaggcaatactactttcatactaatgttttctaatactagtggatctactgacaatgcaatgtcagtgtgctcatcatgtagaagaatgctcaagagttttctcgacgctaagctatacataatctttgtcattagaactttcttttatcaaagatgaaattgcaagtaggagggtgcatgcacgtgttgggcccctcattagctagcattagtcattttcttacactcaacattacaatattaagcccttgcacgtaggttccatcttaatttatgctttgcacacacagggcttgtagctagattcgtcgacatattttatgcaggtcaaaaacatctactttgaccaagatgtaagcatgcccacatttgattcgaaatttgtcatcttttgcgcgccatgcatgatggttttggggctttatgcagcaggcaaggaaaaaagaagacacaccatgcttagaccatggacgcatgtatatatctatggctgattgatttgcaaacctgaacactactgcctttcttcgttcactgcatgtagcagcccgtgtttggaatatcattattactgctattaccgcgctcggctttccacaaagcatgtgattggtgattaatttactactgccttgctgaaccggccattattattgtactatgttggatttaactaagcttgatcaccacactgggctacagtttcgtcagttgttgcttggtccaaagtcttactggtgcaacttgctggttatctataaacttactggaaggctcactgcactatgatgccatactttgttaagtacaattagctaattcaaatatgtttcatgtgacattactattcagccattagtaatttacaggtggtgttgattttacttcaagtacctaaataaaattgacaataacgcatcgttcttctgcatatgtgtggtgttcaacagctgattgttgcttgcttccttctttcaggcactgaggaggaagctgcagaagcttatgacatcgcggcgatcaagttccgtggcctgaatgctgtcaccaactttgagatcggccggtataacgtggagagcataatcagtagcaaccttccaatcgggagcatggccggcaaccggagcaccaaggccggcctagagctcgctccgtcgagctccgccgacgccatcgccgccaccgaagcgaaccacaccggcgtcgcgccaccgtcgacgcttgcgttcacagctcttccaatgaagtatgatcaggcagattacctgtcatacctcgcattgcagcatcaccagcaaggaaaccttcaggggctaggcttcggtctctacagctcaggtgtaaacctggatttcgcaaatgccaatggcaatggagccatgtcaaattgctacaccaatgtctcattacatgagcagcagcagcaacatcagcaccagcatcagcaggagcagcagcaagatcaacaggatgatcagtcacaaagctccaacaacagctgcggctccattccgtttgcaacacccatagctttcagtgggtcatatgaaagctccatgacagcagcaggcacctttggatactacccaaatgttgcagcctttcagacaccaatctttgggatggaatgatttggggaggtggcactttgcaggcaaaaaggatgaagagcctgatccctgatcagaggtgatgaggatcaagactgacatagttcattctcacacaacaacaacaacaacaaacataaagagcaggggaaaagagaggtaatgtagtagtagtggtatgatgataaagtatgatgcaaacatagtaggaagcagtatgcaggagagagatactgacaggtcagagacaggaggagaagactctgctaacaaaacgatgcagcgcaagcatattgttttattttactgcccttttacccttttgtagctttgttttcttgtgcttttgtcatcgctgagctttgtttgccgctcagcttcttttgagcttttctttctactgacatgattctgcaagtgccatgatagcttagcccatgtacaatggaagcagggacgtctctttgtagcttttgcttcttttcttttgttagatcgcctttggtagcggcccctgtttactcaagaagttgctctccctccacaagtatacaatgaaatgtactgcaggaactaaacaatataagtttttgtaacattttccataaagtttagttcctagttttcaaacaccccctaaatatttcattcagtactttaaaagaagtaaaaaaaatcagtactcatcacgagttatgcttgtactttctccgtttcacaatattaacattttttatatttatattaatattaatgaatctaaatagatatatatgtctaaatttattaacatcaacataaatttggaaaatgttagaatgatttacattgtaaaacggagagagtactgtttacgttgctgagatctgttacaggctgatggagcattatctccgtaaaaaaggacgaaacaaagttctgtaccaatattttcatcatgggccgaaaaggatgagatggtcggcctgacccacaatccttttttgatagttctcgttgcgccctggcccaagaagaatggccttcaggccggcccaactactggcctgcaggccggcccaactactatgggaattccatcccagccgaaaaaaagatgggctgcaagtgggcgggaatcttatcatctacgtagatgggagtcccgtttcggccctattatgggctgcacctacactaaacttctattctggcctaaagataatagccttctaagcaaccgtatcaacctccaagtacacatgtgttcacatgtgaatatgaagatttccgagcgcacttgtgaaacggatgactacgaagattaagttgtcgtatgtaaaatgagagagcgctattagtatataattaattaaattttaattattataaacttgataaatggatatatttaatattttaaaacaacttgaaaagtttccgcccaaaacgtatagtttaatagtttaaaaaatatactaatgtaaaataagataaaatctaaatcttaatcagaaaactgagataaaatttgaatcttaatcagaaaagaatggaatagtgccatgcacgaagtgtccacgtcaactcccctcaggctgtcgataagtagggtgactagggtgacaacgacgatcgtcaccgggcctag

SEQ ID NO: 587 - DNA, 5796 bp, Oryza sativa
agtgcaaccatgttttccaatggtaatagtatactatgaacctaaggtgatgatatttgtgtgtaacaaactaatcaaaatttccctccaaaactgctgttgattagaatgtccattttgtgaagactttgcatttctccaagtattggacagtagaactactgtccatgagtcagtctagctacgtacccagattatggcagctatctattcgtcagaactcaggattgcaacttgcaatatggtggggagtgttcacacttcacaaaattcagatcatctgcgcggaatccaatatacagactgctgctgctcctccacggtagtactaagagcaagtttaacagtatagccaactgttggctttaattatttaaagttaatttaatagctaatttatacaatagttttatattgtctgatctcacctatcatgtacacatgtatcttatagtctgtgctacagctagctacaagtttgtagcccgctgtttttctctatcatcttttatcttcttaaaatatatttatagcttatttataatctgctactgtacgtgctctaactccactcgcgtaaagagcaaacaaaaagcaagctagctagggctgcatgcgagggaacagcggcctagctccattttggtcaaggagaccgcccataggaccccatgaaacgcctccacgttgtcgaccattactactcacacctcctcctctttagattcgcaaaacaaggctaggttttaaagtatttccctactttgctcttatccctaaatcactctctttaaattaatcaaactcatcttggcctttgtgctctccctctatctcctctctcctctctagttcttggacgtattcgttacagcccagcaattgcatgtaacattaattccaaaatgcacaaattgtggacagctgagagagagagagtagctagcagtcagccactcatgttactcagcagtgtatgtcgcacattcaacttcattccaatctatatataacacacacttgggtattctctcattctctccttagcacaacactggtctacatcgatcaatagctttatagttatccttccctctcataagctcaaacaaacgctggtcaagtgctcttcaagatcggcgcatcgatcatatctatcgccatggacatggacatgagctcggcttatcctcaccattggctctccttctccctctctaacaactaccaccatggcctccttgaggccctctctaccacatctgcacctccacttggtaatatatgagcatctcaaataatgcactattcataatctttcatgtgcatgcatgtttgctaaactaatgccatgtggattagtaggacatgcatctgtgttcatcatcactaagtatcattatttttctgtgttttctggtgtaggagaggaggggccagcggagggcgctccgaagatggaggatttcctcggcggcctaggcggaggcggcggcgccgtcgccgccgctccggcagctgccccggaggatcagctcagctgcggcgagcttggtagcatcgccgccgggttcttgcgccggtacccagcgcctgagaacgccggcggggtgaccatcgcaatggcgaccgacgcggcggcggagctggccgatccggcgaggaggaccgccgagacgttcgggcaacggacgtccatctaccgtggtgtcactaggtatatatattttgcgataacacatggatccatagagatgatctatctatctaatctagctactcgatcccagctctcacagcgcccaaatagctaggtgcatgcatgcatgtagttagttatactactagcagtacactaacgacactagtagtcgttcatggttaaaatgtcattttaacttatagctaaaaataatcatgcaagcatgacaatgagctgaaaaataatataatcaacaagtttttgataagggatgttgggtattgggaaaatgcatcaggcaccggtggacggggaggtacgaggcgcacctgtgggacaatagctgccgccgggaaggccaaagccgcaaaggccgccaaggtttgtgcatgcatgtcataacccatatccaacaaattaatctgcaaattttagcatatggacgttacattgttgatcactaattaacatttgtacctgcttttctccaacctaatttctcgcctgttggcggaccgccggtgatgatactccatcagtctacttaggtatgtcgtcattatttgcaacatctatatatcttaattagttagtttcttttccattcgttcaccttgagacttactgtaaaagttgggggattaaacaaaactttcaggaggttatgataaggaggagaaggccgcaagagcttacgacctcgccgccctaaagtactggggtccaaccaccacgacgaacttccctgtaagtacttgttgcaacagtcaacttattattgccagccccatcaattaatacattattcgatctttacacatatggcatgcatgtatgtgcttatcctggtcgctgaggagatagtagagtactagttatatacagtcaacgttcatacatgtattatacgatgtactacgatacgtgtactcgtacattcgtacttacctagtgataaatttacctgcaccgatcgatgactgtaggttgccaactacgagacggagctggaggagatgaagtccatgacgcggcaggagttcatcgcgtcgctgcgcaggtgagacgaaacagtagtcatccggaaagtttatttatttatttattttggagaagcagcagtaatccagagtcacatgcttaggagaaacaacccttttccacgtacaccttgccatacgcgtgtacgcgtgcgtgcacgtacggctgcgcactgcttttactgttctcacacttgtcacatgttgacctcattgtgtgtgttccaactctgttttcttttttttttcaggaagagcagcggcttctcaagaggggcttccatctacagaggagtaacaaggtataagattgagttacaacaataaatatctccctgaaatacttagtatggtagtatcaagttgcatcattcggagcactagctactactaggtaagtatattctgctgggtcacatattcggtgaaaaccatcaaataaatgaaaatctataataactagatctgttttaacctaaaatttgtcttttcacctaaaagttgagtatagatttgagatttagtacaaacgaattttatgcctagatttatctccaataattttttcatcaatttaaagaatttgtaggtacgactttcatggattttcacttattcgattgttaattttcactagatattccccatcctatactacggtaaaaaaacattagccctccttctcttcccttatcctgtgtataaaaaaaaccgctacagaaacaaactggtgcatccgtgattagccaagaaaaaaaaattaaaaaatttaaaaccttatctcccatatcaaattaaaccacgttctataaattccgttataccacacgggcatgcgactagtttggggacaaaattctagaagttctagtttttgaactctagtatcaagttgcagcattcagagccgctcttcttttttttttcttttcttagtaaaaaaaaactgtgacaatgggagcctaatgtttggagtgcagacatcatcagcacggccggtggcaagcgaggatcggcagggtggccggaaacaaggacctgtacttgggcactttcagtaagctagcctcgatcttttcaaatacatataaacaaacgctaagaccattgagatgcatggttgttggcaaattttcctaaatgtcccatgcaccgcgcgcaggcacgcaggaggaggctgccgaggcgtacgacattgccgctatcaagttcagggggctcaacgccgtcaccaacttcgacatgagccgctacgacgtcgacagcatcctcaacagcgacctgccggtcggcggcggagccgccacgcgcgcctctaagttcccctctgacccatcgctgccgctgccgtcgcctgccatgccaccgtcggagaaggactactggtccctccttgccctgcactaccaccaccaccagcagcagcagcagcagcagcagtttcctgcttctgcatttgacacctacggctgctcctccggcgtgaacgtggacttcacaatggggactagcagccacagcggcagcaacagcaacagcagcagcagcagcgccatatggggcacagccgccggcgcagcgatggggaggcagcaaaacggcggcagcagcaacaagcagagcaacagctactccggtaacaacattccttatgctgctgcagcagctatgacttctggatcagcactctacgggggctccaccggtagcaacgggacatgggtggcgagtaacacgagcacggctccccacttctacaactatttgtttgggatggagtaggtggacttactggctctattagcttcattagctgaaacgagtggtaggcctaggactgacatggaactgatcaaaagttttggctgctgatgcatgcaggaatgcaatgcaatgcatccttaagattattcttttgcttccctgacatagtcctgtagcagagaaactcatgtatcaccagtgtttctaattcaagctcatttttttaactagttccattgtcagctactccatttgtttcatattataagtcattttgatgtttttttttagttaaatttctttaaatttgaccgagttcatagaaaaatatagcaacattgtcaacccaaacaaatatattatcaaaatatattcaatattacatttagcgaaactaaattggttatgtagatattgttaattttttctataaacttaatcaaatctaaaaaaaatttgactagaaaaaaaatcaacacgacttataatatgaaacggtgggagtacaacataagtgtgtttgaaaatgtgtatccatctatatgaaaacgtttcgaatttccatgccaggtgaataacagtaaaagaactttcaagataattagataatggtgcatacttgaagtcaaattttgtcgcgggggaatccgccagggttcagaatagtgtagaactgtagataccttgaagaatcacctgcacaaaatcagacggacatatagcaacattagatatatgaaattaaatatatcagtaggctgaagaaacacgtgtaacacaaacagtaatgataaaaaaatcatttacacattcaacagcagtgatccccataccttgaagggaatgtacggtggagcggtgaaatgcattgagatcggaaagaacatcaatggtgaaagaactcagctgggcactgcataattggaattaagcacaatagaatcagtcaacaaggacatttaactatcctctgcacccgcaagacaatcttatccaaggcacacgataacaatctcctgcaacatcaaaggacatgtctcattatctaaaaaaaccaaagggacatcgcttagtcttatctgattcatatctatatatataatgtcaaattgtcagtatatattagtgaagttcacaaatcttactctatttcaactggttgaacagcaggtggcgtctctgagaacttattaatactttcagaatttgatgaaaaatgcagaaggagccaccaagtgtcacctgcaatgttctcttgtcaaaaaaacataaagcacacaacaataggaa

SEQ ID NO: 588 - DNA, 3122 bp, Oryza sativa; identical to SEQ ID NO: 211

SEQ ID NO: 589 - DNA, 3234 bp, Oryza sativa
tggcagagatcgaatattattctctcctcgattgcctgcaatcctctgacaaagtgtcaactcgatacagtattagaacgcatggaatgtgacatattaactaagaacataatgcaagacagttggagtattaacgaagaatgcaatacacttgagcagtgaaaagctgactaatctgacttgcctaagaaacgcattagaaggaaggtggtttgactttagttaggcgtttcatgagccgtccgatcgtcaagtaaacgcattagattagtttgctatacttgctactactagtacaatgctcctgtagtgttacagtgttaccactgtagcttccatgatctgacacagtattcgctaacgttgaaaattcacaatgattttcttaagcatttccagtttgtaatgcagaatttgtgtgatttctgaaggtaagatcactagtgcacacacatgacgacctttttctgaagaaacccaagaaaatcaagccttttttctgaagaaaacaaaagcacgtacgatatatacatatgacatgatcattacgtccaagtgatttcatcctgaaatgacgtcaattttgaaggctgatactgaaactatataaaagatcgccgtaacaggggaacgcacatgccacatgagcaccgggattacacagcaaatgcaggccgagctagtcagctactactagtttcagaacaaattttgctcttgaagaaatcagttcgcgacacccaatcatgaacacaacgtgcagatgcgcgcaaaagtcaagattagccaaccattacacgctaatcaagccctactcaaaggaattttaacggataaaataccagtcgctttctcactgcaaatcttccattctgaatatgaacagcctcctgaattatcaaaggcacaatctctgccgttatcaaccgaatcagttagcacggcagttgcagccaaatacagtataaataccgaggtgtggtgacgcttacttctccacacaacacaagaagccagttacaataatttagaagcaaaagaaaaactgtaccgagcttgcattgcagtgacgcgacaatggcggccgccagaatgctcgtgctcctggcctctctctgcgctctcctgctcacggcgtccgcggccaaatggactcctgccttcgcgacgttctacggcggcagcgacgcctccggcaccatgggttagtagcaaattaagctcagctaatcaccatgcatgtgttaattaatcttttgcaaagtttaattggcatttacaataatggagtttggtctctctctcgtctcgtgtgtgatatccaggcggcgcatgcgggtacggcgacctgtacggcgccgggtacgggacgcggacggcggcgctgagcacggcgctgttcaacggcggcgcgtcgtgcggcgcctgcttcaccatcgcctgcgacacccgcaagacgcagtggtgcaagccggggacgtccatcaccgtgacggcgaccaacttctgccctccaaactacgccctgtccggcgacgccggcgggtggtgcaacccgccgcgccgccacttcgacatgtcgcagccggcgtgggagacgatcgcggtgtaccgcgccgggatcgtgcccgtgaactaccgccgcgtgccgtgccagcggagcggcggcatccggttcgccgtgaacgggcacagctacttcgagctggtgctggtgacgaacgtcggcggcagcggcgcggtggcgcagatgtggatcaaggggtccgggacggggtggatggcgatgagccgcaactggggcgcgaactggcagagcaacgcgcgcctcgacgggcaggcgctgtcgttccgggtgcaggccgacgacggccgcgtcgtcacggcggccgacgtcgcgccggcggggtggtcgttcggcgccacctacacctcctcggctcagttctactgatgagcattaattgcaagcctatctcatttaattaatctggaccgttcgatgtagtatattgtatgctttgatcgacgtggcataggatggaagaggccgcccacgaagaaaatttgggacttgtgtatatatcattgtaccgcactttgtttttttcttttttgatttgctactgtactatacgcacgtaagttgtgctttttcttgtatttgtattggcacatggaagtatcgtgtggagattgctttaattaattccagtcagaaaacattgaattaagcagtgcattgttcggggaaaaaacattcggcatactccctctctaagaaaactcaaaccctaacgttccaagaaaattttaaagagagaaaataaaaaccataatatccttagttaatgtgaaagttgtatgggttgatgggtacgtgagagatattaaagtaataaaatttcttgttttgcgaattggcggtaggtactccctccatcccaatttgatcatctcttagcaaagagcacaaaaatcaatgacaccaaaatactccatcatttctaaattgattatcatataatgtaatccaaaatttcttaaattgatcattatataaccacataatatggatttcatcggaatacaaataatgcagcatgagagaatatgtgcatcttatggcgtaattggtatggtattttaatcgatgcatgcatcgtgggagaacgtgtgcatggtgtcttgattgatacgatttaaattatcattggtcttggtgaataaacatatatgatgatcatttttgaaatagagggagtatttattattctcaaattaatccttattggctaaggtgctctaccgcttcgtcttctgtgaactactcatgttttaaatattgcataccattgcaccaatagaaattaatctcattggtcggatgcaacacattcaatgatgcacatttacttttgcacaaataaacgaaaagatgatgattattttggaagatcttaaaaaccttatgggatgaccaaaatggtatggagggactaaagggtaaaagttgatttattttaggataaattttagacgtgagaagttggtttatttcgagaagtacgtataaaactccgacccactccacctgaaaaaaggggaaaagaaaagcataggaaacaggccaattttgtcagatctaaccagcccggcccaagcagtacgcctcggcctcccgcggcaagcgaaaagggggcaaaaggttgcagtagaattttgttttccttt

SEQ ID NO: 590 - DNA, 13610 bp, Oryza sativa; identical to SEQ ID NO: 407

SEQ ID NO: 591 - DNA, 3113 bp, Oryza sativa; identical to SEQ ID NO: 429

SEQ ID NO: 592 - DNA, 4423 bp, Oryza sativa
aagtctctggatctaaacaccacctaagccttttgctttacattatacacacgtttatatgtcgggtagactgaaagatgatgatggagttaaaactacacggatgaaatttgttagattgaaaagctcaatcacagcccaaaaaattgtgagttgtattactataggccctgtttaggggtgtttaggagagaggaactttagcccctctctccaaaaaataagtccctacagagggactttgtttagttcctaaaaacttttcgtaaaatcatcacattaaatctttggacacatgtatagaacattaaatatagataaaaagaaaaactaattacacagtttacatgtaaatagcgagataaatcttttgagcctaattagtccatgattagtcataagtgctacagtaacccacatgtactaatgacggcttaattaggcttaaaaaattcgtctttcggtttccaggcgagttatgaaattagtttttcattcgtgtcaaaaaccctttctgacatccgatcaaacgtacaatgtaacacctaaaaatttttatttcaccgagtgaacaggcccatagtaccattaccatccatgcatgcgcagaggatcccgtggcccagagccacgtcgtgccaagtgcggcggcctgcgagggagacgcatgagaagggggggcatgatggattgcaggaagcaatcgatcgatcagcgatcagctctgcactgcctgatcatctccactcgtctcatctgagttcccccacgtccacactccactcttccttttcttttctcttctcgccacccaccgagccgggccccagtccccactgtcgctgacagacagacaccccccccctcccccccgattcgtcgaatcccacacatttactcctcgtcacccacctccctcctcctcctccagcaccaccgccgctactagtataaaacacggaccgatcctctgatcccctcaagaagagcgaggcagccatcgatcgtcgcctctctcgacaggtggggggatttagtcgagcgttcgtaccgctgctccttccattccattcctttggctcttgtgcagctcgatccatcgctgctgctcattaatggcgtttgtttgattatggagtagtagtactttgtttgtttgtttcttctcctgtgtgcttgactggtagttacttgttgcagcagctggatggagcggtgcagcgtgctggggctgggcggtggcgggggcgggggcgggcggctggacggcgagctgccgccggggttccggttccacccgacggacgaggagctgatcacctactacctgctgcggaaggtggtggacgggagcttcaacgggcgcgccatcgcggagatcgacctgaacaagtgcgagccgtgggagctgccggagaaggccaagatgggggagaaggagtggtacttctacagcctccgcgaccgcaagtaccccacgggactccgcaccaaccgcgccacgggcgccggctactggaaggccaccggcaaggaccgcgagatccgcagcgcccgcaccggcgccctcgtcggcatgaagaagaccctcgtcttctaccgcggccgcgcccccaagggccagaagacccagtgggtcatgcacgagtaccgcctcgacggcacctacgcctaccacttcctctcctcctccacccgggtcagcactttccccatttattttcttcaccttttgcccattgtgttgttcacttcatcctttggaaactttctgttgttgttcttgctgcggatgatgtgtgcaacatatggtaggaataagtcacgaggggtctagggcacaatcgctagctctgagcttgcttttctggtgtgaagtcatcagcagcgagctccctccctgcgctgctatgctacttcctgtagcagcgcaggggtgctgcgacgcagattgctgcatactgtacgtagatatggtaatcggtcagcttagcgcagtgaaagatcagaggctgcagcttagcaggatacgaatctttttttggcctcatggaagcttatatgcaatccaacgcatgaatgcgtggatacatgagagcacaaggtgtaaatgcatactgtactccttacgtatttgcaatttgcatttagcaaaaatagatgccttgggcatacatctgcgtttgtcatttgagcgagtaaaccaaagaggaacaaagttcgccttgtgcaacgtgcacgcgaaatcgtagtactgtactgctgctacacaaccttgtactaccctttttttagttcatgatatatatacacagttaaattcgtgttgctacacaaccttgattcttaatttctctgtgttgatgtgtcgtgcaggatgagtgggtgatagccaggatcttcaccaagcccggcgtgttccccgtcgtccgcaagggccgcctcggcataagtggcggcggcggcgacacctcgtgcttctcggactccacctccgcctccgtcggcggcgggggcggcacctccgcctcgtcggcgctgcgcgcgccgctggctgaggcctcgctgttcgccgccgccgcggcgccagccgttgacggcgccgacagcagcaactacggcgggggcggcggcgccggcagcgccaccgccaccgccaacttggtcaccggccttgagctcgtgccctgcttctccaccacagcccacatggatgcctcgttcggcaccgggcagtacaacccggccccgctggccgtcgagccgccgccgccgccgccggccttcttcccgagcctccgctcgctgcaggagaacctgcagctgccgctgttcctctccggcggcatgcaggcgggcgtgtcgtcgcagccgctcagcggcggcggggccttccactggcagtccggcatggacgtcaaggtcgagggcgccgtcggccgcgcgccgccgcagatggccgttggccccggccagctcgacggcgcctttgcatggggcttctagccgcagatcgacgtcatgacgcgcatggggccggcaagtatgcccttcaaagtgtatgctaattactacttactagctcattaattactactagtagtactgtattaattagcctctgatctgttcttagctcaggttttaagttcctagtaggtgtatggttaaagtagagtgaactctggactatggctagcatgttgtgatcgttgtgtcatctcactgcagtagcaggatttcccctgaggtgactgatcagtgattacacaatttttatagatttagtaatgtacgaaccaatataaccggtctaattaatgtatgtgtatcggagcgtatctgttcacaatctatgagacagatgcatggttgtttcagctccaaaccaccatctttaggtatattttcgtgctgcatttctttttataccagtttgttaataatgtgaagattcattattgcaactgtagggagttgcaactgtaagatagatttcatcgcagaagatctagggatattcatgacagcacgctagctattcaggatccaaatccaatttgttcatcctactaactgcctaacacgcaaagtttaaattttaaagatgatgtgactgaaaagttgtgtatgtatgacatgctgatgtgatgaaaaatgactaaagtttggatccaaacttcaaatctaaacacagccattgtcattcatttggcttgaataacaaaagtgacgttgtcaaattattcgatcggcatctctttggaagtattaatagttctctacaatacaaatcaaagaatagataatcttgccagaaaatgtagcaacgttcgaaacaacaatcttgtgcaaaataaaataaaaaaaatcttgctattgccaaagtgcacggctaagattaattggcatagaatgaacatatactatccaccacctggttaccgatggtgttaaagcgttgatagttcgtaggtcattcagttggccctttggctgagctcgaaaccagttgcttggctgggactcgttgtgcacttgtgccatatgtccattagcatatgattaattgagtattaattattataaaattaaaaaataaattaatatgcttttctaaagaaactttggtttaaaacacttttgcatcgaacataccgcttaatagcttaatatttagagaaatgtatcaattcttgtcttgggagcccctacggggacacatgtggacgggaaatacaatatactagtaggtacttatagtacttacacctttgtgcatttctgtgcaagaaaatagctgtttcaaaacttggtccaggccgaccacctgttcagttatggcctagctaacgttttataatttcaggagtactttctataaaaattgtctttttcttaaaaagaaatcaatactttccct

SEQ ID NO: 593 - DNA, 2997 bp, Oryza sativa
taagcaggacgatgacgaggaggcatgcatgcatgcatgatcagttgctgtgctgcttttactcttctttttcacttctttgaacttgttttatatacgtacgcgaattaggatcttggtgatcataatatggtagtactcctatgatcaataagtgaccgttggaagaagaaataaatgatcggtataatttgcctgcatatttgtaacgggttagatggaattatacggaatataatgaaacaaataaatcgaccaccatcgtggtcagcatatatatctgaacagcattagcattagcattagcagcagcagcagcatataagcaagatcggcacctgcgtcgctgtctcggtgatggtctttttccctgtttaaacttcaaaattttgtgatgtctttgtctgccatacggaaaaagggatatatggggatcgtttcgagtccatgaccatgttggtgatcgtttccaaaccaaacaaagctttccacactgttggcgaaaaggttgaggatactattatgaattttaaaccgatctcctgctaccgtccaaagcaaagagagaaaaaaaaggaggcaggcaatggcaaacctgtaaatacggagcggtatcgtgcaacgactctgacagcctcaacaacacccagccttcccctgcaccagctggccctgacgtcagcaaccggcagcgccgccgccaaaggatggaatcccaggcccagcaagccacaaccactgcacgtgggccccaccccctcatctctctccctctgcaccggggccccaccgcatcagcgctcgccaccaccgaggcaacgtgtccctttcgcgacactcgagtacgcgagaccgtacggcgtgaggcacctgcgctgcactgcagtactgcacctcccccccccccccccctgcgaaggttggaaggagcagaaaaggaaagaaaagcctcttctactactagtcttcttcacctttttttcctgtgcgtcttcccgttgctgcgcgtacacgattgaggcgcgggcgcgcggctagactctggatggctcatcctcattgtgccgtcaagccgtgctgctgcttctgctgctgctgcctcctcgtcgccgccgtgctcgccgtcgccgtctttctggccatgtcgccgcccgccgccgccgccgccgccgcatcgtcgtcacaaccaggtaggttcaaaaagtgcggggtcttttcttgtaacgtgagttcttgacgacgcggctttttgtagcggcggcggcggcattgcaacgggccgagacgacggcgaccatgtacaccgcgaaggagttgcgggagaagcaggacgtgaccaaggtcggtctgagctcaaaaaaaggtggctcttttcatggctttcttgccctgttcgatcgatctcatggtggtgtagggtttcttgatttggggggttgcagggcgcggaggaggacgtgaccacgacgacgacgacgacggggttcggcgcggagtcggagagggaggtgcccaccgggccggacccgatccaccaccacggccgggggcccaggcggcagtcaccgtgagtgcgaatcccccgtcgccgtcgccgggttaacgaatcgggcgtgaacccagaatcccatgagacgcgatggtctatgaaagaaagattgtgctcttcaattcgttttgctgaatctgtgatgcacttggggattttattcagattcatttcttgctgtagggaacacagtagtatgtctgaagaactaggcagctagcttaccaccattatctttgttttttgcataccaaactaaggaaaaaaaatacgattcataagttctccctaagttcttcttcctaaggaatctttgcatgcttccggatagttcctctttactctctcttcttgtattgtgatggatttgagttttgaacagggagcttgttcctgttcaagtattctgtatgttgatgcatgattgattgttcaagttgaggaaagaagcagcaaaactttttgttcctttttctgttcatggaaggatgaaaactgcagctttgttctgttgtgtgcaatgaaaagagttcatgtctagtcttctgatatgtgctggccctttttgaggcctggagcagcagcttggtccaatgtgcatatatctcggctcagaagtgcacaagacttgattcgaaattctacctggttgctgctacttgctggagtagcaagcatgcttgcctgttgtaatgcctttcttgttgtactccactttttaatttggtgcaacaagtcatacaatactatcatgttcaacctttcataatcgtataatgcaactccactgcacaagagaatatggttgtgtgtttatataattcagaaaatgggcattttgtgttagctatgagtgaactgagtatcagtgaggtgtgagggtacgtttcttatgttgtttgatctatgtatgtggttagaaccattttcaggttcccttcaaaattaagattttcagaacaacttatctataaactatgtaatccgtagcttttgatgtactgcgatttgcaatattgcaatgatcaaggtagagagcatctgaagttgatgtagaacgttatatttagttgacacaatgacagtatgaattaccttctgttccatgacattgcaattcatgtcgactacctggtttgatttccagcaatggatccaaaagctcgcattcttgtgatttacttgaaatgattgtagttgacgtattgcagttcaccgtttgctgacggtgtacagcttacacaaatcactgagagagcatgttggaaacaaacacgcagtagaaatgtttaatgatcagagcagaattcaagtatttttagccaaaaatgggggaaataaatgaagcatacaacgaccaagtactcctactagtacagaaataggtacagtttgactcctttaaatgtaggtcctatctgattcgtatctcttaaccacaataccag

SEQ ID NO: 594 - DNA, 8139 bp, Oryza sativa
gagcaacataaaaaatcaaaatttcaggatacttcgggtgtgtctagttcacgttaaaattgaaagtttagttaaaattagaacgatgtgatggaaaagttagaagtttatgtgtgtatgaaaattttgatgtgatgaaaaagataaaagtttttagaaaaagtttggaactaaacaaggccgaatcttcatcttcaaactttaattcctccttttttattatttttttaaaattattaaatgatatatatattctaaaaaattctataaagatgttatttaaaaattcaaataaatatttttttaaaatttataattattaatactttattaattatgtgctaatgagttttctcgtttcacgtgtattgaaaatctctctccggacttccgggaaaaattcagcatagctaggaatcccaacataaacgttcagatttacaagtagaagttatagtttattacgagacatagtagatcaaggatccatggacagatatatataatcacccatgcatatcaacagtaatgaaacttttttacacaacaatcaacagtaatctaatggactggtaccagtataatcctactactagtagtagcatagctcaatgagttcttaattagtaatcagatggtcaatacacacccaaactatatagtttagctgcaaacttcagtctttttccatcacatcaacctgtcatacacacacaacttttcagtcgcatcatctccaatttcaaccaaaattcaaactttggatccaactaaaaacagccttagtagctgggatcagcagttatcagatttgcaagctgggagtaattaagtagagtacgtgtacacagtagaagtagggtatgatccatatgatattccctcccttccttcccagcttgcaaatctctcgtcttctcgtctcgtctttggctgtgatttgacgcgagaaaaaggatagccacccgccatcgcccacacgctcgcgcacatacgctacacctccccttcgccgtagtatacacctccacctttcccttccattaatacctccaccccccactcctctcccccatctcccctccctctcgccattggagctagacagctcgagctccaggaggaagaagagagagagcctagctgctagggtttccatcggatttggttttttattttctttttgtttcttgtgtgtgttttgatggatcagagctttgggaatcttggaggaggaggaggagcaggggggagcggcaaggcggcggcgtcgtcgttcctgcagctgccgctgtccacggcggcggcggccaccgcgtactacggcacgccgctcgccttgcaccaggcggcggccgcggctggcccgtcgcagtaccacggtcacggtcacccccaccacggcggcggccaccaccacagcaagcacggcggcgccggtggtggggagatctcggcggcggaggccgagtccatcaaggccaagatcatggcgcacccccagtactccgccctcctcgcagcctacctcgactgccagaaagtatatacgctcgattaattcttctccgattttgttgaacaaaatactccgtagtaattatctatcgatcatatatatcactgcaattttgatccatccatccatccaggtcggagcgccgccggaggtgctggagaggctgaccgccacggcggcaaagctggacgcccgccctcccggccgccacgacgcgcgcgacccggagctcgaccagttcatggttcgttcgtccccccccaactccggcgaccagttcatatatcgttcatgatatattgacccgtccgtacgacgttgaatcgatcaatcaccgatgttggttgcattgatcgggttgattaatcggaatcgaatcaatcttcgacgcaggaggcgtactgcaacatgctggccaagtacagggaggagctgacgcggccgatcgacgaggccatggagttcctcaagagggtggagtcgcagctcgacaccatcgccggcggcgcccatggcggcggcgccggctcggcgcgcctcctcctcgccggtaaatcaaccaatcatccatccccctcctcctgctctcgcctgcggttttacttctatttacacacatgctccttctgcttcttctcttctgctgctgctgctgctgctgatgatgatgatctcgtcgtcggcggcgatggcggcggcggcggcggcggaggcttaccgcattaggaaatagtttgatccggataatggaggtggttgctttggatgattgccattgttagtatagctacccatccaaagccctgtggattagtaatttatttattggggttagtaacaagacgcctttgcagcagcatgcactaacaaaagtaattaaactaacaattagtagcggtctagtcgagtgattaatctaatcatgttggcaaccagggcactgtgagcaaccatgtctcaagcttctcctcctctcgtttcagcagcttcacctccattgtttattgcatccatccatccatccatggcagcagctagcacagcctagttgcaaaacacaacacatgctagcctttcaactcaaccatttcttttttcccctctttcttttggccatgaattgtctcttctctctttcttttcttactgctctactagatgacaagtgactagaagccttgtctttagggttccaaggcatgcagggcagaggagagaatcagcctgtctatagactaatagctagattgatggagattctgaatggtgattaagcccagtaaacaatggtttgaggaagagtattataactacatagagatgtatggcagtacaagcttggttaatcatctctctggttgctgctgattggatagcatgcatgcatctaccccggatcagtagtattattcttttcttgctctagtggaagtagagccatatgcattggaaattgttgtcatggggctagctaggtacccaatgttgcagcagcactgtacgaaccgtctttcttcttcgcacgtagcactgcagctgttcttgtaatggttttgggatgcagcacagattcatctgggcgttcgtgttttccggggggttgtactgtcgattgctgcagggcaggataatcaattaatatgatagagatctgatgaactgttgatagactactgttgaatgctttttattttctgtgcatatatatatgtatagaagtattggagaagagtgtctgattggtagatcaaactaggtcagttgcatttgattcatgatggaaattaagacagttgttggagcttgccagctgctactagtagttttcctttttttttcttgtgaaagattcaatttgattaagcagagatgcaactttattaggcaatattagtggaagtcccttaaatgaaaagttacagaaccatatattatcaaaggtttttatgaacaatatacaaatttattctatgatcattttttatattactaaatctatgttcgtcagatattgggaaagattcacccggcacttatgctgcaaatgtgaactcttctctattatctaaaacaaatgggagagattactagtttcttatctctgtgatgctcaaaacctcacatggtgattctgtattctctctatataagcctagcgcatctatgctgaattttcacaaataaatctcaactattgaaattaggccacttcaaaagatcttttgtcaatgagtttgctatatgttggtttacttctatgattgcttttttgataatgtatttcatctcatcctcgcgcatgcatgcccggttatttattgccagttatgtgttccatttgagatttaaagaaccagctaatatattattattgtttttcttgtttgttatggtatgacaactgtcctagcaaatccacatccacacatcgatctatatatcttaaccaatcagcaaggctctatttgtttgtatagatcagcatgttgtttatatcgcatcattggtattaaattgtaacagttgcctactatactggtgaaacttctgcctttaaaacaaatgacactagcttatacattaaacaaatatgattgtgcaaatgcatttactaattttttttatctaataaactgtgcttgtcacttgtcagtgtttaacaaactgtccatttttcagtcattcataagtgtcagtttccgcaccattagttttagtattatggtttcctactcttgccatgtatgcttaattagattcactttgctgaaacttggaaaattaccattaatgtgtccaaatccatggactggttttgattttataattttatcaaaactgtttgagaaatgtatttttcaaatgaattatcatgtttactcattccacaagttaattaacgtgtttctcctcaaaataagctaatgcgttttctataggcgccacaaataaaaagcaaagggttcattcacaaaattttgaaggttttttttagcaaataccaagtgccatgttattaaaagattaaaatcttgtcactgttaatgcattagtacatcaggaataattctttttctgcgtagaagcacaagggcaacattggtgtatttgtcatgccatttccttttttcatgttatttgtacctcatcttaaaaaaaaggagaaagtattacataggggactaatagcttatgtgaaagaccaccgactggtttataattaaacactggctcatttctttgaagctttttttttaaggatctggttttccctctagtagttctgagctgatgaaaagtttctatagcgggttactgagagaattacagtcattgtgctaccatgagaataaatacaataacagagtaacaaccatgagaatatgttcaagaactaatggattctaaaatttgaaaggcgcttaaaatgttttcttgacactattcatgatgagaattaaacggttaatcaagtaagacatgggacgataacaactactacctaatcctgtaaatctacagaatctccatgcttttcagttgctttttatgcacccacaatatagttttcagttgcatgttatcattggaggatgtagaatactcatgcatgcacaattttttataatatggggccacatatattatcttttattttcttgtatcacatcctgggtcagatcaacaactgtcactgtacagtttcctatgtatagatcaattattttgattgcccatctgaaattaagttatggtcatatgtatctttatttattttgaagttgatctccgaattattcaattacataggcccaagacaacgctttatgtgtgatatttttgtttctggttgtatggtagtaatttttgtttttttgcttttattttatccatttctttgttatatgctatattctgtaggacgcatggtcagcatgtgaccattctgtttagagcagagaaatgctctgtcaattctttatttctttccactaaatgattctttatctactgccataatatgtattcctttgaccattggaccaagttttttaggccaaagacctagcttttatataaagcaaaagaacataggtgataagagataggaccaagtttcagtcagtatcatttttttcgtcgaagcctgggactctacgtatacctagttcagtggtttctactatttggtttatcaaacactgttttaaaaccataatctgcacaccacaatctggtcaatatatctttcaactggctgatttggcacaaatcaaacctgacaaattaataaacctaaagcagtgctagttttatccttgtattgaatatccttgtcttttcacttgcatagttttttttaccgttttttatagtgttttcttctacgaaatcagtagggcaggatccttcttgaaatccatactctttactgtagctactctaccagtagtcaaatacacagtgtcaccctattcttgcattccaaaatggatagagttgtttacccacagctatgggcctttctgcgtctgttccattgctgaccaacatggtctagactgaagctcattccaacaatacaatagaaatctgatgaacaaaatgtagtatgatctcttacattaaccaccttttgtctgcagatggtaaatctgaatgtgttggttcttctgaggatgacatggacccaagtggccgcgaaaacgagccgcctgagatcgacccgcgcgctgaggataaggagctcaagtttcagcttctgaagaagtacagtggctacttgagcagcctaaggcaagaattttccaagaaaaagaagaaaggaaagctgcctaaggaggccaggcagaagctgcttcactggtgggagctgcactacaagtggccttacccctcagtaagattacacatacaaaattacctgataatatatagtaattgccacaattacctaatgcatacatagttctacaaacatcttagttcagatcagatgcatcatcacattgttactaactttgcaccaatgggatgagtaggagacggagaagattgcgcttgcggaatcgacaggactagatcagaagcagatcaacaactggttcatcaaccagaggaaacggcactggaagccatcggaggacatgccgttcgtcatgatggaaggttttcacccacagaatgctgctgcattgtacatggatggcccgttcatggcagatggaatgtaccgcctcggttcgtgaacctcgatctcgatcatcggcgtgtttgatgagagatccaatgccaagataaattgatcatggaatgtattcagcatgcgttgcaatgcatggacattgttatggaatttttggtttatttacctttcaccgtggattgacaaggtctcgatcatgttagtgttgatggcttatagttctccagtaatgttgttgtttttcctttcgatggcttgtaaaagtttaggtgtatcggaatttcgatcaacttgctcgtacgctggtaattaatttggtgatggtctatatgttgtatggttgtgcgtttcagattggtgttcaaagttgcctatctgaaacaattatatatatttatattgcttctcattttagacggatggttcgaattaaaatcgaaattacttgtgaaattgctggacctggatgttctacttcctagagctgtgaattttatagtttctggatttggtaatcaggcatgcttggtgaagcatttagaaattatgtatacatttccagatgataattaagaaaaaaaattgttcctctttaccattaattattatatgccgtgcaatttatcacgtatgcaagttagttacaacggttttgtactgcattggatgcaaaataaaatgattgaagccattattttatttctgactcaatctgattattgttcatgcatgatcaggtagcttggatagatggagttggtacatgactgacaaactaccctatttgcctcccctatatatggaacatcagcttagttcagtcttaatgattttctcgagagacaaattaattcagctgtctagccaaaaatgttatagctagaaactaatcaagttcaagagtgcttgagctaacctttgtataaacagaaaaaaaaaggattcttttatatttcaatcgctagttccaacgtgttagctccaaaatcagtttttcccaatagtacacctcctaaattttaggcatgcattcaggcatcattcctgttctccaacagcgtcccctatgcatgatatgtgctatagtaatttcccaaataatcatcaagttctatgtattctggttgaatcaatcatcagatatctgtccaaaaatgccagatttgtcgtcattttgtggtaagcagcagcactggcacttactcttcagacttcagtgttcagtcagattgcacaaatcactcaacagtagtaggatcatggtgaccatgtacaagattccctatgagcagttttcattatcatatatcagagccgcatgcaccaggaatgtttgcatctggaacagctatccttgacctcttgcaatataattgtgccatctactgctatctcacacacagcctcacagagc

SEQ ID NO: 595 - DNA, 15276 bp, Oryza sativa
ctttaataatataatagatttttttaagaaaaatgctcgtgttatacgtgatctgagatacacttgatacgtaagtggtgtgtggtttaaattctgagatcccgtgttgaattttcaacacgctcgtaagttcttctaaaaaaatatttgaagtgacgtctctctccaaacctttttttttttggtggggtttagacaggatctgaaccggacctgtacaagttgaacctgatgagacgagatactatgcatgcatataaacattacacgatcctaatcccaccaaggagaaaaaaccgatccttggcgaggcagatcctgacatatccttgtcctcccgaccaccacagttgatcgtagccaccctggcgtgcgtgcatagccagtttagccacacgaaactgtagctctctcgacccaaattccccgaacccacctactagctactcctgcactgcaacagcaaatgcaaggagaaaagcaccgagccagccgatgagactcggtgaccgtgccccggcgccgaccgccgcgtgtgcgtgttcgcccaggcaaaagacacagcgcaattgcgcgcactctctttcgcaggccgcgccgccgccgccgcttcgctttgcaattgcatgcgcccttttgccgacgccgcctagcttatcattatccttcctcgtcggccgcggttttcaccgtcctctctcagctcccctcgtgttttcaccgagcgacgcactcgtaaaaatacatcaaagaacgccgcggtaaaagctacgcaccccgtacgtacgtaaaaaagtgggtggtaaaaaaaaaggatgggttggtgtactggtctctgcgtacgtgaaaagactagctatcgatgcgtgtatctctgtgcgtgcgcgaacggaagaggggagcagcagcgagaggctttagctagtctcgcctttttctttttcccggctttatataaggctcactcgctcacactcactcacttgtgtctagtttacaccgatcagtagtagtgctactaccactttgggtcggatcgagcttgttgttgcctgcaaatctgcaaataatcttagctccttcagctaaagagcaagcaacggctactagcttccctcaacgccctcgtcgcttgcctcaccgtcaccgtcgtcactcgtcattcaccaacactcgtcaggtacgcttctcgcagcttgtagtatggatatgtgctgcagtgtttagcttctactggtgtgatgattaatttcttgggcttcttccgatcctgtgacgaagtcgcttgtgataatttggggcttattcagctcagacgaccagatgcaaagcctgaaagtctgtcgtctgctaagcctgtagccgtagcacgtcgtcttctcgtgagcctctggttggatggaaccttggagaggagatggaagtatggtagtagtgtcgtaccagtacttgtgcctgctgctgctcgctgcacattgagctgcgtggcgtatgcgccgcgcattttgctgcctttgcaaaatgctcgccgatgcatatgcatatggtctcgttctcctcttctttcgctcgctgctcttttgaggagagagacacaagcgaggccggctttcttttgcccccaaagctgcgtggccatggcgtgcagccaaacgcttcacatctctcttttctctctctttggcactgtcgagataccagtcacgcatcacggccatgtacgaacacgtctcctcctctgcagcaaacctgctcttctttctctctctatctatccaacgctatcaaactgtagccgtaggcctctggcgaggcattaaatgcaagcgaggcattaaaacgcaggcacagctcatgattgcgtcgcttgttggtttcctcctcgtcgtgttccaagcttcgacctgcaagctcggacggacgacttgccttcttgccgtcgcaaaagggtgccctaaaaactgatcctcggtcctttccatgtcacccacgacgaagaacaacattgctcgcacagcgtaggagtagctaccattccttgtcctgtcatggaacatcaccgaggaaaaaacgagtaatttatgtctactacagaatcttggctggctgatttctatagctacctggacagcgcattttcgagtactagtataggagtatagtactctatgattttgtggatagtagctttttgcatgtttgggtgtgtttagttcacgttaaaattgaaaatttggttgaaattaaaatgatgtgatggaaaatttaaaagtttatgtatgtacgaaagttttgatgtggttaaaaaattgaaagtttgaaaaaaaattttggactaaacaaggcctttgtatctttattttacaaactttgtgctgttggagtagtactagactactagtaggagtaactttgtattgataatactaggagatgaacgtacttgtaggtaatggtactaacagactacgaaagattccaacagcatctatatatgaaaaaggggaacaaaggagaattctgaaaaaagaaaagcacgcaactcctctctttgatttttttgcttttgtccatccatgcatcagccaacggttaaaaaaccccgtcgttgcatcatgggtccgcagcaccaaaagcccctcatcctcctcccccttttgcagagcatttcttcccttttcccccagcaacgagggtaaaagcaagctagtatcctactatggtctactccagccaggctaccactgccatcctgcatgtctcccgtccgtcgatcgtgccatcatccgcctgcagcgtcacgcgagtcgggttcgccgtgacgacgacgacgacgagagatcataatagtagatggaagactaccaccagcggtagcatagctataatagtaacttcttcatcatttacagttaatttaatagtcaatagtcaattcatataatagttatctataaatatatactatttctacctgttatacacatattgtgtcttgtaatccgtactatagcctattgcttatctctctttcttcactgtgtttatagctggcttatagtttaagaacggtggtgaaatgctagaaaagttactataggactaatctcgcctttgctccaaaaaagaggggcagaaagaccggggcgtgctcgtgctggaccatccgccgctctcgcgcgggaccaaaccaaccaaccagccgcgcgcgcgcgcgcgagcccggcagccgagctagctagccacgcccaccaattccaccgtgcacgcgcgcgcatgcgtgcatgctcgcgagaacggtcgggtcgggccctcggcgtgggatcgagttgtttggttgcctttcccgtgctcgatagatagcgccggacgacgacgacgacgtctttctggtctttttgggtgcacacacgcacccgtttgcacgtcgcgtcgctgtccctcgctgccacttcggctaaaagtcgtgcgacgacggggatcatatccgtgtgtgtttgcgttcggttcgacacgtgacacggctgttgtgtttgattgtctcgtatgtactatatttttcacctccctgaagaaaaaaaatgggaaaactgagattagtaggggaaggagttttttttttaatcttgtgggtggcctttgtgcatgcgatgcgattcgcaccgaatcttgtctggtcaggtagcggcgtcacgtacccatgttacgtcctttccagcttcaacgccgccatgattgcactcagtcgcagcagccgcgcgtgctcggctgcgccgtcaataatggcctcgtatctcctccacccacaaggccacacacagcccagtagtaggccagtagtccaccggggtcaactcctccttcgagtgcaacctctgccagtgccagccatcaaaccaagacccccccgaattagccccaaatgatctctttttcgtgtcaccttttccctttttttttcgtcctgcgatcaggctagagtacgtacgagtactagtactagtgtaccaggcaacgagagccatcgatggcacgcagcgctagtccactcgattacggttgctcgccgtacgtctcggcgcgacgcggccgtggtccctgcgtcgcgcgcgcgtcgcgtcgcgcacgccacgccggcgctcgcatgcgatcatgcgcgagctcgtcgcaccggcttggccttttgccgcgcgccacggcttttctgacccccaaaataaaagaaaaaacggctgcagccagcggcggccggtcagccagccggccagctacacggtgcgcgtacgtacggggggaaacacgcactgtgtggggggaaggaaaaaaactcgttgagcagactgggtggctctcggttcaaaattgtctccattgatctaatttttaaaaacttttaaagtaaaaatatttatttttaactaaagttgcttacacgctactctcttcggtctaataatacttgcccttttatataagggtaaagtcaaactttagaatctttgattatgaatctttttaaaatatttgtccttcaaatatgatgattacatgtatagattagtcttaaaaaataatttaataagatcatatatttgttaatacttttatacatgttataatgaaaaataatggtcaaaattattttttggagatcgtatccttgtccaaaacgacaagtattatcaatccggagggaatactaacttagctcattaaacaaagaaaaatataccccctacatccataaaagttacacatattatttatattatttttgtcaccaagaccaaggaaaatttaaatcatcttggatgttacaaaatcatagagtgaatgcaagcatgtaaccaatgagtgtttagatgcctccttgggttctaatcaaatatttaatttgtctccttatttaagtcttgaatgcataaagactgcagatagaaataacttatttgggaaaaactcaaatgtgaaatatatttaacttttgtggttgaagggagtaataaactataaaaacagtactactagctagcgtgtgatgatatctagatttccgtttacaattataaacgattctaaaatacttttataatattaaggaagtagcaaaacgataaatcatagtgagtattatttaatatatttgacaataaactagaagtagtaggggagaaataaacaatacaaaagtcgataagtgtaaaataaactaatagaatactatgccttgggattacagatatcttatgtttataataaattaaaataatataatctcttatatttatatatcgagggagtacgatcatttagcgtattgtgctgtacgctagaaatttcttacgtctggttcgtagaaccatttgtgggtgtgatcttaagcgagggtacctgcgtacgtaggtagaagatggggacggggatatggttgagagaacgggagtggtgaatgccgtcctgaatccacggagcagcgtatggagtcacgatttgttacggtgagctctcgctctcgtcatggcggaggtggatcgatccatccattttcacgccggtcgtggtcatccatcaatgctcatgtatcgtgccagcgagattgcaggtgatgtcttcatcatctaatcggaaattcagcaacctggggagaaaaaaaaatcaacaaatcgctgagcactgtacctaatttccgggacgattccgtacgagccccctaacagtagtgtacttactggagtactaagtgcaatgagctaatgccatgtttgccattactacttgcaagcagtcaatctttagggcagatgagacgatctgatccgtccgaagaaaagagagggggagagggacccagccgtgttgtggtgtgatgatggcgccttttgagcacgcaaaagaggagtcctagaccgacctgccaatgccgtgcccgtggcagccggcaggtagtgggttggcactgcctgaccccccgacccgactcccctgcctcctgctgccgctagctgcgacctgcaccggcgcatgccgcagcacaacagcagcagcggctcacagtcacagcttgtgtgtgcgtacgtacaacccgagcacgcgcacagtgccgcaccgcagcacgcggcacagcagcggcattaacgccacatgctctcataaacgtatgagtatttcttcgcactttttgcaggcttgcgatgcagcgacgacggagaacgcggcgccgcgcggcgaagggcgagacgaggcccggggttgggtgcgcgtggtggtggtgccatgcacgggctgatcgggttggatggatggtcccccgtccgtagccgtaagggtggcccgcgtgtggcaggtggcgcatgcagcagcgggcgcagcggctgctgcttgctctgcttgttcccctccccaagcgccgtgttgcctctgaccgcgccacgcgaatgctccgctttgtccctcgacgccacgccacgcgagtagcgccacgcaccgcccaccaccccatccatccatccatcgggccgtgcgccgtggttggcggcgttttttcttggtaggttttgtattgtacgcacgcactggtagtggacggctagtagcctagaactggtgtaagtcgttaacccgtaaaacctacttaacctgtttggattcgtggccgaccaattacacccctacctaaaactaagatcggtgctgctgctgcttttgcccgtgcgcgcacgagtaaaaaatgggtttgggccatgagggaacgagggggtgtgtgtgttgtgttcttctattctgcaatggtggagcgccttcttgtcgggggcacgcacgcttccaaagttgtaccgcacgggcaccgaggggcagggcagggcaggttctctcggctttgggacatttcttgctgcgtcgctggtggtgtagcagtggtggtagtgggagtagtggcgttcaaggccaaaggatgttgcgtttcgatttctctagtgcttgggccatgctgcatgaggcttaaactaaactttgatcacactttggatgcatgttcctgcacaacaccaaaaataaaaaaaaaataaaaatcctccaaaaatagcgcttggtaggatgtccgtcatgccagcaatacgcagttgaatcagacttaagtgcctgtcagcattgaacaaagttttgtaatgtcaaaagttccattattatacacacaatctgcctctcaatgatatttacaagtactactagtactagtactcccatggtaacataacaccacgcgctagcggccagccacacgaacatgtgatacacttctcaataaaaatccccatccattctcccttccttccatccccttcgataatccacccccatccgttggaaacctcagctgcactaccctctcgtgtttctcgcgccccaattaatccacgggccacaacgttttacctaccgtctccccccacctacaagaaatcatttctacgacgcctgctacctttggtaaaaaaaacggagcatattttgcttcttccctgttcaatcttaccaccggcaggcaaggcgaggtctatttatttatttaccgcgcgaggcggccactactactactaggaccaaacagggtcaaagcagctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtaagtctctctctctctctctgctccatatgtactttgagcatggaagaaaggtgagagcggttttcttggtttccgtggcgcggcggcggcggactttgcaggtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacggtgcgcgcattatttgcccacagcccggcgctccattcttctccggccatgtcttaaccgtcatcgcgtctctggctccgcagggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtacgcacacgcattgctcgtcgtcttgtgttcttgcaagggaaaagaaaggaaaaaaactaatactgattggccccaatggtaggtatgtctcgatagggcggtcgttctactcgccggacataaggaagccgcagcggctcggcgatggcctacagtcatggtgtgggttctaccagagcatccggccgactcagatggggttgtcgcttaacattggtgagatgctcgcgaatatttggtgccctcatgcatgtatctttcctggttgtcatgtgcttgctgcttacatggtggatgatgttgatgccagatatgtcatctaccgcgttcatcgagccgctaccagtgatcgaattcgtggcccaaatactagggaaggatgtcatatcgaggccattgtcggatgcaaacagaatcaaggtaaatttatgcttgcggggaaggaatagtctagccttgttactgtagtgggatgtaagatgtgttgtttggatgcttttggttaactgatagatggcttaattgtgatgctttgcatgattatctgatttacctgtggaattcgccaattccatgcagatcaagaaagccttgcggggcgtgaaagttgaagtcactcaccggggaaatgtgaggcggaagtatcgcatttcagggctgacaacacaaccaactcatgaactgatgtatgttatagtgtaattcatttctcgtcatgtactttcaattgtcaaatgtcttgtaccgaactttcacgaaagtagaagcatgcatgttaagcactccctcttgcttctaaatctgagtatggcagaccaaatagaccaaattaactatcaatatccatatttcatatacgttagctactaggcattgtgttaagctatggaactgattttgtttgttttaacagtttcccaatcgatgaccaaatgaacatgaaatctgtcgtagagtatttcaaggaaatgtatggcttcaccattcagcatccccatcttccctgccttcaggtgggaaaccaaaagaaggcaaactatctaccaatggaggttggtattaatctcatcaagtcacaaatttcattagctggtcaattatgtaacattcaaccttggtaaaagacatcatcattttgagatatttcttaccaggcctgtaagattgttgagggtcagagatatacaaagaggttgaatgaaaagcagatcacatcattactcaaggttacttgccgtaggcctagagaacaggagatggatattctacaggtctagttttttctcctaatcggattataacattttgaaatatatggattacatgtttgtcaggagtaaatgtttcaagtattttgtcttactaaattggatgataaatccaaacaccaaatcagtgcattagaatttagaagatacgcatgctaatgtacgttaattgttctatgctgaagtctttgttttcattacccacttccaagtggtccaagcattccatgcaattgatgttcaatagctacccacccaataagtgctactagggtttctcttcacttgatcagcactcttgttataatggttcaagactaaaaaaatttctttccagacagttcaacaaaatggatatgagcaagacccttatgcaaaagaatttggaatcaacattagtgagaagctaacctcagttgaagctcgggtccttcctgcaccttgggtatgatttgcctttgttaatctcagtagttggctaactgctctcagctaataatttgggtatgaaattttgtggctttcagctgaaatatcatgatactgggaaggaaaaggagtgcttgccacaagttggtcagtggaacatggtgaacaaggttagattccccgttttccgcagctgtatacaacagacgtccttttatatatcatgatgatggcctgatcctgctagttttccactaattaagcattttttttttgcagaaagtgataaatgggtgcaaggtgaatcattgggcttgtataaatttctcaaggagtgtgcaagaaactactgctcggggattctgccaggagttggcacaaatgtgtcagatatccggcatggtatataactcttaacttcatctaatggttttgcataatattggtgcttttataatgttatttgttggctgcatcttttcagttttatctctgctcttcttgcaggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgagtgtcggtttggtaattgcatcgcaatttttccttggaatcctcatattgtgtgaaatgcttaagatgtaacttaatatttgcaggtgatataaaacgtatatgtgaaactgacttggggttgatatcacaatgttgcttaaccaaacatgttttcaagatcagcaagcagtacctggcaaatgtctcacttaaaatcaatgttaaggtaccaaatacttataaaccaagcagttaatacttagcttgtctacacaaatgtagtgtaatgcagtaagcagacttgcagcattgctaatgccttgcatttcggagttgtgatacagatgggaggaagaaacaccgtgctgctggatgcaataagttggaggattcctttggtcagtgacataccaactattatatttggtgcagatgtcacgcatcctgaaaccggggaggactctagcccatccattgctgctgtaaggctgagcatttctatggttacatggccatcattttttttttaacctcttaccctctctaataagctgcatgcaggttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcaggtcttttttgaggaacaatttgttcttccaaccaaaattaattgatgaagcctcctattaaatagtttagggttacctcctaccgattaacttatttttggttctggtcttgttgtgtagggagctcttaatatccttcaggaaggccactgggcaaaagccattgagaataattttctacaggtatgctactgcaaatactgtttataaactaacgtttgtagagtacagtagttagatatttgtggaatcaatttaatcctatgtatcttcaacaagtactgaacctagtgtttttgttcgctatttgaagtatgaaagttgctgttataggcttctatttgtatatctgctaatagtatcggtactgcttctcttctagggatggtgtcagtgaaggccaattctaccaagttctcctctatgagttggatgctatccgcaaggttagatgcatttgtattttctttactcagatattttgtccactttattaggttgcctgacgaaatgttttcttttaggcatgtgcatctctagaaccaaattatcagcctcctgtaacattcgtggttgtccaaaagcgtcaccatacaagactcttcgcaaacaatcacaaagacagaagtagcacggacaaaagtggaaacattttgcctggtaattactattcatcacctcttaaggcatttcattggatctactgcagatgataatgcaaccaacatattgcaaaaatattttttttattttaactaaaaccctcagtttgttggtagaactgtttcagtgatttgatacttgttttcctattcatgatatcacattcacaactgtttttcttggattattaaggtatcactttgggtgaactaacttttatatttactgttattcacttgatttctgtaattgctcatgtgtttgctaaaaaacaggaactgttgttgattcaaagatctgccacccatcagagtttgatttctacctctgtagccatgctggaattcaggtaagaatattgtagtggtccttttgtaaggctgacatatactgaacttgtcgttactctggtccccatgtcttctgtgattaagtatttgaggagacttcatattgtcttttcaaccacaagcagtgtagtacttcctccgtcccaaaatgtaagcatttttgaggttggtacgggtattaagaaagtaggtgagaatgattgaagaaggtgtgtgattgattgaaaagagaaagtaggtgaaaaagaatgattgtgattggttgagaggagaaggtaggtagaaaaatagcttcattttgagacaaattactgtgctagaaatagctacattttgagacagaggtagtagtatcacagtagctagttactgtagtacctagcaaagggcacatctgcacatgctagaacaaacaaacttactataccatggtcaaatttttaatcatgtgattgtacattatagtacttggatcagcaaatattctgtctgtagtagcgctggaatataattccccaagtttgtcctccatgtactgaaatgactgatgtgtgtgagttttccagggaacaagtaggccagctcactaccacgtcctttgggatgagaacaatttcactgcagacgaaatgcagacattgacaaacaacctttgctacacgtacggcattactgaatcttgttaagtttatcctttgcactctgagcttctctctatagaaattgtctgacttggtacatttgctgatgcagttatgcacggtgcacacgctctgtttctgttggtacgttcttctgaaatgatctgaacatttttccatcattttctttgtattcatgtgttattattagttggacacgaattctgaaggtgaatcttgcatttcttttttcctggtccaacagttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcagagcaagcatttggatcctgagcgacctcttttgaccactctgtaaagtactaagtaacgcatgtataatagttgttgtatcagtctgaaaaaaaggaagtgcactcagtgcttgtttttccagttctaggatgattttctcttcatggttaagatctggtaagagactcaatacacgaatccattatcaggataacaccaacaattttcacttatagaacatattcgaaaatttctgagaataggctaataattctcaaaataaaaataaaaataacctgcaggatgagcatcattcgttgctgccattaaggacagtaactaaggatataatgctgaatatacgaatctagttaagacggcctgaagcaggtccacagaacccgacttaaaatcattgttagttcagattccgggccacattgtatttttactgtgacttgcagatgaaccttcttccataaataaatattgcattcacttcaaagtgatgttttatgtgttagtgagttttgagtggatatgctgaatacatcaacaagagcaaactgaaaatccaagtatagcatttttaacaagctgacaaatgacagaatcatgctgcgatgataatgttcgtccatccattgttaagaagttatggttgcacattagatataatcatctgcactgataggcataggcaacaacagaaaaaaaaatactactggcattggtgtctaaccttgttttttcatctgcagaaccgtgttccatttcctggcaagagtaaaaaaaatccagctctgctacaagcctgaaacaagctagctgaagttcagtagtcctcaaattaactaactgtacaagcctgatcactcgaatgtctgttcagacaaggttcttcaaaattgctaatgaaacggcttccagtgattgatcatgcttctgttggtccagtcaaactaatggatgcttcaacaattcctttgtccaagcattatatgcttcaacaactcctcagtaccccttcacctcaatcaagctacaccctgcattcttcttgacagtagggtgtgccatcttgccccgtacccttatcacatcctcccatctacttgctgttgcatatacattagacatgagca

SEQ ID NO: 596 - DNA, 3294 bp, Oryza sativa
tgttcgttagatcgaacaggccatacggatgaagagcttgatgaattgttgtccggtgtttgacttatgctgcgatcgaaacggccgtgcatgtagcatccatgttactgtcctgacacctcttttgaattccatgcatgatcacaccttaaatttggcatgcagatcactgacaagtttgactgaaaccgctcatatagcaaatctccacgcgcgcaaccaccaataatttaagcgacgtgcaaatggccaaatacaacttcagacttcagtacgtataggcaacacattactggagtaagcaataaaaaagaaataaagtaaattctgggaaattggcatgcgtctcggtggtcgctgtactttcgccatgagaaaatagcaggtctgtcttgttgcatcttaacctgttcagaagctactcaagaaatctacacctttcattcaatgcgagcaggcacttcgatgggtcaggctagaccagatgagcgaactccaaaactggattgtccatgcgccacgagcctggtcctcaccacgattctcttcaactagtcgcgacccatgcaaggagccagagatctctatggaataatgcaccccagaaatcagatcagcacagcgcattattctaatcatcaccccgcaagcagggctcattctaagacatgatgctacgcgacacgatggcacttagatttgcatgcatgggcgaccaaaaccgcattgttaattcgcgccttgaggatgtcgggcgcagcgcacgagatgagctagccatagcaagaaagtagcgttcttgcaaacagtggcagctttcgcgcatgtctccggcctcccccttttcctctctctcgctctcactgttcgagaagacaaaaaagaaagaaactacgcaccgggaccttcgaatccgctactgccactcccacgaccaccgcctcggccctgcctctgctcgactatataagtgccccccctctgcgcatctattgatttcagcattgcttctgatcagaagaagatcccggaagagaccaaatcagaagctaaacctatctaccacaaggccaagttacgttagaccgttttgatcagtgaattagctttcaagcagttctactgctcccagccgctcgatcgatcgatcgatcaaacaaggtagctagctagctcaggatcaaatctggtttgtctacatatataggtagtgatcgatcagtcggtcggtcatggaggctcttagcgggcgagtgggggtgaagtgtgggcggtggaacccgacggcggagcaggtgaaggtcctgacggagctgttccgagcggggttgcggacgccgagcacggagcagatccagcgcatctccactcacctcagcgcattcggcaaggtggagagcaagaacgtcttctactggttccagaaccacaaggcccgcgagcgccaccaccacaagaagcgccgccgcggcgcctcctcccccgacagcggcagcaacgatgacgatggccgcgccgcagcccacgagggcgacgccgacctcgtcctgcagcctcctgagagcaagcgggaggccagaagctacggccatcatcaccggctcatgacatgtaagcatacatactttgattaattatttcgcctatatacatgcatacgtacgcatgaatacccatgatcgaatagctgatcaagttgctgttcgatccgcgcttgcaggctacgtgagggatgtggtggagacggaagcgatgtgggagcggccgacgagggaggtggaaacgctggagctgttcccactcaagtcgtatgacctcgaggtggacaaggtccggtatgtgaggggcggcggtggcgagcagtgcagggagatctcgttcttcgacgtcgctgccggccgggatccgccgctggagctcaggctttgcagcttcggcctctagatcgacccgtgcattgatgtgccgcacatatggcatgagatgcagcttgccgcgactgtacctggcctcttgtcgctgtgcctagtcctagttctagctgccccacatcaaaaggagtacgtacgagatgtcatgagatacggcatgtgttgtgggaaagtccgttgttgcatgcagtatctgggaggatcaggaaagagcacgcaaacgagatttccccattgcccttttccttggtctttccatcatgagatgtacttctacttttcttcttttctgctacatggatactaacatggtcactgctgatacttctatatgatatatccattaattaatattccatattcctttttttttccattcttgcatgtatgcatacctttgcatggcgattgctatatgtgcgcacgctctgaatttcccttcgcagatatcgactctgaagttttaaaactgttgtattatatataggggagatggattagtattataggctgtgattcatgcatgcttgcatacatagagttaggtgagaagcagtagtaggaacacatgatgttacagtactaaacgattcaaatgccgctctgaagccagctataatatttaaccgtgggcttgtcgtaacggagtgctcgttgtccctggcctttgtaaggaaagaattctgacttgctcgtgtgttgcatgtgtagactgatagtcaactgctacctgctttcctctaggaaaatgttggctgatcagctgctttggaagctagcttgttgttggacatgagtttcaaagtttgcagctaacttttcggtcatctgatccatcccttcttgtttgttgacttccaaacactgaataatggcacggatagcaggcccctctcttgtgaaatacttgtagtattgtacttgtagaaaccacatctgttttaaggaatccttgtattaattagaaacgtttcagtagaggactaccttcaactattataatttggttagtcgttagtttcagatgagtaaaaatgtaaaatatgtcgtgttaacgatgattgtgctaccgaccatatggtcaagaaagacgcacaaattgacaagacaataacacatgtagcgtttctattatctatctctctgcatttcttaaaaagaaaaaaattctatctggatcagtgtatacaaaagcggacgtcatgatcccgtattcataagataaacatgatattgtgcgagggaagacagtttttatatcctaaccgcatttgctcgacaaactaaattgtattttcggatatcaacgaagtagtactagtacgtcgtcaacgatggcgtttgcctccgaagacatgggcta

SEQ ID NO: 597 - DNA, 6074 bp, Oryza sativa
tcgacccattttaatgacctatattatcaattaacctaatggtctgtttggttgggggagtgtttaggaggcattgggaatttagagggatgaagctgttaactgttttatttggttggaagacatgtgaattttggtgggatgtggatggggaattgaggaatacctgggtactgggtggtaattgagaatgaattcctcctttactttgcctaaacaattctcaaccatctgttttcattaatgacctaatctccaactaaactccctatcaatttgtaccatgtgtactaaacaagatattgggattaaaaatcaaattcccatcttaatctcactatcaattccctcatctaaacttctaatccccttcctcaagttaccaaacaagctgtaaactcctttgttcgaggattttatcgtcttatctcatacttacgtagttgcgttttcatataatggatattatttattcatgttattagcaatggattattcttatgagtcgttattgttgtcccctgtattgctaaatcaatatcgtcccttgtatatatacataacatccaataattttaatccttttccgaaccaagtccgcaccgctccgcacccatttccgatattcgaaacacgctccgcatccgcacccgtttttttaaaaaatatccgttttcacccctattcccaaacgtgtgatgtgtgatggaaaaacctgatcgttttcagataacgtttgggtgagtgagagggaggtcgacgggtggcaagcaattttcgcacaagcgcgagaggaaaagaaaacaaaaatgctactaacacacacaaacacaaaaagaaaaaaaaactcaatcttttcccctccggactcccgtcccgtggtaccaatactacccctacacacacaacacacatccctcccccaacaatgctggacccactcctctccttgtccatctcctataaataccccccgcttccccccacctcatccgcctcaactcaagcaaaagcctccccctccaattcaatttcctctctctccatctctctcctccaatcgctgcctcgctcacgcacgcgcgctctacctacctgagggcgaggctggtgccgatggcaatggaggctgcggcggagaggagcgccggagcaggggcggcggcgacggcggcgccggagagcggtggcggtggtgcaggggagaggcggtcgcggttcaggcggatctgcgtgtactgcggcagcgccaaggggaggaaggccagctaccaggacgccgccgtcgagctcggcaaggaactggtcaggattcttcttcttcttcttcttcttcttcttcttcttcttcttcttcttttttgatttgattgattgtcctttctccctccctccctcccaaatccgtcataaaaatccaatcttttcattttctacttttctttctttcttccccctccgggcttcgccggccggctcgccggcggcggcggcggcgaccgactctccggctcgccgtggccgtttctctcttggtgcgcgtccctagtatcctaggcagctatagtagtaggttttctagatgagcaaacaaaaccaatcatgattgctggcgagcgcggtgacctcagttgcgtcccgaacggaacaacaatcttacaatttttgcatgcatcaaaacgccaccaccatctcctccctctctcccccaccttttggatttttcttgtcgactcaagagagtagagagaggttgattggtttcttgtttttttacatttccccttttgtttttggttcgtgttggtgcaggtcgagaggggcatagacctggtctacggcggtggctccatcggcctcatgggcctcgtctcccacgctgttcacgacggtggtcgccatgtcattgggtgagtgatccatttgtccatctctctctctctctatctttctctggttgcttgccaggtgagatgtgtgagaatgcatgcgtcgctgggatgataaaaacggcagcttttgatcgccagattgggggtaggaggagtagtaggtgctgagtccctgcccattttcgtctctctttcttgggtctcagtgtggggggggggggggcattttgaatgcatctggggccttttcgcctccgtttccgaaaggctactcgcctgcatgcttgaattgttgtttgtgcagcagcacactccaacttcacttggcctgctcctgcatagctcagctcctgcaatctgctgctgctgctgctgctgctagcttgctagtactagtgctcttctcttctttgctctcattattgtgcagtgtttatttggtccagctccctctctctctctatctatctgtattgctagtgtggtgtagctgtgctgcctgtgcaatagcctgggccttggctttgccagtctctttaccaagggagagaaagcaagcctgcttgttcttactacacctgtttgaccgcttttgtgctaaaaactgatgtgcttttctgtttcctctctctttgtgttcttggcagggtcatcccgaaatccttgatgcccagagaggtgagctgtctactcctggaagctagtaggagtagtactactgctattacacaagctcgatcgatagagatagatataatcttgattgctgtttttaatgtggccgtgctgctccattttgttcggggcgaaattgatgaatgctttcaattcctctccctgctggcttctgctgctgctgctgctgctgtgcgcagctgaaaaataggagttgcaataaagaaccaagttggcatgctgctagtgcttattggggggacatgatgcatttatgctcatcacatgaatctaatgcgcctatccaacagcattgcgtgctgctcttaaatggattttgagctatagtagctgtctaggatgtgccatcgcatttgccttgccttcggataatttactggggcttgcacgtagtagtaagtgcagtaactgggattatttactcttcttgtacgtatctctacttgtactagtactcattcggtagtacaatgtcttaaaaatgggactttcttgattgtcgtggtctttgaccactgcattacgtacgtagaacttgtatttcctgtgtattctaatgtcgatgatgatctcacgctgaacaactctgtgtgccgtagtttgcatccgaatgttgtcagccatgtatttctatggacttttgcattgctagtttcactaaaaaaggtttttaaatatttttctactaggatgatgagcttattaacatgattctgaaagagaaacaagtgtgatgtgtgccggatcctcaatatatactggtttttcgtttgcaggtcactggtgagcctgttggtgaagttagagcggtctctggcatgcacgagaggaaggctgaaatggcccggtttgctgatgcgttcattgcactgcctggtatgataatttagttgctactacgacgtcgtttgcagtgaattttttttgatgctgcatcctaaggatgcaaaatttgacactcttaatttgcgcgacaggcggctacgggactcttgaggagttgcttgaggtcatcacctgggcccaactaggaatccacaagaagccggtaagtaaccaactggttctgattcctctgtatatcttgtactagtaagattcacgaagaaaacgaatggcattattgcgcgataatttggaggccatgtggttgtgcgtgcatgatcccgaattcctttcttgtctctggttgcaattgaggcaaattaataatcgcaaagtcgttggatccattgagatcttgtgctaacatcttgcccttgattatggcttcgtggtgctcccatgtggttggctgaaggttttgccatctagaaaccgaattattgaccaatagtttaagccctctatgatctgcagatcttacagtacattaggcgatagcttggggatcacgagatctgcaccctctattgtttatgcttcctgttaatatgatatatgctttatacttttatgaatgttccaactcatctaatagaatgatgttcgcaggatcttgtacctgtcattttttttaattcaaaaaggaacttatcgtttgcatctatgctaaattaatgacccaatggatctgagcagtgcattaaacctcattcatcatgcctagcaatcagctttgctgatggcccccacaaaattcatatggtgtcgtgtaactgtattaactaggatagtgatccttcttggatccatgtttttagaggaatgctcgtcttttaatcgcgcgggatttcccttattgctctcaaatgcacattctctactcctagctctaacagctcctcaatatttaccaggttggccttctgaatgtcgacgggttttatgatccttttctatccttcattgacatggctgtcagcgaaggattcatagcggaggatgcgcggcgcattatcatctcggctccaactgccagggagctagttctgaagcttgaggtaaaaaaaactcacagcttgcactgttccattttcgacacattgccctacatggcaatttccttctcataacaccaagtttgtatgtacccttttggaaatttcaggagtatgttcccgagtacgaggtcggcttggtttgggacgatcagatgccgcacagcttcgcgcctgacctcgagaccaggatcacctcatcctgatctctcggctctggccctattcttacccaagcttctaaccggcggacgacgataccttcttctcgtgccgaagccgaatatgatcctggaggaagtttgtttttctcagccaggggaaagtaacatccactaaccgaaaagatttagccaaaggcggcccctagctcgggtctgccgatttgttgttttggcaaaatatgtcaattgggacagtatttagcattagcagtgcctcctcaatgctgttcttttggcccccctccctcctcactagctagaagaaggaatatatgtatatgcaagtaatattagtagcatctgtctatcttgatcttctccatatgcctgtgcaatctgtgtccccttgtttgatccgattctgcactgaaattgatcatgcacgtgtggatggatggattcggattcagaactgattcctggaaatgatttgatgattcgtctctaaaagaaaagaatctctgaaagtctgaaccatgtttgactaactgaagaaatgtgtctcatctattgctgatggaaaaggtggtccgggtccgggctttccggctggccggccggcgtcgccgtcggcagcgatgggacgtgccgtcgccggttgtcggcaagggacagggaggcagccggtggggctcgccggggcgacgaattgggtcaccggatttggacgtgccgttgctcctgccctttcggttggttaggttggttggtttgttggttggtttggttcctgcgtttgattccaattccaaaggggggaggttgacattggaattctggtgttccctggcctgaggaaatgcagggcaaagatggtgatgacttgtgatttatatataaagaaaaaggagatggtgatgactttgtgataggttttcacttgtgggaccttttatttttcttcttctgaaaatccaactttttggtctttggttgatgtttgattctagtactgaattgggagagtgttagagctaacatatactccctccgtttcaaaatgtttgacaccgttgactttttagcacatgtttgaccgttcgtcttatttaaaaacttttgtgaaatatataaaattatatgcatacataaaatatatttaacaatgaatcaaatgataatcaaatgatagtaaaagaattaataattacttaaattttttgaataagacgaacggtcaaacatgtgctaaaaagtcaacgtagtcaaatattttgaaatggagggagtataatatcttaactatagggtacggttggctttatttttttttctctcctaaatttaatataaatattttggagcatgcgtagagcgaactc

SEQ ID NO: 598 - DNA, 4323 bp, Oryza sativa
tttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctcagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacgggcgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcgtcggggtcggcgccgcgggactaccgcaaggggaactggacgctgcacgagacgctcatcctcatcaccgccaatcgtctggacgacgaccgccgcgccggcgttgggggcgcggcggctggtggcggcggcgccgggtcgccgccgacgccgaggtcggcggagcagcggtggaagtgggtggagaactactgctggaagaacggctgcctccgcagccagaaccagtgcaatgacaagtgggacaacctcctccgcgactacaagaaggtccgcgactacgagtcccgcgtcgccgccgccgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgt

SEQ ID NO: 599 - DNA, 6563 bp, Oryza sativa
aatggaaagcaagcgtgccatgagattttctatttgggccgtgtttagattaaaatttttttcttcaaacttccaactttttcgttacatcaaatgttaggacatatgcatggagttttaaatgtggacgaaaaaaatcaattgcatagtttgcatgtaaatcgcgagacgaatcctttgagcctaattacgccatgatttgacaatgtgatgctacagtaaacatttgctaatgacagattaattagacttaataaattcgtctcgtcttttacatgcggaatctgtaatttgttttgttattagtctatgtttgatacttcaaatatgtgttcgtatatttaaaaaaaatctagcacacgaactaaacacaaccttggatggccttctaagactgtctccaacaagtgacccataagagcacccaaacccaaaatgggtctccgatagtactatttcaacaaaagacccattttgcgtgctataagaggcataacctaaatctgagtatcctctctcctgaagacctatttgcagtaagtgttctcttttaggtcttattgttggagaagaccaaaaatatgtattgaactctttgactgtagcgctatgcaaacgtgaaatggttcttgtattatgggtttcattgttggagatagcctaagttgcttatccggttttattgcctgccatataagaaccccatcatccacatccgaagaggacatatttttgttgcaaaactttaaaattataataataatgtaactacaatataacataactagtacatgtaacgtttgttcaagcaattatactactaccatagtacgattgcgtataaagtttttcaattcaaaaatgttgctgccgttttctagatggtgaaaaacaaacttcacccatctccgacgaactacaaaaccctcagctcgatctccgcacagtcccgggccacgcccacaccaccctgatccgctcaccccttccaccacagggtccaggaggacctcgcccccctcctcctcctcgtcgcacgaccagaccagcagcaccaactccctttctgcctttcgctttcactgctcagtgctgctcctacacaccatttccccgtccgtccttcgccccccgcgtctcttttccgcacccatctgctgcagctgcgcacctttaatttgcagaaagaaagaaagaaagaaagaaaggaaagcaaggcccccccgagcgcaacagctagcccaacacacctcctccatcaccaccgagaaggcaacgcatatcaaaagcgcgggcgcaaagcaaagataacatcagatcaggtcggcgccccccgctcccggctgccgcaaagcccacccgatcgatcgatcgacgcctcgttctcctcctcctccgaggctactctctgcagggcgctcgcttacgtctgcctctgcgtacgtgcaccgcccagcgcgggcgccatgtcgtccgccgcggggggaggaggagggtacgggggcggaggcggcgagcatcagcatcagcagcagcagcaccacctgctgcttgggcaggcggcggggcagctgtaccacgtgccgcagcacagccggcgggagaagctgcggttcccgcccgaccacccggcggagtcgccgccgccgccgccgcccgggtcgtggccgctgcccccggcgttctactcctacgcgtcgtcctcgtcatcgtactcgccgcacagcccgacgctggcgcacgcgcagttggtggcgcatgggatgccgccgggggccgcgacgagcggaggggcccagatcccgagccagaacttcgcgctgtcgctgtcgtcggcgtcctcgaaccctccgcccacgccgaggaggcagtttggcggcggcggcggcggcggcggggccgccgggccgtacgggcccttcacgggctacgccgccgtgctcgggcggtccaggttcttgggccccgcgcagaagctgctcgaggagatctgcgacgtcggcggccgccccgcgcagcttgacaggggctccgacgagggtttgctcgacgtagacgccatggacgccgcgggaagcgtcgaccacgagatggacggcagcgatcgcgccgtcgcggacgcggtcacggtctccggcgccgagcagcagtggaggaagactaggctcatctcgcttatggaagacgtgagtaatcgcaagctatatttgttgtttcatatcgctgcttctgtttttccaaagaaaatactatactagactttacttttgctaccctgcattaattaacttcatgaataagaatctaataacgaacacctcatggtcacatcatggatgcacttactgttgttgcacagattatttcttgtgcttgtgatttgatgagggttgatctggattagtgacacatctcttctcttttggatatatttttgttctttaatatgtctcaaatcaatcaacagttcaaggctcttttaagctcccttctaaaactagcaggaggtgatccgcagtttatctataatcaaaaggtagcatacaattctgtgaaaatgcacgatagaagctaaattcctcaggatgctcttaattacatcataaagaaaaattcagtttgctagtacttgataagattccagcagtttgtcctctttcacgagataagattcgttgagtttgtcagcagaaagattctgattatatagttactagtacatactgaaaatatgttgagcaccagttttttttatttgcaatggtgtcaaatatgatcctcgttccttaattaggaagcttgcgttggtgtagtgtccacatgatcgtaaagtaggtctgcacaccttgatgtattattaaacaattaattgggttacatatcgtgatgtcctcttaacagttacaaaaaaccttgtaggtttgcaagcgatacaggcaatactaccagcaactccaagctgtagtatcgtcctttgagactgttgcgggtctgagcaatgctgctccttttgcttccatggctcttaggacaatgtcgaagcatttcaagtatttgaagggcattatactgaaccagctgcgcaatacgggcaagggtgctacaaaagatggtctcggcaaggaagacacaacaaactttgggcttatgggcggcggcgctggcctactaaggggaaacaatgtgaattcgtttagccaacctcacaacatatggcgcccgcaaagagggctaccagagcgtgctgtttcggttcttcgtgcatggctattcgaacacttcctgcacccgtaagtatatgatataaatcatcgcaacagaatttttctttttaggtatgctaatctggaagcacataactgaatatgcgtattgtgcactaattggaaaaataaaaggaaaaaggactttatggtatatatactgcatgttgcatttttacaccgacaagggtgtacatggattcctattagtggagaattatccatagaccctacaaatgggtaatatgaaggatattgcaaccaaaccgttggtgaaaattgttattttgctttattgaaatcttggattttttttcctcctttagatgcattaaaatgattgtggttttagtgcatggtttacacaagtcattgttgtgcacttacaggggagtcttggtctccatcacatataacctttattgttgtttcaattttagatgtgattgccgttgaacaatcattagttgcatgttatgtttattggatacctgtatgggtcccaattgatatttggtttgagatgatactacaacaacttgaaagtgcattttattttccaccaatttagggcaaccattgtgtgtagtttctatccacacataccatatcttcattcttcttggcaacttctattttggtacagtttttcctacagtaaattcctccttttgtggccctgacgaaccattaattcatgtttgtactacatcagatagaaaatatatatagtagtacacagtttcaatttatacacgtggtcttgaaaacttcaatgtttactaatgcctattggatggatagtttactcgaaaagtgagtaccatcacatactaacacttgataattgtgtgtaccttcattttcattgtggttattgccttggcataatggaggagaatttttgccataggacatccaactgacttgctgacttgcacatggcaacaacctttttgctgtaatttaattaatttgttccatgcaataattgttgaaaatattgttttttaatctagaattctttcctatcctactacacgtaatgtgcaatgagggttggcttgttgtttatgtttagtttcatttgttcttccatattttgtatgtggtgcttcatccttgtgcaattgtgtatgtaccggcattctaatgttggtgcttgatttcaggtatccaactgacagcgataagcagatgcttgctaaacagacaggattaactaggaaccaggtaaacaaccatttcaagtttttcttttcccaaatttatatcgatgtaactagctagtccgctacagttgtccactagcaatatctttgggtccataatgttactagcgttgtaaaacattttgatatctcaattcttgagcaggtatcgaactggtttatcaatgcaagggttaggctctggaagccaatggttgaagaaattcacaacctcgagatgaggcagctgcagaagaatccgtctcttgacaagaatcagctctccatgcagcacacccaacattcgtcggacagcagcgggaagccctgtgatccatcaaactcgctgcaagggcaaagtagcagcatgaccaggaatcacagcatctccgcctcccggcacatcgaggacggcctctcccagatgccccatgacatctccggtcaggtgagcttcgcatacaacgggctcgccgcgcatcacagcatcgcgatggcgcaccaccaccaacctgacctcattggcaccggtggtgccgcgaatgctggcggtgtctcactcacccttggccttcaccagaacaataaccgagcttacattgctgagccccttccggccgcgcttccgctcaatcttgcccatcgtttcggactggaggacgttagtgatgcctacgtgatgagctcatttggtggtcaggaccggcatttcaccaaggagatcggtggccatttgctccatgactttgttggttgaagagcagatatgattgtttcaccaaggagatcggtggtgattattgtaggatgcagatgtatgatctacctatattgtagttggaagtaggaggtgaagaaaagaggggcattggcacgcctgtcgtagatccacgaatgcttgtcgatatttgacattgtggggctatagagagcatatgactatacctttgaagacctgtttgtagtgttgttccctatttgttctgatccgcggttaagccgtgttaaccctgtactattcatctgacttgcaaatgtggttgctcccactctggcaaataaagggtgctcagttaatttgtcgccagcaagatgaaatgtttattggcagtatacctatacagctgaaggccttaagcatcagcgtgtaggtctaaaatatgactgggtagctaaatatttcatcttactccatggttagcctttccatgtgctcctattaaactaagcaagcaaatgacagagtactaagctgtgctagatcttgtatccttagatggagtagaaccctaaagtttagacaaaaccatgatttggccatctgccaacctttaactggctttgtcatcaccctaaccatatctgttagggctgagttgtgcctattgtaggttagcttttgccttgatcagtgcactaaacagctggccaattagccccatgaccatgatggagctagccaagcccttgttcttttttcacttctccccagcgtaaaaagcccatgttacctgggatcagttatccatggccctcggtgttgcagcatctgatttgatgtacactttggcaagcactgcaactagtactagtataactagcactgcaacagctggggggctccatgcacgttctttttcgcgtggagggaatccatgcacgtcaccgatcactactactactactacaactgctgctgctagtactcgtcctatacttctcccaaaagtgagcactgttcctgtttaaaaagggcactgttgttagctttcaattctaggctctggttcctgcatgggtagattattgcggtctgattctacatgccaactgaagaaatatgattccatgccttttccttcgtggataaagctggtagtaagagggtatgagctatcattaccactcatggaagctagcagaaactggagtttagctcagagctccactctcttcgtttgggagagagatgtgaaaaagaattaaagaaggctgcaagcgaagacactcttttctgtttggctactattaccactgatcattcctgaagtgaagctgagcccgctgtgaaatcaaaatcacgtgctaa

SEQ ID NO: 600 - DNA, 5901 bp, Oryza sativa
tgtcaagtaccgcggcagcgtagtgactaggagttcttgactgagagatcgagagggcatcccggtaacaagaaatgagagaaagatggaaagaggtcctagctatgcacgtactactacgtactctagtctagcaaagatgctgggactactgtggtaaatagtgccactcgtagttgttcaagttttgttcaaagttttaggtataacatttactacttttacaggtggaaataaacacctgatatatcaaatgctcttgtctaaaaacatatatccaacgttgaaaatgatgccaatctaggctgtgggaaaccaatttcttatatgggagaaattataatagtgatgtaggagcaagtaaaaggtagctacctttttttaaaaacatttttaaaattttaaatcagttctattttaagatagagtggataatagtaacggcttaatcattgtagctaccatatttatcaagatgatacagactaaagaaaccgattcgtaaatcatatctctgctactgtaaaaatggagtcgttttccacgtctttccctacacgtagtaagtctgttctgtttttgtacttcctccatcctataatgtaacaatctagtatgggataagaccttatcctaatacaatgtatctagacatgtcctaggttgggtctcagattactaaattttatgacagagatagtaactatttaaactcatgtttctcaattactctatctaattatatagacttgctcgttaaaacctgggtacgtggtaccgaggttgagctaccgtttatactactacgatggtgcatcccgaatagcaagagtacacgtgacagtccatccgggcggtgctgaggcggagcccgggcgcccacagacccaaagctaggacggacgaacggtaaagcgaagaagcaaagcaaaggccccgtccctccctggctgcagtgtagtgtagtgcagtgcagaccaagataagggcaagggcggcccctccccccctcgtgccgccaccaaaaggagaagacgcgagaagacaagcaatcgaatcgaatccaagcgcgaaaacccacggccgcccccctcccccgatcagggtcccccgttcggtcggctaaggtttgctactaaaaacatgtgtaattttttgcccctctgcttacggagaaacacgcgatgacgccgcgcttttataaccgcgcgtccaccacgattccccctttactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgcagtgccaagagtccaagacccaacaagggggaggacggaggaggcgaggcagaggcatctcaccgaagggggaagggcgacgccatgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatggtaagcatcctcgtctcctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctctaagaagagatgttttatggtgcttggtcttctaaattaaaaaagacatacgactgcgtttggtatcctataccaacaggaatcagatatgtgggccctatctgcaatgcaagaaaagaaaaatcgaactgttccttgcagaatcttcctaataatctcttaatttcatagtgttgggttacttgcacacatatctaacatctcgaagacaagtagacaaccaacagtcatctggacttgttggaattgaattcaaagcgtgattaaatagcaatcttccaaaaagaaaaaaaaatgaatcaatgtatatagacccaccacgtacggttgtgcttgatcatttgataaggtacggatctttaggttgctgttgcttgttgcgaaaacaaaaatgttatcatgagatttcccgaatagaaaagagaaaaagaggaataagcagatgcatgtatctcttttccgctcgcttttttatatccttggagatgctttaaaatgtgttgcctatgcacctccctgaaaaagaagagaagagaatagtgccggggcatagatgcaagtgggcgtaacattttgctagagaaaggggattccttgtttctaatttgggcattgcaataattgaatgtgtgtggggcgagatgagagagagtgaagtgaagtgcagtgcagtgcagggtagcatcagcagcaaccgggcatcaagcaaggcaagcatgtgtatgtatgcgactggttcacaaaagcgagctgggccagccactggctgggccatgaccatgagagccaacctctcgcggtaaaaaacaagttaatgtggtctcatccgatgccgtgtcgctctcctcggctctccgaatcagttcgccccctggagctaagctttaccttagctgcctctcaccggcaaccaaccaggcg

SEQ ID NO: 601 - DNA, 8083 bp, Oryza sativa
tttttttaattttctaaaatatcgttgagaaaaagagagcataaaaccgtggctgaacttgaagtatttgctaaactctgaaaatagagggttcctatttacctagcatggtgtttgtgcatatgggtatttcacgtaatcgcaaacaaaatttgcaactaacttggacaatatgatatatttttcagatattaataaatttaatgctaataaaaataatcaaagcttgaatttgaatatgaatagttcccgataaaattatttgaaaagttacctcgatcaactgagctacaattggtatacccatgccacacgaatgaagaaaaaacaatttataggaaatagttttatatatgcattattagctgttcaacagccaagactaaaaacaaattaaaataacaaatcataaaattaattaattgagttctgcattcatattttcggaagggacattcagatccccttggttgccctaataagcaaaagccaaaactaaaatttgaattttcaaactaaattttgaggttgattttaaaattttttcaacatgattctttttcagtattaacttttaaatcactaagacatatataaaattttacttataaactaatactcctatttattttctaatataccattttaacttattagtagagaatatggacaacccagagggcctcaaattttgactcgctggtaagacggcaaagcacagtagcacacaatgcgaagaccaacggaacgaatccaacctccaacgtccctgagcaccccagccgtcggatgcgtcagatccggccgtccatttggctcccctcgtaaaacgcgctcccacccggcaacccaacgacatccgggcccacccaccagtctcctctccgtttgggaacacgggattcccagtcccggccccaccccccctactcccattcccattcccgtcggatcccattcccacgggggagattactcctcgggcttgggattccgcctcctctctctctctctctctctctctcctcctcgcgacttgtcggcggcgacggcgacggcgacctcggcggcgcacggcctcgctccctccaccgccgcctccttccttcgccgccgcaccgcgcgtccccgctccatctccggtatgcggtgccctcccccctacctgcgctccttctcctgattcctcctaattcctcctctcccctccctcacactgctctctctcactcggctagggttttctcttctagatctccgcgggcggagctcccgggcgcggaggaggctgcgccgcgcgcgcggggaaggcgcacgaggtagggggtttctccttcctccatcttctcactgtggagtgtggattttctggcttgcttgcttgggcgcgcgtgcgtgcgtgcgtgccactggttgcttcgttgggggggggggggtttgcttgccgtgtcctcctggatgattgggcgcggtctttctgactgatttctccttcgcgtggatccgtgatttgttctgtgtcgcatggggggagtgaatcccaaagtcgagcgccactgcttgaagtttttgaaatgcaaacaggaagagcgaaggggtttttcgaaatcatgttcctggtaaaaaattgggggggtttttgaagtcatgttcccggtaaaaatttgggggttttggttctgtgggtaaatcgaaaaaaacaggataagagtgctagtactaaatctgaagtgtgcgtatgagctccatacacataactattgtgtccaaataagctccgtgccttcaccatatgatgcaacatattatgaagctttgttgcgttcatttaatctgtgtttttggggatctatttgaggtacattgatgtactaaactcttctgtaatttggtgatatcaaggttttgtcttcacatgactagatatggctcggcatctgattatgtgctttcttatgcaattgttgtcaactgttatcatctgaaatttgaaatttccaatgttagggcagtctagagttaagtttgaactgcattctttgcattccctgtgaacttattcctcacattcacttattttagctttgcagtgctattttcattctgaaggaaattgcacggttaatctgaatagattggtcagtggttgtctgcattctacatatgatccagatggtttggagatattcagtgtaatcaacaatgcagacacggaaaaagggtgctacgaaaaatgcacttggggatcctgccagtactaaaactagtaggcaacccagaagagcagctcaggcggcagcttctgaaaagaaagtgaatgatcttattacttcttctgccaagaagaagaagtctggtaaagttctatttttcaagtgtacatgatgtgtatgttaatgcaaaatcaatttcttctaaaccaaattattggtacaggcatgcttaatggttgtttgactttcatttattcaaataaactgacaaaacttactcatatgatgtataggataatttatagatgcttttctttaactactaagatgtattttcatggttcgaaacttgcaataacatattgtgaaatgatacatgcttctagaataaacaaatacattttgtccttgtttaagttgttgactattaatctattcctacacgtaaattgtttgtttaatttactatattggtgtagtgcccatgtgctggaacagttttgaaataaatttatgtcattttctaatcttgaaattccaaaacaaatatttaaatataaacgaaacaaaatctaccagccagctattgacatatatacatgtaaacatgatatatttttctgtaaaaaatatcctgcaaataatgcacacatgtctacatggatccatccacagaagataagcataaagcacaagatcactgtcaccaactctttcttttaaggagtagattttcaatttgagcttaattcttccacctcttatcgcgaaaagaaccaaacaacattctttatgtgcataaccgtttcttatttactatttaatgctgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcagttaagacttgtgttgggagcgatcaccatacactaaatgcacaatcagctttctgtaacacaccgcttgaagaggatgaattcagtgaactcggaaacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggtaatatatacttcctgtctgagcacttgtgttcactactacactaaggagccttctgttccatttctgtgattaactccaactactttcaagcaggagtctatttatgtaataatagttattagtgaatggatgaagttagctacatctgtttactgttattttaacttcatcattgtctcctgcatctatgaattggtgttaatggtacaaatttgaattcaaataactctagtactctacctaaaggctggaaactggtaaacaggagccactgatggactttcaaatgcatcatgattttattattaccaatttaccataccttcattggcatgaaatattaatagtcaacatacatttgatgttggtgtttgatttttgcctgctgcgtggcagtaatccttggacatagcagttggtaccgcccccacaaacaaaccttgatttagctttatcctagttttatcctattcttttttgttcatttttgtttgatctatgtgtgctcttttataaccagctagacatattttcgaaattgtcttttcctttctcctttgatgttcattttgtgtcactccaaacaatgcagaaacacttgtgcattcaactcttgaaccatgcgaggatgctgacttcgcatttccagtttattttaacttcagagaacacacaatatatgtccgatgccgtccctatctcaaagagttcttggagagggttgccaatttgtttgagacaatcattttcactgcaagtcaaagcatttatgcagaacagcttctcaatgttcttgatcctaaaagaaagttgttccgtcatcgtgtttaccgtgattcctgtgtttatgtggagggaaactacttaaaggatctaacagttcttggacgtgacttaactcgtataatgattgttgacaactctccacaggtatgcacttagctatctcaatttttgtgcgacaacatctgttcaatacttcaatctatgctaactttatcctggttttagtggtttgtattcacattgaaatgcctatttgtttcttggtggatataaattgtgttatagtggtggacgactacaaagataggtgtgcatcagttaccaggggttgtgaacttgtgattgaagctgtcaactttgctaggtgtctccagtaacttgctaattgttgtgacatatagtttccttactactttcagggtctcttaaagattatccgaaagttcactacctccagcaaaaaaaaaaatgttcttgtttacttttcaacctcaagagttaaccttggctacaatttaatatcatatattttgctcacggcattttcataatgaaactaacattttttagacaataaattggtcgaaattggtactatatttttgcaactagagttagttttgtagtaatataaattacaaagcaaaatcttgctattggctttcactggtagttcaaactctaattaagtaattatatttagcagtagcaggtaccttttagttctgaaattatgcattttattcagttccatatttgtagatccccatcaactattattgttatggttatggggacatgaataatgtactgatgtcctgcttacaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtgatccacttttgctttggaatatgtctctgtgtaggtggtaatttcgataaatgcagaagggctggtatggtgattctgtagagtttaggctgtagtgtatcaggatcccccctgtactgcaaatcttgtatgtctttagaaccgccatgtacaatgttctccagatgtaagttcgtactggaagaatttggggatcccatgtatggctaatcaaggttactaggttcatggtggtgaactttccagcaatgcagataaaattgttcaaaaaatgtgttctattgtgattgtaaatgccgtggactgcatgctcctaacatctggacgattggtcaggtagctgaaatagtccgttttttactttgacctatccttagtttaatttatgatttcctgtcatggttgttttgccaacttatgtatcttctgccctaacaaaatggaaaaacgggtgcgaaatctgatactactttcatgcctgtctccagaaattattacctatccagttgtggtgacggtctcattagtcatttcccaacaagatgtgtttacttaacgcaatggtactgtggaggaatgctctggttgtaattgtataaatttcacgcaactctttgagttgccatcatgtgtgccctctgttattcagttgtgaagatgctgtgagcatctgagatgtcgtattgcttttgttgttctttcatatgatgggatgagacttactttgcatcgcttgtttgatttgatatccgaatgctgcacgagtcctttttgaagcagaccgattcgtgtggtttttcattttaacagatgtagtccaatttctcagtttggtgtcaatataagcattacagcaactctacaatgtttgatttaattacactagaggaaaagaggagaaaaatcttgcaaacagtaaattactgatgctcctcatctgatggtcaacattgatgattatattttgccatgatttagagtggtacgagttacaagaaataatctcaattgcaaattcctatacacttctgtacatgtcatgtattcctcctgtacatgttcttctgaatatatacacctgtctctctagctccacgatgtaaaatactcctacttctctacatcttccaaggtccaaggatgttcatgtttcagatcaattcctgaaaccacatggatgttcatgtttcatgtcagttcctgaaaccacatggctgtggactgacactcccggatttcttccattctgcgttctggcaggtgctcttggcattactgctacctcccttgacagtgagattgacattctccaaggttatgccatggcaaggtacactgctgctgcaatgcagcatgatggcctcctct

SEQ ID NO: 602 - DNA, 7685 bp, Oryza sativa
atgaggggcagcagcatgttggaataaacaagaaccggatgagtgttaatgagcataagattctactcctatactactgatgggctatagagtacaggtagagtagcagagtgaagaacaacatcatcttttcgtttttcttatactaatcagacaaaatttaaatttttaaccttaaatttgagttaattttagagttttttttatcgaaatttattttttagtatttgcttttagatcgttaaaaacatatatatatatatatatatatatattattcacaaattatttttcgtttacaattataccgtttgtagggccagaagagagagagagaaaggaggggtgacagtgtgacagagattgctggataggctgggagtagcgacgagacaagaaaggacgagacaaaataaaaggtgagcatgtgactcgccagtgatccccagcatgcaaagcttttgcccatccatcctcctctcctctcaagattaaaacttttttaaaatttttttactaatcttttatcctccccatcattctgttttatattgctagattcaccgcgccgagatgaacatgcgccttgccattagcgcccctcctcgcaccaaaatgacaacccgcaaaccggccccaatcctgaacattagtatttgtttttttataatcttcacagaatactactctactgtattttactacagtgttcaagatgattacatggttgttagtggtaatctaatcttggagcgagaagagcagcattcttgtcatcagtatggttggcgtttgccgtcttccgtaagcaaaagctttgcaaaaacaaaaacaaaatcttaacaatagtgttaagaaacaaacaatgcgctaactaacctaagctgctaaaatctaatcttggtgagtggtaaagaggaaaaatttggagagatgacgatggtgatgatggggtcgctcgcgcggtgatggacggatggcagcgtaggcacgcgcatccgtgtcgggggagagcgaaaaaaagttgttttcttttctttcttttggcggttttgcagcggcgcggcgtgttgcggaggggaggatcgattgataggggtcggagcggctgcccaggccggtgctccctgccgtttctttccctttccctctctctctctacttctctctgcctctgcttgctctgctctgtatctgtgaccatctcgcttcgtcatctcgtcgtcgtttgtgttcttggattgggttgggttgggttggtgaggtggggagatggtttggtgaggagttgtgtgttgctgcagctgcagctgctctgctggtgtgggggtggaattgtgttgggtttctttggttgaggagagaggagggcgaatctgtgggatgaggatgcggtggtgggcggcgccgctcgccgccgtgctcgccgtgatcctgctgccgtcgtccaccgccacgctctctcccgccggcatcaactacgaaggtaacgcttcttgccttctctatctaagaatcccaagaaaaatccaacgcttttcgatgctgccgctgctctcattttataatgtctgttcaatctgtttgttgcctttatttcaaaaagaagaagtctgttctttttggattaaagaggatccagtgaaattttgataataaagatttggttctttttggggggcaatctcgattcacaaagcaagcgactctctcatgcaaagcgacaatcctcctggctttgaacaaagcgcaaatgctgtttctgtggctaccaagcttgagctgtttgttgctaagatttggtggagagctgagctttgtttccttcgcagtggtggcgctgatggccatcaagacggagctgcaagacccctacaacgtgcttgacaactgggacatcaactccgtcgatccctgcagctggaggatggtcacctgctccgccgacggctacgtctccgcgctgtccgttcagccgcccatttgttcattcctccgcagccgccttcggcgagcaccagccatggctgctaatcttgttgtatcatctttgcttgcagaggtctgcccagccaaagcttgtcaggcaaattatcccccggaattgggaacctcaccaggctgcaatctgtgtaagctgtcactgatgactgatccggccttgtttgtgctgcctatggcatttcaagaagtattacaagtgtttcaacctccttgttctacaggctattacagaacaatgcaatatctggcactattcctgccagcataggcaggttggggatgctgcagacgcttgacatgtcagacaatcagattactgggagtatcccgagttcaattggcgatctcaagaacctcaactatctgtacgatttctttctttggttcttgagtcctcactcactgcctgctgcaatatattttgagtcattttccgttcctcttgttgctacaggaagttgaacaacaacagcttatctggagttctacctgattcattagccgccatcaatggccttgctctagtgtatgtctcttaatccttttttttttaaaaaaaatcatttgatcattttgttattcttgtctttatcattcgttggtatgcttaatagttaccttgaattggtcttgtgttgcagagatctttcattcaataatttgagcggtccattgccaaagatttcttcaagaactttcaagtaagtaaattcatcttatcccctacccctttgaacagttgaattctcacttaatgctctatttgcatgctgtaggctactgtcttatccttgcatttttggtattatacttatttgacagcattgtgggaaatccaatgatctgtggtgtcaagtctggagataattgctcttctgtatcgatggatccactttcataccctccagatgatcttaagagtgagattttgttcatcattgagctcttttgtattgttttatctatttgtgcaactcatatttgtttcctcttcctcagctcagccacaacaaggcatcgcaagaagccaccgtatagctattatctgtggagtcactgttggttcggtagcatttgcaactatcatagtcagtatgcttctttggtggcggcataggcgcaatcagcagatcttttttgatgtaaatggtaatgctcttttcatttctgcacgcttttgttcccgtagtaactctatctagatttcgatagtaattgatgtcttcactacaacagtggctgaatgttctgcattacttgagttttgaggcgtatttttcacagcgttcaatttgatagcaaatttacatgggacatccatgtggttgaacatgttgtagaaatgttagtggttcaataacctattgatctttgcacaagctgaatgattacctctactgaaactgtataatattctaaaaaaggaaggaccctttctgctgcaaaatttgagcattgcattaatcttccgtgatgtactatgtgatatctgtagcaagttttaaattctgttgattagtggaccataacaaagaggcacctgtgatcatatgggtttttgctgacaagattccatgctcccaacagaactgaatttgtatgaacagctcgtttcataaagctgcacactagtgtccctaacatcatgcaagctgcccaagacaacattactagatgattatgaagtacatgacttaaatgagtccttgacctgggccatgccctaatatgttcagtttcttacttagtcatgaagggaaccttgattattctcttctgtacaaagacgccatatgtcttgaatttactagctgaaagattcctagtggagttgcctctgggattttacacatgttaatgcatgggtgcttgtcttcttttttactttaacatcatacacaaataaatggccaagcttttttagtggacaagtattaaatttactcttgggcccaactgtaaagagagatagctttattcccctatattaggcgtgtttgtacttttaggaaaacctttggtgcagttcagaaccatgatgtccccgttaccttcggtatgctgatttgccatggatagagcatgacatgtcttcttttgcacctatgggcttaatctgatcttttaacatgttctatgtttctacgcatgctcttccagattacatattttgttgtttcggtttccagtacagtaatacttgataccttatctgcagatcaatatgacccagaagtatgtttgggtcatcttaagcgttatgcctttaaggagcttcgagcagctaccaataatttcaactcaaagaatattttaggtgaaggcgggtatggaatagtatacaaaggttttctacgtgatggtgcaattgttgctgtcaaaagattgaaggactataatgctgttggtggggaggttcagttccaaactgaagttgaagtcataagcttggctgttcatcggaatctccttagactcattggattctgcaccacagagaacgaaagattacttgtttatccttatatgccaaatggaagtgttgcttctcagttgcggggtaagtccatgcttgtaaatcttatgtgtatacatatatgtatttgtggcgctaacttgtcctaagtctcaaatccttaaaaaaaaagttgaagaaaaagatagacgagtttatcacaagggagaaacatgattatgaacttcaaccataattttttagatgtaaaattctcgtgcgcatctgtcataactgtcgagcaaatttgccactaagtatgctacttacgctggtattagttcgttttgttaattaacttaaaaccctatccctgctcctctgattgatttaggtgtttatatgttcatccaatacattgcactggtaccatatatggaatgtgaactgatcctaagcccatccaattggcatgtctagttctactgattttattgctatactactattcaataaaagcggatgtaatggaacattatctgagtagcttgcaagtaaattaaccttctctgttttatgctacatggcatctaaacattatctatctttttcagaacttgtaaatggcaagccagctctagattggtcaaggagaaagaggatagcactaggcacagcacgagggttgctttatttgcatgaacagtgtgatccaaaaataattcaccgtgatgtaaaagcctccaatgtgcttcttgatgaatacttcgaagcaattgtgggagatttcggattggcgaaacttttggatcatagggagtctcatgttaccactgcagtacgtgggacagtagggcacatagctccagagtatttgtcaactgggcagtcatcggagaagacggatgtttttgggtttggagttttgttggttgagttgatcactggtcagaaggcattggactttggaaggctagcgaatcagaaaggaggagtgcttgattgggtatgttttttgtgttctctatatgcttactcactttttctttggaaacagagaaattttttccttaaattacttttgaattttttccccatccttggaggtattgaaagacaaatatcttctaatgttgatttctggtacaccaaataccttgttcctcgtaatatctcattattaacagtaccagatacatctctccttcaatgcctcccaagggccataaatatgctttatatgtccactcagtttgttgtgatatgtccttttgtttcgtccgtcatagagcttttttttgacaagtctgtatgtcattctcaggatcttttttgccttttttttgttgagtacatgcattgataagatttgatgtgcaagatagtggagcttcttttccctagcagaacagataagctgaaaaaatgttcttgagaaactagatgcatatctatctctatttatctagtgtggacatccaccataatttagcatattcttttcaaaccagttgagatctaaaaggactgataaagggtataatttgttcttaaaggcggttatcatgagcagcatttctgataacttgagtttttgttccaggtaaagaagcttcatcaggaaaagcagctgagcatgatggtggataaagacctgggtagcaactatgacagggtcgagctcgaggaaatggttcaggtggccttgctgtgcacacaatactacccatctcatcgtcccagaatgtcggaggtgatcagaatgctggaaggggacggtctcgcggagaaatgggaggcatcacagaacgtcgacacaccgaaatccgtttcgtcagagcttctacccccaaaattcatggattttgcggcagacgaatcctcccttggcttggaagccatggagctctctggaccgaggtgatcggtgtcgatattcgttctttgcgacaaatgtgtttgatttgattagagctcttgagccgcccaactaagggggatgagaattttccaaattgagtagagccatattgttgtctatagccgaggtggtattcatttgtacatacagtaagcattatgtgaggtgagcccatccttgttgcacatctataggtggcaaagagagatgagattgatgagcaaatatagaaaaaaaaagaagttttctattggagagtctctgctccatttttcatgcataacatgattagttttgcctgtctattggcacatgtatttgtttgtcattttgccaattaccagaataccaactgcttgttaggtagtaagatacatagaaaaatagtgaggtgatgcatcagggacagggtttactaaaccccgcatgattaccatggtaaccatctcagttttttttaaaacctcgcggttttcacggtaactgcgtgaccaccgggtagtggtaaatcctaccaaaacggtatgaaaacccaaatgggggcaatataggaaatgaaggtgggagcaactcctgccttgctacaattgctcctgtcaaaaaattctttgaagcggtgtactgtaccaaaccattgtcctgcatatactcctaccttattattgccagagctcctgtccaagactagtttgaaaataattaatgatgcagtatcctgtactgtaacagtctgtacaagctgcatggctgtatctagatccaaagttcggtccttttccatcacatcaacctgtcatacacacacaacttttcagtcacatcatctccaatttcaaccaaaatccaaattttgcgctgaactaatcacagcctaagagtgtattactggtgcttaagctagtactgacgctgtcacccgattgcatagtaactccaggaccagatgtcacccaagtgtcagcatttgttgctgctattggaacagtagttgctgcacaggaacaactgctgctgctacactgaaaagctcttgccggaaaagatctaagggaaggaaaataaaaaaaaggtgagagataaagattgagatggaatcatgggattcgatcggtcaagtgcgatggaactgatcgatcttgggttgattctcagttggtactgatcgatctttgctccctttgctaccaccacttgatgcagcctacgagtactaccattactactactagtagtggtcttgtactacacctcgcagcaagcgtcacgtcaccaactgtttgctccaactgtattctacagtgtcac

SEQ ID NO: 603 - DNA, 5220 bp, Oryza sativa
actaccgatgctacaatgtttaaatcgtggagtagtaatatcttttattttttccgtgatggctacaggattgaatttactctctggaaaatacacatgaaattccctcacttccaagttccaacttgtcctcagcaagctaccgcttgagctttcattgacttctatagctgcaagttattgccagtggaggagttgaaagatatggtggcgattggtccggatccgactaccgagttgccgtttcaggaatattcacatctacggtgcaggctagcactagcagattcctttctggatctgattttcgggacatttgtggtagttttgatggctcctttttcagattccgttaccgataacactcgagatttggcagaaacaaaaggcaaggacagggagctggcacgtcactgaccgccgtcccctatacggactgacgagcttctgtacgtacctcgaatccaataaaaacgggaattgattttgttcaccgagactttcagaggcgtaattcgattcaaagcgcccaatttacactccacgaagtcttaaagtctagcgccggaagcaatgtctctcatcactaaaaacaactgatcttaccagacaattcatatgcaaactccccccccccaccccctgagttagtcaaaaaaaaaaacaactgatctgaaattctgaatagtttgagccacagcgacaggaatgcatgacacagtcttgtaatttttgttcgtatttcctaacatggcgtggactattagtacgtcggtatggaccatgcatagtgtacgcaaataccgtatagtacttttcaatagtagtacaccacgcgaatcagccggcaaaagccctgtccgacccgggcgggggcgtatctatgtacgagccccatgaacaacagctcgatccatccacgcgcgcgtgacggctcggcggctgtcaccaacccggtcgccgggcggtctcgctcgatctgggttgggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgctcaagggcatgtacggggagttctccggcagcctcatggtgcagatcgtcgtgctgcagtgcatcatctggtacacgctcatgctcttcatgttcgagtaccgcggcgcccggatgctcatcaccgagcagttcccggacaccgccgccaacatcgcctccatcgtcgtcgacccggacgtcgtgtcgctggacggcaggagggacgccatcgagacggagacggaggtgaaggaggacggcaggatacacgtcaccgtgcgccgctccaacgcgtctcgctcggacatctactcccgccgctccatgggcttctccagcaccacgccgcggccgagcaacctcaccaacgccgagatctactcgctgcagtcgtcgcggaacccgacgccgaggggttcaagcttcaaccacaccgacttctactccatggtgggccgcagctccaacttcggcgcggccgacgcgttcggcgtccgcaccggcgccacgccgcgcccgtccaactacgaggacgacgcgtccaagcccaagtacccgctcccggcgtcgaatgcggcgcccatggcgggccactacccggcgccgaacccggccgtgtcgtcggcgcccaagggcgccaagaaggcggccacgaacgggcaggccaagggcgaggacctccacatgttcgtctggagctccagcgcgtcgcccgtgtccgacgtcttcggcggcggcgcgccagactacaacgacgccgcggcagtcaagtccccccgcaaaagtagcaatcttttatcttcaccgtgtactatttgcctgatttggggagcatttcttgggctaatttgtactgactcgtatatttcttttacgtcagtggatggagcgaaggacagggaggactacgtggagcgggacgatttcagcttcgggaacaggggcgtcatggacagggacgcggaggcaggggacgagaaggcggcggcggcggcgggcgccgaccccagcaaggccatggcggcgccgacggcgatgccgccgacgagcgtgatgacccgcctcatcctgatcatggtgtggcgcaagctcatccgcaacccgaacacctactccagcctcatcggcctcatctggtccctcgtctgcttcaggtgcgtacaccccgggcttctcgcaaacccaaacccatctgctcgtacgtgctgtggtggtgcggtgtggtggtctggttctgacaaggcgttcgtctcgttttggcgttgcaggtggaacttcgagatgccggccatcgtcctgaaatccatctcgatcctgtcggacgcggggctcggcatggccatgttcagtctcggtcggtattctcttgtttccatgctaacctcacctcacccccggcagtgtcacgagctgttcccctgagtttgcgatctcgccatgcatgcaggtctgttcatggcgctgcagccgcacatcatcgcgtgcgggaacaaggtggcgacgtacgccatggcggtgcggttcctggccgggccggccgtgatggcggcggcgtccttcgccgtcggactccgtggcacgctcctgcacgtcgccattgtccaggtaaaccggaacggaaaagaacagccatacgcacacactgtcacacgcacagtcacacaccgaaaataaaggtctccgtgtgggtgggcatgcaacctaccgcgcgcagccagccagcgtcgttcttttctcccagcccctcgtgctcgttcgcgtctgctttctctcctgccttttgctctccacggccgcggcactttctacgtttggccagcacgaaagccttttgctttggctaacctttttctctctgttgttcttttgtttggtccaaaccgaacgaacgaacaggcagctctgccccagggcattgtccccttcgtcttcgccaaggagtacagcgtgcaccctagcattctcagcacagcgtaagtactagattctctctcagtttgcactctgtcctgaatcgacgggccactgacattttttgcctttgctcctgctcgcagtgtcatctttggcatgctcatcgccttgcctatcaccctcgtctactacatcttgcttgggctgtaatcgagttgcatgcatgtaaattcctgctcctgacaaccagccatgttaagaagaggggagaagaagacagagctggtacactgtttgcaaagtcaggactctttgatttttcttttcttttctgtatttcttgaagtagaatttgggaggagggggattggaagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtgggagttttggttggctgcgctgcgctgacccttgtaaaacggacgccgattctgacaagagatcgaccttgttttgttcgtgtcgtggtattgctgactactactttggaatgattaatctcctactactaattactccagtctttttgctgtaaattcactcttctttttacctatacgtcaaattggaactttgtgcacaactaaatggagagcacactgctgtctaatctactgctccaaaaatcgtttagcacagcgaccagaagagccgctttcgctttcgcctggccgagtcgaagccacagaaacgcatgggtgacgaggcctcactccctatcagcggttgctgatttgataagacatgtcggccgttagagctgtgtgccgccaattagtactagtacctgatgaggtcgcttacgtggagatggcaccaataagctagtgactctagctgtaatcatggagacggacgaatgcacagtaccgtagattcatggagatcagctgagctagttctaaccaagcatgaaactagatgatttcgcatgaaatggttcataatcagattaaggttcattctatacacatattagaggcaacaaatggacataaacggaattgttgacttgtatatgtagttcttcaagtagaaaatgtgtctgtccgcgctgtactattaactgactgattggattagttcattcgttctgaacatctgatggagaaaatattgcgaaggggttggtggccctacgtttggtgcagggcattatgcgctaatgtgggatttgatgtggaccggtggagcatatccagcgacaagcagggccctctaggttgctgtcgcatttaagtgccttgttggggtccctgtgctccccctgctcattttccgccactgttctgaatctgccgcctaacctcttggttgaatggttgttagacctgttcagttcgttccacggctagtgccttcatctcccctcttctccgggaaaaaagaaaaggcttgcatttacgtacggaaaaggattatctaatttaactattgtgcagttgagccactgatatatggaccttactaaagtggaacccacgtatcagtgactcaactatatgtgtagtt

SEQ ID NO: 604 - DNA, 5934 bp, Oryza sativa
ttagctacatatataggttaactggttaagtcaatgtcatgcccccttagttaggcaggtagaggcttgaggttactatggaaatcgaatcaattaacatagcttcacctatatgaatggagcccaactcacctatatgaatggagcccaactcgaattaatacctatagcttcagctctactacactgctaacctctccggtcataagtgcatgtcgtttgatttcgtttcagtctttggcatttggctgaaaagttttattaagcttatgattatgaaaatatttttaagataaatctatgcatatcattttctatgttttcaaactaaatattttattaaaatttatgaatagtgccaaatgagtgtaacttaacctttttttttatttcatgtagtttcaaatcctagacttgatacgaacgcttgcatttacaattttctaaatgtgtttatggaatagggtgtgcgtgtatatataaggggtgagtgtgcgcgtgttatgaacgtctatatttttactgtaattttaaagggtaaattggaaccatgccattataattttgcaaagtttgagatatgccatcggtatctcaatgacatgtaggacccacccgagtcaatgatatgtggatcaggatgacatatctcaaattttacaaaattataatggcatagttccaattttcctaattttttttaaaagagaaaagtatagatgttcatacaccagaagtttaacctgaggaaaaaaaacatgaatatcttcctttttagggttatggccgttgtctttcaatttgaaccagttcagtgtttaccatttttattaccaaaggtccagtatttaccacttaattaacactgctagtggtgattaactacaactaattgtcaatctaacactcccattaactaactgcgtcatcgccaccgtcgtcatggcatcttctccagctatataaccatccttgtgcctctcttgccacacttaattagctcgttctcttgtgtcaagaaaaaaaaagaaagaaaaagctcgccgccgccgccaccgtcgccggcgcgatgatcaccggacgcgacatctacgacgtgctggcggcgatcgtgccgctgtacgtggcgatgttcctggcgtacgggtcggtgcggtggtgggggatattcacgccggaccagtgctccggcatcaaccgcttcgtcgccgtcttcgccgtgccgctcctctccttccacttcatctccaccaacgacccctactccatgaactaccgcttcctcgccgccgactcgctccagaagctcgtcatcctcgccgcgctcgccgtctggcacaacctgctctcccgctaccgccgcaatggcggcgccgccgcgtcgctcgactggaccatcaccctcttctcgctgtccacgctgcccaacacgctggtcatgggcatcccgctgctccgcgccatgtacggcgacttctccggctcgctcatggtgcagatcgtcgtgctccagagcgtcatctggtacaccctcatgctcttcctcttcgagtaccgcggcgccaaggcgctcatctccgagcagttcccgccggacgtcggcgccagcatcgcctcgttccgcgtcgactccgacgtcgtctcgctcaacgggagggaggcgctgcaggcggacgccgaggtggggcgcgacggccgcgtccacgtcgtcatccgccgctccgcctcggcctccaccacgggcggcggcggcggcgcggcgcgctccggcgtgtcccgggcgtacggcgcgtccaacgccatgacgccgcgcgcctccaacctcaccggcgtggagatctactcgctgcagacgtcgcgcgagcccacgccgcgggcgtccagcttcaaccaggccgacttctacgccatgttctccggcagcaagatggccagccagatggctagccccatggcgcagcacggcggcgccggcggccgcgcccagggcctcgacgagcaggtcaccaacaagttcgcctccggcaaggccgccgacccgccgtcgtatcccgccccgaaccccggcatgatgccggcgccaaggtaaaatgaaactgattattaacacctcaaaatttctgttcatcgatcgtgttttgatcgagttggatttttgattttgtcgccattgctacaggaagaaggagctcgggggctcaaactccaactccaacaaggagctacacatgttcgtgtggagctctagcgcgtcgccggtgtcggaggccaacctccgcaacgccgtcaaccacgccgcctccaccgacttcgcctccgcgccgccgccggcagccgttcccgtcggcggcgccactcccaaaggtactctctcatccatccattgacgcacacgacgacgatcacaccacatgtgttcaaggcttcgtctaatggtgcgtgcatgccacaggggtgagtggcagtgtcacgccggcggcgaagaacggcggcggcgagttggagatcgaggacgggctgaagagcccggcggcggggctggcggcgaagttcccggtgtcggggtcgccgtacgtggcgccgaggaagaagggcggcggcgccgacgtgcccgggctggcggaggcggcgcacccgatgccgccgacgagcgtgatgacgcggctcatcctcatcatggtgtggcgcaagctcatcagaaaccccaacacctactccagcctcatcggcctcgtctggtccctcgtctccttcaggtattggattctcaccgatgttttcggtactcaagctgacgttctcgcttccacagttccacttcatcgacgcccgctttcccggtcgcttccctctaagatggaacactcttctgccaatacattttgacatcccacagctatgacagatcgcttatcccggttcatcttcagggcaagggcgctttttttcaagttataccgaattatcaaaacagattatttactctccatttcaaaaaagtattttataaaaaaaaatattcttctactacattacttagattacttgttttaagctagttgttaagtttttttttaaattgtttaatttatttgtataatgaaatcgataatctgcatagtaatctaaaccaaataagtaatatacacttgagttcacgatctgatcaatttatgttgttcgaagctacaaaaaggatatatttttgctatgctattcgttgctagattgcttgaaattttaatctaggaagaggcaagatcgatgagaacttacttaacttcacaactggattagtgttttctgaacgcatgtgagagcacatgataattacgttggtctcggatctggtccagcacatgcaaagaacatacacacgtatgcagatgcaggtgcaggtgcaggtcttatgtgagccctggagtttagcagcagagaccaaatctaccgaatcagctgcgattgccgtgtttgtccccatccaagacagacacggcgaattcggctcaactagctagatgatccatcatgtgtacaagaagaagagcaaaaaatgtacaatgatatggatgcatcattgattcattgtactactatcttaccattagatggcacatctagagggagggttgcaagaacagggcatttttagtggggaggagcacatgcctgcaagcatctaaaattgcatacatgcatgatacatctagcattgattctcttgtcatacaatttttttttacattgtgaaaatatatgcttaattgcttattgactttgtgaatttggatcaggtggaatatccaaatgccttcaataataaagggctcaatatcaatattgtcagatgcagggctaggaatggctatgttcagcttaggtacagagttgacctttttgatacatatctatagccataactagtgagttttttctttgctttgaccaagaaattctgacaatagtatatgtaacccaggcttgttcatggctctgcaaccaaagatcatttcttgtggcaagaccgttgcgacatttgcaatggcagtgaggttcttgactggtccagctgttattgcagctacttccattgccattgggctcaggggagtactcttgcatgttgccattgttcaggtaagcagtagattctttatttcttgcaatcatcttaaaagaaaaaaaatattaaattttgtaattatggtgaattggaatgtattgtggtgatcttatagattaattgattgtcaaacaggcagcacttccacaaggcattgtcccgtttgtgtttgccaaggagtacaattgccatcctcaaatacttagcacagcgtaagaaatgcatgcttaaactttctatttgttcgtccatacggttgctgaagtatatagcctaaaatatataaatgtgaaattttcagggttatttttgggatgctcatcgcgcttccgatcacgatactctactatgtgcttcttgggatatagtgttcttgaagaaggcaaaaaagaaagagtagggaaaaaaataggattctaggtttctagaggaaaatgcaaaagaaatatgatatgggctttcttgaagacctgaagaactaccagagctgaagaatagggaaatgagatcaagtaggatcctagctagagagaaatgcaaaggaaagacaccccttgattacaattttttaattttttctgcaactgttttggcatcaaagtaaaggttagggccttgagtatgaagagttcagccgttaatttgacaagttgggttggcggtactaaagattccaccagttgattccctttgttcaaacacacattatcgctctgcacatttttgcttgatctttgccacagctgcaaaggtaactgtagtaacttcgatcctacactgggataaattaaagtaatacatgatgtttccacagtgcatggcaagatcactctggtactctttggttaaagagctggctgcttcaatccaatccctgcatgaacagattttttagaactctgaaggatggtagtaatagtaacttggtagatagttaattacagcattgtttattgatgtgtaaaggcgttatgtagcttgcattgatgagtccaaagcaaagggtttaacagtggatccacatgtggggagtatcttatgattgttaggagtaatgttgtctttgtctgcctaacagtgttggtcgatcaatagttaactgtctaagggtcaaatggtagctagatccatggcctgccccacatgtgaaacctctgtattttttgctgctagtgggatgtcctttgttgcatggaacatgcaagatggactagaatactgtggctctgaattgttaaattaccgactaattagtcttcagtcgggttaacttaacttaaacataatgcatgcttgcattcttacatgaaggccgcctttaatcagtccgaaccatccaaagctgctgttatgaaaagttctctgttctgacgaagtgaagagggttcatgcttttgaggactcctacagcacagcaaaactagctatagatcaatttcctataagtttatcagaacaaagttttcttctcttttttttcaacttagagaaggaaagtatatatccaaagaaacatgaaaaaacaagtataaatgggttacttcattagtagccaatggaatccagtcaaacgacataaacagcaaccgatcatactaattaatcacatgaaacagctcaggttgtctggagtataactttctcctgtataatttgtcaagcatcccggcgatatcaggctttggaatctcaagaaagatatgcaccgcagttgaatattcaggtcccgttgaggagtgattcagtgaacagaaacctcttggcttctcccgtccattgatcagtgagcatcgatcctatgaattcagact

SEQ ID NO: 605 - DNA, 13570 bp, Oryza sativa
aatagcttgaaaaagtaatcaaagcaatgttgatgaaaagtttatttagagaaaacaaaattttcaaagcatggcatgaataatccgcttgatactccgtaatccattatctgcttttagttgaacgaacggaacctaacatggatcgggcatctactcatttgtcatatcaaagtgtagatccattgctatcgtcgtactagcaaaaccaatataaatagccaagacgatacagtcgggaaaaccgataatacaacataaaacatactacatgacatgctttactccaagaattacatcacattgaattgatatcatcacctcctccatgttagagatacctacatgtggtgaagaaaaatgctatataaaccaaagacgtgctttgtttaacgccattgttagctttatcctttttttttcaaacgacaagatttaaccattgacaaaattctcataatgttgttgtttgaattattaccaaattatctgatatgattgactaattgctagcaaattatcaaatgtgtgccaaataatttggtaccactattcttgatcctgttatgtagtcaataaagctctcccccccaggggcaaaaagagaaaatcaaatgtgtgccgaataatttggtaactttttctttttaccgttccaatcattttggtacagttgatttgtgggatttaaagcttgaaccttcatcggagatcagttacatacttcagtagcgcctctcctctaccgtcacaaaatgctgagaaaaacgaaccgtagaccaggccacagggcaagtcagcaatccacaagaacgataccaaggactcgtttgcaaatactcagaaacacaagggcccccaaaagggaaaattcgttagccggtaaaatgcaaccccccaaaataaaaaccacatcacaattcacaagtagtactccattcaccaacacaactcccaaactcctctcctccaaaagagatagactccgtcccccgtctccgtctctctccccataagaggcgagggcggaggaaggctttacgagcaaaccaggccattacacccccaaaaactaagggagagagagagaaagagagaaaggcaaaacacacaggaggaggggacacacgcctccgcctccacctcctcccgaggcgatagcgagctcgcctccgcctccgcctccgccgcgccgccccgccgacgacgaggaggaagaggcgacgccaccgccgccgccgcaggaggaggaggaggcgacgcccgtggggagctcgcgcgacgccggatctcgcgatctgaggggcccccgcgccaattcccccgcaggtgcgcgcgcgctccaccccccacgatccgcggcggggctcgatcccgattgggttcgtggttcattgcgtttggtttggtttggatttttttttttgacctgctctcctctgtgcttggaattagggttttgcggcggtggagacggagatgagcgtggagagccctggaggagcccccgggagctagggtttcgcgcgacgggaccgggacgacggccgccccgacaagctcctaggtcttccatgggagatggaggtgtcgcgtgcgccgtcccgccgcagcgtgcagtggagggcttccgcgccgggggcctcgtgaggagaccagggggagaagccatgccggacaagggggagaggggacaccacaccaccagcaacaaccaccacagccacagccacagccaccggaagcatcatgccgagctggaggaaggggagctgctcaatggggaggctgacaacagcagcagccgggacttggagaggagcatgcctcccaagaagtggcggaaggtgctggctgcctcctctgctgcagaggtggagccgggggagattgtgatgccctccaagaaggcgaggaagaacggggagctcgagaagggggagattgcccccgagagacagaggaaggacaagtctgataagagtgggaggaagtcgaataaggatgaggtggaaccaggggaagttgctccaccagataagaagcaggaccgggatcataacaagaagctcggctcgtcggctcaggtacgcgatgacggcagcaagaagggctcctcgcgggattcagatgaggagccaggtgagattaggccagagagcagcagcactggcagtgcaaggaagagcagggcaacagagcctgagaacagcaaccacaagcaccaagctgatacatgtgatcaaacaggttctaagagtcgcaggaagggagaggcaaagagttctggcaggcatttgtcaggaaggaatcgtgacatctcgccaatgacacgggatcgacatgagaggagcccagggatcttggggcgctttcctcatgatcgcctccgccatgacaggagcccaagccgcttggagccctccccacgggaccgcggtcgccactatgacaacagagaccgcagcccatacatttctccacgccacagaatgcgcccatcccattacagggataacacaccgagccgtggtgagatgcaccatcacagggataacacaccgagccgcgttgatagttctcctcggagatctcagcacgaggacttcagagaccgaagcccatctcgtcgtgataaatcgccatctgaacgaggacggactactgaaagccatgaagcaggcaagaagagcagaggtgctaagcttgaaaacaacagcctggaaaaggcacaacacaaaagtaaatcaacaaagcaatcaactaagtctaagagcagtagcaatggaagtaatgagaagatatccaaggaaaaggcaactgagaccattcagtacactgagttgccaccaccaccccctctacccccgccgccaccacctcctccgccgccacccccgcctttaccgcctaacatgcctcctcccctgcctccaccaccagaacctgaactgaatggagctcctgcagaagatgtctcaatggaagaagacatggacatctgtgacactccacctcacactactagctcagcacctgggcccactgaaccacccgcaagcgatgtggggaagtggttttatcttgaccattacggtattgagcaaggaccttctaagcttgctgacttgaagaagctggtggaagatggatatcttctttctgatcatctaataaagcatgctgacagcaatcggtgggtgactgttgagaatgcagcttcaccactggttccatccgaattcccctcagtatattcagatgtctcaacacagctggttagcccgccagaagccccaggtaatttacttgatgaagctcgagaggaggcatctggtactgaccatgaacaaatgaaggaagcttctgcagaagagcaggaagatttctacattgatgacagggttgatgcattgatggatggatctatcatggtggatggtcaggagcttgagattcttggaggtaaaaatgctcccttgtcgtttgaacctgagattcaaaatgttttttttttcccgttctcttttggtgccaatgggctagctcaatttgggtttttcttcagtttgcttggttatatcctttttggggttgcataattcttggtggtattggtacacccctcgatttctttgtaggtttgtagaggggcgggtgatgcttcatccgtgattttgctgtttaaacctaatggtgaggtgtttcatgctgtccacgtggttgggcccgggttttataaggtgtatagatcttcttttggatacagttttttccgttgcaaaatctagtagcgcggaccttgtgttttcttggattttttcgttgcatctttgttttgcatatgcacccccatgtatttctgtttttagtttgactgtcatgaaaaaaaagtaacgatttccacaaatgcccttcagatttatttatatatacatgtctccttttggaaattaattattcttatgagttatgacatcacttcgtgctctctcttcatctctcggattcatattttctgcaactctggattgttggtgtgaagttaacctgcatctttgacttcattttttttaaatataaacctttgatgagtgttagaagtgtagaaattccagaagctttacaaataattatatttttgttatttggttgttcttcagaagccttttttcccgcaattacttccacttcctcatggttgtactaatgttgtcgccttctgtcatttgtaaattgcagagcttctaaatgcacattttgagccagtcaactgggaaagcgaaggtattgaatcagttttctcttcacttggttttaggatgtgctctcatacacgtttgaattctcaatactagtgtatggtttccttcaattatgtagatgccattcatctcttaggcagagtaactgtattctttttttttaatttctaaagcttaatcagttaattgagcataatatttccttcagataaagtttaatgtgttctttcgtgaatatgatgtcatgataccataattaagtttctttttgttacccttcattctgttaccattaacatgttttaaaattcttatgctagatctttcaaggttccaagttaaattggaaagagatgatggaaccaaaagaagcactgaatttccagatagcaggactgcacacatttatggcgttgttcctgctgagagggatacctatcagcctcatattgagtctagtgaatggtattctgggagatggtcatgcaaaggtggtgactggaagcgaaatgatgatttcagccaagataagccttacaggaagaagcttgttctcaatgaaggctatcctctttgtcaaatgccaaaagggaatcatgaggatcctcgttggggctgcaaggatgacctctactaccctttacgtgctaaaaagcttgatctgccgttgtgggcattctcatcaacagaagaaaatgatgacactgtagatgatgccagtaaaagtggtgttatgcctgggaggtcaggtcagactaaacaacctcctaagggagtgaaggggacaacgcttcctgtcgttaagataaatgcccgtgttgttaaggaccaatcctcttctgaactccgtataaagcccaaagtagctgatcggccaccttctagatcttcgcgctcccattcaattgggactgataggagttctacccatgaaggttcgtctcattctaagaaacatcatgaacacgattcacaaagtttgcacaagtccaagtctgttccaaacattccaaaggaccatgtatgtactgttgaagaattgtcagtcaaagtaggtgactggtactacctggatggaactggtcatgagcgtggcccattttcttattctgaattgcaagaattagctaagaagggcactatccttgaagggagcagtgttttccggaagattgataacacatggcttccagtgcttaaggatttaaaatctggttgctctgctcggaatggggaggctggaagttctacctctgctctcacacactcaaaccagtccaacttccacgagatgcatccacagtttgtgggttatactcgtggtaaactgcatgaactagtcatgaagtatttcaagagcagggaacttactttggctataaatgaggtcttggaaccatggattgcaacaaagcagcccagaaaagaactagaaacatttttttctcacagttcagcttcaaagaattttgtgcaaggtactgtatcaggtcttgtccaaatacaacttattcccctaccttttgctgtaaaaattttcttctcagctatcatgacgcatgtcaagaagcaagtttatcttttcttcgtctgttgctttcaagtcattccagttgcacgatacacactctttgctatatttcttttattctagtaatgcaattgttatcctggtcatttatttcttctggcctgcattttgatttgtggaccttctcatcaattctccttttcccttttgattcatgtagaggatggcgggtccacaaaaagggcaaggttgctgcctgatcaaagtgatgaatatactgatatgtctgaggacattcttgccagtcagaaggatgattgttgttttgaagacttatttgagggggctgctcatgttaaagaaagccctctgaattccagaacggaaagtgaaagctggggtttattaaatgaacatgtgttagcaagaattttccattttctgagggcagacgtgaagtcacttatttcttctgcagctacctgtagctggtggaacactgcagccaagtattacaggagtgtttgtagattcattgatttgtcttctttgggccctcagtgcactgataatgttttccacgacatcatggtatattcgctcatctttctaacttcaagatgtttcctttgtcatcttctaacttcgggctcaaaatcatgtatcttcctttcaggctggttatgacatgcaaaatattagaacacttgttttaacagggtgttcaaatcttagttctcttgcccttgcggaagtacttaagcgttttccgcacatatcatatgtgcacattcaaggttgcagtcagctaggggatcttaaaaacaaatttcagcatgtaaaatggattaagagctctttgaatccagatgcatcataccagaaaattagaagcttgaagcagatagatgatgggagcaacagcacatccaaagctggaaggatcttgaccagtcagatgggtggttctgatgagcttgatggctattttgctgatatttcaaatagagagagttccaccctttcctttggacaagggttctataaacgatcaaagtggcttgatattagaaagtcgtctgcggttttgtcaagggatgcacagatgaggcgtttgatgcagcggaaggccgagaatagctaccggaagatggaagagtttgtcatcaacaaactaaaagaaatcatgaagagcagtagatttgatttttttgttccaaaggtactatcgaaatcctttaatacaattttctgaaccttgatgttttggttgaccctaataatagttcacggtactttattttctattccaggttgcgaaaattgaagttaggttgaaaaatggatactatgctcgccatggctttagttatatcaagaatgacatccgttctatgtgccgagatgcattaaggtaaagtgggtctaaatgaaatgaaggcttgcaaagtagttgaattttatgtgataatgcactatctgacatttgatatgccattacagatataaaggtcgaagtgacttgggagatatgaaacagattgtcgtggccttcatccagctagcaaagaaacttgagaacccaaggttgatttctgatagagatgggacagcagttcagaaggacagttctgacatgagtcagtattcttcagatctgaaactcaaaaagaaacagagtaaaactatgtcagaaagaaggggagcaaactggactactgctggagcagatccgtcatctcgtgcatttgaccgtgaaatcaaaagaagtctttctaaattaaagaaaagggatatcgattctggtagtgaaacatctgatgatgatgatggctactctgaaggtgatgagactgagagtgaaactactgtttctgatacagagagtgatcttgatgtaaattcgggagcatgggatttaaagggaaatggtatgaagttatttgaatcaagcgagtctttgacggatgatcgtggatggggtgctcgcatgacaaaagcaagccttgttcccccagtgactaggaagtatgaggttattgagaagtacctaattgtagcagatgaggaggaagtactgagaaagatgcgggtcgctttacctgatgactattcagagaaactgctctcgcagaagaacggcactgaaaatttggaactaccagaggttaaggattatcaacctagaaaagtacctggggatgaagttcttgagcaagaagtgtatggaatagatccatatacacataatctcctacttgaaatgatgcctactgaacttgattggccatcctctgacaaacatacctttgttgaagaggtttgtcctggtgaatagccattttaatttcgtttttagtttacatgcaggcctaattctttgcacttgtactatttttttttcactgcagttgcttctgaacaccttgaataagcaagtgaggcagttcactggttctggaaatactcccatggtttacccccttaaacctgtaattgaagaaatccaaaagtctgcagaggagagtggtgacagacggacttcaaagatgtgccttggaatgctaaaggccatgaggaaccacccagaatataactatgtcgcctataggaaggcatgcatttcgtgataactaatccctgcataccatcttaactaacttcagtctttttaactttttctctgcattttctttcagggtcttggagttgtttgtaacaaaacgggtggatttggtgtagacgactttgtcatcgagttctttggggaggtatgtgatttttacgatcaacaaatcttcctagatgacatgcaaagggatataacaatggtataatatttgtgaaattgcaatatctgcaggtatacccttcttggagatggtatgaaaaacaagatggcattaagcatatacaaaacaatagcgacgatcaagctcctgagttttacaacattatgctagaacggccaaaggtattagtgcaatctcaaattttttaatgtgaccttgcatgtgacttatgttattccaggtcaaggtacatataactgatcgttttacctttgttatgataaaaagggagaccgtgatgggtatgacttggttttcgttgatgcaatgcataaggctaactatgcgagcagaatttgtcactcctgcaaccctaactgtgaagcaaagtaagcttcttaatcttcagattagtaccttgtgtggtgtatgtgtactgccttatcactcctcctatagtacttcctctgtttcaaaatatagtgtgcattttgtttcgttaggacaagagtttggccaacgattactctattatgatataatttttacgacacataaatttattagattcatatccagaagtacttatgattatacttttgtatcacaaatgatattctaatagagcgattgttggtcaaagtcgtcctaacgaaacaaaatatgccctttgttttgaaacagagggagtacctttttagtgttgacctgtacttttggactgtatttgtggaaggggtttactctgttaactaaatttatatatgtggtgttgcagtttgcacgtgatatatgcttggccctatcatttacgcaactaccttctattgtctttttcatattttgaaaggcctttgtgacttcattgttgttgtattctgtggtggatccatcctatgctttgaactgtagtgggggaatgcgatttcactcttcctgcatgtctacttcattctatttggttcaccatgcgctgttgtatttttttctgaacaaagtccctgatggcctgtttttgttgttccagtagtgaaattcagaaattgagaacaaacagggaagggggcagcaatcaatggatggctaacaatttataaaaactgaactgcacatttatagtttaagcattttctgtacacctgtacctaatattgaaggactcttaagattgaaggagaactggcccatattggtttccacaaagcccactttccatgctagtcaaatttataaattagtaaaatgcactcataagattacatgttatacctgtaataataactcacgattattaaaatatatttccagagtaacggctgtggatggtcattatcagattggaatttacactgttcgaccaattgcagaaggcgaggaaatcacttttgattacaactctgttactgaggtgattgccatttctagtttctgtataagttctaacgtaaattgctttatcttatgaatacattctaattatgccagagtaaagaagagcacgaagcgtcagtttgtctctgtggaagtcaaatatgcaggggcagctatttaaatttttctggggaaggagcttttgaaaaggtaaacttcattcttgtttacagtaatttaggaactgacacttgcagtttatcaaattgtcatacactgaattttatactgcatcatttcctctcatctactaatatcatttggaacaggtcttgatggaattccatggtgtgctcgatcgacatagtcttctgttacaggcttgtgaagcaaactctgtttctcaacaagacttaattgacttggggagagctggtcttggtacctgtttgcttgctggtttgcctggatggcttgttgcttacactgctcacctggtaattgtagttaccattttcttaaagcttcttttttcttgatacagtaatcagtatcgtgatccctcatggctatttttcctgtaaacaaaggtgcggtttatattctttgagagacagaaacttcctcatgagatctttaaacacaatgtggacgagaagcgccagtttttcacagatataaacatggattccgagaagaatgatgccgaggttcaggtgggtcttcgaacggctacaagttgcaacgtaatttacataaaatcgatctaattctgtcatcactactcaggccgagggagttctgaattcaagattacagaatttgactcatacacttgacaaggtgcgcattttatgccccctagcttgaagttattcagtataagtgaacaaaaaacatgcactatgcactaacaacccaaaagaagtctcttctgatgcatttttatggatcattgttatgttcaggtaagatatgtcatgagatgcatatttggggatcccaagaatgctcctcctccactggtgaggctaactgggagaagtctagtttctgccatctggaaaggggaaggctcgttagttgatgaacttcttgagtcaatggaacctcatgttgaggaagatgtacttactgacctcaaagccaaaattcgtgctcatgatccatctggttccgaggacattgagggagaaatccgaagttctcttttatggtgagtttagaatatattcttgttttgtttgaccattaatctgactcttccctccagtcacctgtatctggaatctgaccgcccttttcttcaggttgcgtgatgagctgagaactctttcatgcacatacaagtgtcggcatgatgctgctgctgatttgattcacatgtatgcttacacaaagtgttttttcagagtccgagtaagtgaaaacttcctcttaattttgcaacaaatgtttgtgatttttctctgtaccaaaggactgactcaaggatcaccacatgcaggattacaagacggtaaaatctccaccggttcttatcagtcctcttgatttaggtcccaaatatgcagataaactgggaccaggcttccaggagtactgtaagacatacccagaaaattattgcttaggtcaactcatttattggtatagccagaatgcggagcctgaatctagattgacaagagctagaaagggttgtatgtcattgccagatgtatcctccttctatgtgaagtcagtaaaaccaacacaagagcgagtctatggcagcagaactgtgagattcatgttagcgcgcatggtaagtgcttaccttttatatgtcattgtggctaaaatattccaaattttgttcttggaactcgttcagtgtggaaaacaaaagagaatatttgttctagacaatattaaatcatcttctgttggattgagtatttctcttcatatatgcaatatattacagtttctttccctgactcccatctttctcaatgaaactgcgtggttttattacaggagaaccaggcacaaaggccatggcccaaggaccggatatgggttttcaagagtgacccaagattctttggtactccaatgatggatgccgtattgaataattccccccttgacaaggagatggtgcattggctcaagacaagatccaacgtcttcctaggctagccaaggaattgtaggcagagggtattggtttttttcctttggagattttagtcagacaccattcttttttcttcctactcacacctttcctacctaatcatggggatttagcttttagatggcagggtaacaacagtctctctcaccttccccatttgtacagccccctcctccccttaccttgtagagatgtgttccattattaactgatagatccatcattgatttaatgtagcgccttttcccgttgcgtagaattgtcacctcccaatgtgcaatgtggatattcatgtgtaaatgcaaaacagtagcaatcttaaattccagtgatatgttacagattgtaggaagtggacgttgcatttctgttgctcagtttcgagctgtttgacctaataaaagtttcaggaagtagttttttgcaggagtgatacagaagtggtctgtgataatgaatgctgggtgaaagtttcgcatgagaggagaaaacatatgcttcaccttgagcttgtgcagttaggatagatgtgcaggcaaatgggtagcagctgctttctgtttttcctatcatgttcagttcatgacatttttttttgtgtgtgttggtggcttaatacatgaatgtcagaatgggattccttgagcctcttttctccttttgggtggacaataaatcaataatgcacccatatgtacactctgctgactgctggaagctggtccttgaatgaactgcctgctgcaactcttttggagccatgaggagtaatgtctctttttggagccatgaggagtaatgtcgtgtaaatgctgacccagtatcgactatggtgaagggcgtcaaggcagctgattaattaggcctttgcttccaagggtgaatagtaccactagcaccccacaaatctgagaggcttgtgatgtttctacacaatacttctttttctaaaccctattcataatggttaatctattcttataaacaactgtccataatcccagcttgggagcaggagctgatgcagtccagcagggctgaatccagaaccaaaattggcatgtctcctatacctatcaatcacacatgctactagtttgtttatgtgataacatggtcaaatcaaatgctaatggaatttctcaaaactttactcttatgtccgcacataacatggtcaaatcaaatgctaatggaatttctcaaaactttactcttatgtccgatccacgatatgtaattcatacaatagttacttactataatattaatatctagtcccacctgtcgtgctgcagctggctatatatctgtagcccgctactcttctctcttttcctttatctctttataaaataataaaatatatttatagctggcttatagcctgctattgtacctgctcttagaggagacgtgggcggcg

SEQ ID NO: 606 - DNA, 6297 bp, Oryza sativa
atagcttcttctttagcattgacttttaattttttaggatcatatatataaatattttatgcacaaattatgttttggtcagtaataagccattacggcttataataaacttttggtcaaccgacaagtccgtttttccacgatgtatcgcaccaatgaaattcatgtgtataagtaaaggatgtgaaattcatgtgtttaagtaaaaggatgcttttaattaaattcatgttatcaacctttgaacataaatatcctaaggaaaaaaaatcatgtgtagtaagtctaaaggaggagtaattgatcgaaagaatcaacgcccacgtttcgtttatttggggaataagccaaagccaaacgatatatttgcaagcaaaaattaatttgtaaataaaatttgtatatacatgttcttaacgatctaaaagcaaatagctaaaaaataaacttcaatgtaaaaaccctaaaatcatctccaaatttaaaatttaaaatttatattttaactgataagtacaagcataattgaaaagatgagaccgcaagagtaccataccttaccttacatacgatggaggcagccacgtagcttcatatttccaagctactcctacccttggccttgggccctctgtcaggaaagatattttgagcccagagcaagcaaccaatggcaggcgcacgcacacaccaaatgaggctaccatcaaatggcctaatcaatcaaagaaaaagtcaaattttaaattttccagcttaattttaagatatttttaatgtagtttctttttcaatattaacttttaagtcaccaaaagcatatttataaaagtttcacctataaatatatttttatttcctaataagcccttttggccaaacgaggacctgagcaaatgagagaagagaagggaaaaaaaaagaaaaaagaaaagaagaaaaacggggcgcccaaatcgggaaggattttaaggataaccggctgcccaccggctacttcccgccttctatctatatatccccccctccctcctttttctcctcctcgccaccgctcgccggcgccggagaccaccaccaccacctcacctcacccacctctgcttcttcttcttcttcttccccgtggtgtggtgtggtggtgaattgttgttctgttcccttcatttttcgttgattcgtgagcgcggcgacgtacgtacggtggtaagcatcgtcgtggattcgtctccggcgacgggggggagtgggtagggtagggatgttcgtcaaggactgggactgaggtgatcggctaaatgtaccgccagaacgagtcggccctctcctgcttctacctcttcctcctctggttcttcttcttgaaatagactccacgccgcgccaattcccagcccgagcgggagccagctgctcaatccgtcgttgagattggttgcggtttgctctagcttgtgaactcggcggagatttttggttttttgttttggttttgggtttggttgggtgagtggtcgatcgatcggaaggtgttcgatcgattgcttgcctgctttgtgatggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtaatttcatcgaacacatcatcttcctcctctcaatccaacgcgacatcgccatgaacaatctaacaaacaccttcatcttctcccaaacaatcacaggtggattcgacactgctcacgcagctgcaaggtaaagaacacatcacatcattcatcagaacatgagctctgtgtttgtgaaggagattgagagaattgaatgatgatggatggatgcagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtaagaacaccatatatatatatagctctctctctctccatcttcttcttcctcatcttttcatttcaacatgttcttgatttattgtgattgtgatcatccattttgagtagggatgatagtaagtagagatagggtgtgattagatgcatagaacagataagagttaagctagaaattaggcagtggatagggaattcctcaccggtgggaacgccatgcttggctgcaggtacatatatcttgggctattcgacagcgaagtagaggctgcaaggttatcatcagcttggattctcttctcttgtacaattgattcaaaccaaaaaaaagtcttttcttttttaaaattttactttctcgtgttgttgattttcgatggaccttgtaccgactcgaatctcctctctttttttttctcttcttttttctcttctcgttttaaacatcagggcttatgataaggctgcgatcaaatgcaatggcagagaagccgtcaccaacttcgagcccagcacatatgatggtgagctgcctactgatgctgctgctcaaggtaacatgcgtgctgaatctgatttgattaaattttttttctgtaactgattaactagctgatgaactcagctctgaacagatttaattaaatccgggttcaattgtgatttcttattatttttaggagccgatgtggatctgaacctgagaatatctcagcctgcagcctcacagcagagccccaagagggatagcggctcccttggcctgcaaatccaccatggatcatttgaaggttctgaattcaagagagcaaaggcaagttgcaattcagtcaaaattcttccgatggatgatttgtttgcatgtcaagcaagttgcagtaatgcgaaagaaacacaaaagcataaataatcaagattcgctttcaccgtggtagcgactaaagtatgatgtgcaaattgcatatgtagtcttctacctagtgtacttcatagaccccatttctattgctaccgtctaaatttgatttctctattgtcggacccaccatacgtacaaattggccccaaatttcatcaaatagtaacaagtttctctttttcttcctgattacgttgtaggagcatctctttcatgaaaactgtaaatgatattcaggatcactgcttagttgatatttcaactgaaaaacttgtgctttgctgtgcagaatgatgcagctccctctgaacttgctagccgccctcatcggttccctcttctgaccgagcatccgccaatctggactgcccaacctcatcccctattcccaaataatgaggtgaaaattttgtagctttcaacactgtatttagcttcatccacttgcatttcttgtgtggctatcagtttagctcaagtcttacatcaatgtgcttcatttccttccggcctgtcgacttcagtagtattaatgcctggcacaagtttcatatgtaggttcttgaattttcagaaaaggcctaattagggtagcagtactagtctatatgcattataaatatgtttgattttttcttcaaaaggaacttcctagagagttgacgatttcgcgttaggctttttataaatcgtcagtccaactgttcctctcaacgtgctaatatcttataaaattagtgtcggctgttgttcaaaattccccattgggaaagaaaaatgatactctgccatcttgttattattcagaatgattagtatactacatcaattggttattaaaagaggttagactggtttgccgttagacatttggacctgggagttttgttcaaatttacctctgagacttcaaggatagcttcagttacgtccttctcttattttccttggacggaaaggtgatctcgacgtctgtagctgagatttctgtccaattgaatcgtcgcaaatccaatccgataatcatattttatccaaacaaaaatacaatataatagttcttggcaatttgtacacctgtatcttgatggatggataagaaattcagcaagctaagctaagtacaatttttcactgtttgatgatgcaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattgataaaaaggaaagaagccatcaccaccactgtaaattttgccgggaagccggcaaatttttttttttcttggccgtcgccggcgtttcaacgttttcgtctttgcgccggcgggccggccgggtggtttcttgtagtgattagttaattgggattcatgactgtatttgcatccacacataaaacgcccaaaaaatgttccaaatgctcctagtctctttgccccctgatctcagagaacagatcatactaacctgagatgtattgatccacacaccttgttgtagagaatttgttatatcagttactgagattactaaacagtacaggcatcaactctgactttacttagaactcgttcttttctgattaagatatagatacgattttttacctcggttttcgttagcatgttttttcaaactgctaaaaggtacattcagtgcaaaaaaaatttctaaatagaaattgattcaaaatgtcagataaatctatttttaaaatttataataaattaatactcaattaattatgcgctaatgtttttaatgtccccccttaatcttcatttacgataaaaaacgagcacctttacctagtagtttattgtggatagggaaaaaaattaaaggtttgcataataggagaattattcaagttactttcttggctgtcacttggtgttgttgtcctttcttagtttggtgccagctaccaagttgcttccagagcaaacactagggatggcaattgtgcccgtttgcccgtttacccgcgggtaaaaaccctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacgatttcccttttatttcccttattatttctctcctcttactctatcgccgccagaggagagacacgacaccgaggtggagaatatttgatgttttaagttcgattcgaagttagtagcttgtagactttttgttccactgcttttgttgtggcgggtaaacgggcacgtccgcgggcaatgggcatgggcaaccatccttacccgtcatgtagtaatgggtatacccacgggcacaaataatctcacgggcatgggtatgggtaggcactacccgtgcccgtcacacgcgattgccatccctagcaaacactgttcgtttgttcgttctgcactgtgccaagatttgg

SEQ ID NO: 607 - DNA, 6921 bp, Oryza sativa
ctggaataccactgctagcaatcagaagctgattacacatcatccatgactcagtgtgtacgctaactggagtagtagtggcactaacaaacaattgaatggcagtaatagaaaccgtagcgccagataaacaaatccaaaagatttgtcttgtccacgtctttggattaacacaagagtgctcctcatcacgttgtgcagctgcaaccgcttcttcatccagagactttttttttttacttaactcttagtattactatatatcttgtgctattaattggagcaatcaagaacaacgagccaaggtgtgtcctatacaccaaagacattgaccaactgttaacattgctgtttaatattaacaacaactaagaagagaagaatagacgaggctaattaagctaaagactttcttggattcccttgtagaaaagcctagcaaaaacagctagtatcatcaaggaagctagaggaccattggaacaagcattgcacggtcaaatccttgcaccgtcgtagaattgacattgtaatgccatacataacatggtgcattaacattttgtcaaacaaagagagagagagagtacgtttttgaccggctactttcaccaaaaaaagtgaaacctgcatatattcctttttttcccctacgccgtttgacatacgtattctaatttcatgacaattacttaaggccataaacaatcgaaataaatattaaaaatttgaaaaaatagcccaaaaaagtgttcaatagttttttaatataaaaatcgcactaattaacggcttgtaaaacgtgctcgtaataattattagctaaaataaacagggcaatagtacaattcaatctgtaaagctttcttttttttaaaaaaagagtggatacataaaagtaatatatttgagctcgaattgcatgttatatctaatccaaagggtggagcacacacacattaggcatcgacacatgcaaggaaggaagcatttgattgatgcaaggaagcaaagaatccaaaacaaggaagggagaacagaacactataaaagcggaacaaagaagaagagaagagaagaggtagaagaagaataaggtaggacacacacacaactccactagatttaatgacccccccttaaaattaggagaaaattaggcgaaaaacaaatccaaaagcgaagacccaagaggaagaaggttaatcaaaccaagacaagagagagagagagagaaagcaagcacagatagagagagaaacaagagagagaagaagaagaagaagaagaagggtagaagaggacgccgagagcggcagaggggtgaggccatgtgtacgccatgggcgtgcgctgcgtggacgtcgtgacacctgccgccgcccgcgcaccgccatcgccatgcccatgccgccgcaatgcgcctcctcaaaacccccttctcctcctcctcctcctcatccccacgagcacgaggtttgccaccgccgctgccgcttcttgccttgctttgatccgccgccgcgggaggcctcttcttgattcttgattttgcaggtaggggacgacatggcggaggaggcgccgccgccgccgccgccgcccaagctcctctacattgccgtctccgacgccgccgctcgccgcgccttccgctacacgcgccccgtgcttcagggcaccctccaactcatgggatgcaaggctcgccatgccttcaaggtataatacctatctatctttctatcttcttgttcatcttgatcccaacaatggaaaaactgtgcctgctctctctctctctctctctcccgcttaatttctgcctaatctggccccgatccaactggtggcgatctgattggctctctcgtgattcttccgcttcgattcgactggaaattttgctgcttctcgtatccagcgttgtgtatggtttgcacgtgctgatgtgatagatccttttgctcctttctgtgaattgcttgcttgttcttggtttaattgatagaattgcatgccgagtatagtatctggatgttgtatgttttttttttttggggggggggatggatgatcttgacaaagaaaggtgacgggttttagtgattgatgtgcagatttgttcttagctcacatccagactctctcaagtcaggtctttacacacactgctgttgatttgatcaaactctctcacatcattttcgatatctttttgcgcgagggcgttctttgcaggggaaaccggaacctttgtcaaattcgagcacccagcgcctcacttggttctgattccgcgcaatttttatgtccaaaaacccagcatatctttcaagatatgttcttgttgcatactgaacttgtcctttcggaaatatacttgtttgtgacgagtcattgtcagagatatactgccatgcaaactgttgcctagctgatgagaattactgtacctttcttggtattattatgttctatcgacaaagacaacaccatgctgtatgatgtagacctgtttgccttgcttgatctttttgccttgggcctgtagtttgatgggttgccattctagaaagtatctagcaattgacttgagttggtcatgggttcccactcggtatgcgttgttcttccctgacttggtcatggctgtttgacatctttttcctttctctgaaggcacaatttggctagctgcaaaagaaactaattgctgatgcctacttctgtagatcagactgcacaaagtgtccttttttatttctctcttgacttgtgaagataagaagtttctttttcatctttctttggcatcatcagattagcaagagggtgttcaatgtgatgaggagtgaattcttggatgcatccaaatcagatactgcagataatgaagaaaatgccccttcccttgtaaaagatgttgagatgctgaagcccaaaattttggaagcaactcttagtagcatacccttcgagttatacaagacccaaacaaccatcgttgtttctagggagaagttcctaagtgttgtatgtgatgccctctcttcatacaagtatgtggggccaaaccagaaggctgactttcttcttgcttgcaggtaacatgtttttccttgtttctgcatttataaattcagaagttacaatgagttaccaatcatcagttcattacagccaatggaaagctacctgaatgcattgaaataacaatggttttgtgcaactgtgcattttccaattgttctgttcagaattaaggagagaaaggaatcagtgacagtactcttatgtgggactagcggatgcggcaaatctacgctatcatctttgttggtatgtttatcacttacgcgaaccatacaattccggatgagtgaatgctctactgtaccagcaacatagtagtagtttgttacatgttaaagtataatgcaaaacgtctgtagaacaaaatccacttgaaaaaaaaaatcctttctagacctatcaattacctcattgctttcagaagattgtatcgcttaccgaacaatgaatgattctgggtcttgattaatacttgatatggtctgtctgtttttctcagggtagtagattgggtatcacgacagtagtttctactgattccatacgccatatgatgagaggctttacggatgagaagcaaaatcctcttctctatgcatcaacctatcatgcaggcgaatgcttagaccctgttgcagttgctcaggcaaaggcaaaacggaaggcacagaagcttgacattgtttctcatcctaataccaatgaaggcagagacgacacttcagatgataaagctcatcatggatcctccgaattgcctcctagaacggagttgatcggcagcaagcaaatggcaatagaagggttcaaggcgcaaagcgagatggtaatagacagcctggacagattaattacgtcctgggaggagcagaaacaatctgtaattgttgagggagttcatctaagcctcaattttgtggtgcgttgcgtactagttagatatttgcatcaattacttatactttgttgcatactagagaactgatgtagccttttctattttcattttccaacagatggggctaatgaagaaacacccttccataataccatttatggtatacattgcgaatgaggagaaacacatggagcgattcgctgtacgtgcaaagtacatgacactagacccagcgaagaacagatatatcaaatacatccggaacatcagagcaatccaggactacctttgtaaccgtgcagacaagcatctggtgcccaagattaacaatactaatgttgaccagagtgtggcggccatacacgccacggttttcagctgtcttcgcaggcgagaagctggggagcagttgtatgacctcaacacaaacactgtagctgtagtgaatgaggaatacaggaaccagcgtgctgctaactcactgggttccaagggaatgtttcagttgatacaaagacagggatcttcaagaaatttgatggctatccttaatactgacggtagtgtcaccaaagcttggcatgtggataaaaacaatggcaatggaagtctcgatggtacaagcagtgacaaatcaacaaaaaatcccatgtatgatacatttgggaaggcggagccagtcaatctccagttcggatctttcgggatcagtgcatggatgagtgacacaggtggcaccagccatacaggaagtgtagatgacttgagagctgatggcattgaaacgggcggcagatattattcctcatgctgcagttcaccaaaggtgtcagattgcccttcaaaagaggtatgcattggtgtgtttacagtatgataggagaaacatgctgccatcgcagacatggatctattcaatccttacatatgtttgtttcatcatttgcatttgatattccagcatatagtgcaaaaattggacgagctagcattagatgctcgtctatattcgcacgaatgttttattattaattacatgtgatacaacactgccttaacactggtttgagtagattggtgatgccataaattcgacctaacaaagaccctgacttttcagcttatggaggatgattattcagtttttggtagcgaagaagatgctgatgatcctcctgatgctggaactgacgaagacctaactgatgaagaaagagatatgcacgaggtaccaaaaaagctccctgtatgattcagcaatttcctttctagttgtgataaacacacaatatagttttcagaaactatataaaaaagaatgcaaataagaaaaaactatatccattgcagctgataattgttactaccatgctttcacttaaatgctcatggctggatttgaagaagatgctaaattcttttgcaccaatgaattcctgcagatagaagcaggctctgttgatgaacactccaccaagtccgacgaggaatacgacgatctggcaatgcaggatgtgatggagaacggttactggtccgacgacgaacaggctgcaagcagcaccaagaactcatcgaaccaggagaagaacatccatggagcagctgatggtgatgttgttgatgatgaaggcagtggcaatgacaggtttcaccacaatctggccttcttcctgaagatgtccaagaaagtagccgccacagaactgccgtgtgcatagtgcctccggtgtcaaagcaactgttgttggtccagatgtgctctgaactcggttgttatgtatcctgatgagcttacctccatgactgtaactgtaagagaggatctgctgcttgtctaagcaatacagatcacttagaatccgtgtaatccaataactcttgaaaagatgaaataataaagggtgaataaatagtttgatacaaagttggagattgcatccgggagaaactcttttaaggttttcgctagttttgtctgtacatcttcgtgggtatggtggtgccaccaccttattcacatcacaagtcactaaaccacagtggtatagaaatagaacatcttctcaagaagggaaaaaaatggtagtgtaaataaatgtggacattatatatgctttcaaatctatcgtgctaaaaacccaacaattcagcaaccatcatcatacaaaagataatgctccctcccctccgttttaaattagtttattctaagtgtgctattttttattattaatttgtaaaaatccatatggtttaataacttgtgaactatatattacgtatttctcagtaaataaaaatatatatctgttgacgaaaaaaatcgaacacaccggcctgggagatctgcttagctcctgtgcagatccaaagattgatgagatacgggcgtgccagtcagtttgatcttgcaactgacaagatatgcaaatagcagatcaaaacagccgatcggctaacaagccgatggagtagttccagccgatagccgataacagccgatgccgatagcgatagggtttaagcaatcggctatatatccaatgtagataatgatataaaggcaatcggctgatgatgatataataaaataacaatatagtcctgtataaaccaatcggctagcaatgatatgataaataagcaccgatccgagggttaaagcacacatcagctggaggtccgatatcatgaaatccacaagattagattaaacaatgaaacctttattgtcatcggctaaatccaacttatatgtatatgcaatcattatgagccgatgcaacatccagataactcaccggctgaaaccccgatgaaacccttattggcaatcaagaagcaggctagagattatggttctaagcatgacttagtagatcaaacttaactgatgcaacactaagtatgaaaagaaacataat

SEQ ID NO: 608 - DNA, 5445 bp, Oryza sativa; identical to SEQ ID NO: 250

SEQ ID NO: 609 - DNA, 8100 bp, Oryza sativa
atccttggtggtttttggccgcgaagaaaattccgaattcttgtagtgttgggacgtggataggctttgtttatgtaagatcaacccctttataagagctataactaattcatcgagacaaccagcacacaatcaatcaaagaatcgttcttataccctttttctttacttctacccctttaaccctagttcatccatcttcatcaatttgcattgaaagccatccactttttgcggcgagagtacgaaatcttttataggtttgtcccaaaaatcttccgttccgtccatgatatggttgtttatccccaaattaatctaaattggttctgctagcctattttgattctatcaccgccaagatcagaagccacaccatctactttgggcaatggttcaagatcaagaggcaccactacttcatctacatcaacaataccggaggctcgatcggtttgtgtgtcgtcaaatagtcttttgtaacacgtatatggctccagcatggattcatgtccagctaattattgcaagcaaaatgagatgtgttgagtcctttcctatcacttacatgacactatacatattaatttttagcttatatgcaattctatagccagtattatgaatggggagtggtacctattttgagcaaacgatgaggtgtacaatatcgtactggaaaatgtaaaatgtacttatcatgagctgtagccgcactcataaccaatcaataactggcacaaggaaagccatggaacatctttacatggtctttcttgcggcatggttttaaagtagcaaattcgtgctaccgtatatgaacatgtgaccgtgacacaaaatcaagaaatccagaatgaacatggatcctaagcacatgacctcaccgatcgatcaccaccaaagcctttttccatttgtgtggcaataataattaaagttttgtatagtttagtacatggcgccggcgggtaattaagctgcagccacctgcatccgatccattcgtgcatataacctaaccacccatttcgccttctctccactctctctcctctccctctctctctctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaagtaagcaatccatcggatttataagtatatatgtatatttcccctaatttaattgtagtttccttagttgttctcggatctgctttgaagtctccttttgttcttgatttatttttgaaagaactctccttgttctttcacttgataggtatatatatctggttctggtaatctttcatccttttaagtttgagacgtttttatcaacaaaatgacccaagtatatgtctgatcagcttttcatcctttcaagttttgaggcatttttatcaacacaaagacccaagctaagcatatatgtatgcatggctattagtcattcttgtgatcttttagtaagctatagctacatagcaatcaatatgtatgcatatagtgtcagtttaattgtgatattttccctccgttctcgaaaacaattgacacttggcactactaagttttgatcactccttttctttcaaaaaatttataaacacttaaaatatgttatattattaaagtatgtagcgtagaaaatataaccatacaacttccattcatcatcatataattatttaaaagtaatttgtgatcaaagtaacagccgtagtactcaaccgtgtcaaccaagtcagttattcaagaactgagggagtaaatattgaatgcaaaattaatatgaaaattttttcttctgctatatatcctttttcagcgtacgtatgttcactcttctgaattgattacaacttagaaactcaaggtggatatatagcgaagaaatattaacatgttaacgtttaataaaattagatgaatttgttctctttttttttgtttcaagtgatgttgatttgtaccaaaatcagatggcatgtgtcacggtcaaacttattaattaaagagatttagcatgcaatcttgacaatcaaatctttacagagaatggcatttctatatatgaagccttacatgcatgtgcataaatatttttttggagctagagtgtggtagctttacgtgccactgcatcaaagacagatagatatttccagatttttaaatatctatttatctgtgtgttttgtctaagtaaattgaaggttttttaatataagctgtatgttttagctaaaaatgaaacaactgactcaaccatttggctttacttgcatgctagcatgaaaactgtgatagaccggtataccaacgcaaaggaggagctacttggcgggaatgcaacttcagaaattaaggtatggttaagaagataagctatcttgttaattgttactatacgagaacacgcatgtgatcttgatctgacgaccaatgacagcttttagtctctttaagattgattttataaataagatgctgattggccaactagttaaagtgctgaatgcactgtgttctcatgcatgcatgcagctgggcatggtgcactgctcacgctgaagaatatagtgagaaattatttctgaacccctctggctgatgcaggcatgcagcaggggttgttactgaattacatatacattgtttactgtatatatagacgcaaacctttttataaaaaaaattcatgagaattttagatgttatcatttctaggagttttttttttctatatagtcctttttaaatcaaaataatgaattatatgaaatcttacaaaattcctatggaatgtctttttctcgtataagttttggaggaattcttgtgtttttccaatggcataatcaaacggtcatttatatatttttttcatgtgttttgtaatcatctgttttacacttagacttgcatttctgtgattcaaagcgccctcaacattttcctatcttctccttccagatgccatatataaaaaactgatgcgtgttgtgcctaatgctgatagtaccaactcctataactggagaactccagcaaactcccctcaaaggagctgaatatgcgcacaatatatgcgcacaatccgatagtacagaatcttctgaacttgaggttggcaagagctgcaagccacgcatgggccaaagggggcagattgctgcaggttcctagattaggacactgggcccaaccataatctaactaagcccctgcaaactcctcaattatcaagcgtgttctggagcaggaagaagcactagtcgatctccctcggttaatgcatcaacagtaatgcataggacgaaagtaaccgagcaattcgtaatctcaacataagcaaaaacaagcatactttaaacaagataaaacagtgtacaatacaagagcttgcagagtattgtataggcaggagaagcatttgatggtagtgcaatataatgctgtacaagttgcttgaaaataacatgctcaagtcttaatttctcagtaattaactttcttcatagtggccacactggtactcactcccgttactccactacttagcttctcacgttttcatgaaccacacacttcatcagcatctgagggcatcagggcaggccatcctcaagtttgcaaatgatggaaaatccatgcacatcctgacatcgaacgttcagccaaagaagcgtatgaagatcataaggcgattcgcgaaaaaaaaaaggggcagattataggtgcatacgtaccttttggcacgataaggacttcgctgattgcattggtccaagatacagcgcagtaatttcgctgcatcttatgacaaccacaaactcagaaaacaacacccaacacatactgaacctgtctgagtatctaacatccatatttcagaggggggcaaacttactcggtatatttatgcattatgtggcaacttggaggttaaaaacagttggagactcgaaaggaaatctaaaaactgttagaaaatggttttctaaataacagatgccaatagcgtaagcagaatggctgtaaagcaacaaagccagaacaacaaggatacatagcaaaccaagtgatattaacagttaaaagtaccgttgttgctcaattgaccagtaaactcgacagacaattgtaaacataaaaaatatataccttaagaaacaaaccgtctacgcataaaaatttcactgctgctgatggtatgatattcatgttactgaatcatgggggaatatgaagtgatattttcaggagtactagcttatgtactcctttatgaatttcatttccatgtcatcatttatttaatgtttattctttctatatgttaaggaaaaggtcaaaacaagcatccacacctacatggtctcaaagaactgtagtacatagcatgcccccacagagatccttctctttccctctattttgggttcaaaaatgccatcgctcatgaaaaatacaaaaagataccaagcaccaaaaagggataaatctgatttgccctgagtttacattggagactgtactcatcattactacagtataactgttatatcaacaaaatggttgaaaacaaagtcctgattaaagatacaattatacataagtacctcctatgtctatgcgtaagttttgtgccaacaaagtgatcagcagttatgcattatgcactccaatggccagtccataatacagatcagcaaggttatgtctagattttttttttccttagaacacagggaagttcagtgtgcaaatttttcagctaggagtttaggaccaaaggtttaaaagtctaatgatgatgaaacaaccaagctactggagcactagacaaaaacaagtgtcagctgaattgacaagttggtccaaattaatctagaataataagtactgaagactgaacaactataacactctgatgcacttgtgctacgcatatcccacatcttgagatattggaactatgtgaatcagatagcattttacctcatctcaaatgcatatgtgattgagttgtgtgtgatttttggcaacatactgcgtttctagattaatcatatgtatatagttcaaggaaactgacatgattttctttttttgctgatagatttggcagagggaggcagcaagcttgaggcagcaactgcacaacttgcaagaaagccacaagtaatcatctaatgattctgcaatggaaattgatcatacattaatataaaattcatcaagaaagtagtttatcaacaatttaaatgccacatggaattgtataagaaccaccaaaagatgcttaaatacttgaaggaaaactttaggaatataatcagaatattcactgtcagatttatcaagaaagtagtttatcaacaatttaaatgtcacatggaattgtataagaaccaccaaaagatgcttaaatacttgaaggaaaattttaggaatataattagaatattcactgtcagatttattttaatagtattcctaagtttctttaacaaataagtttggcctgtctcaaaccatgtcgacagaagagagctgtagtggcatatagattgggacttcttgaactgctgagattactcttttgcatggttgtaggcaactgatgggtgaggagctttctggcctaggtgttagagacctacaaggtttagagaataggcttgaaataagtctacgtaatatcagaatgagaaaggttatattccttgtgctcttcaatatccgtatttttgcttttgatttgctataggctaatgatgatacagtaaacacctatcaaacaggacaatcttttgaaaagtgaaatcgaggagttacatgtgaaggtttaccccttgcacttaatgtcatttcattatttcaatgcaaaagaacatgcatggaatattgtgaattttgtgtactaaatattaactttacttcagggaagcctaattcaccaggaaaacatcgaactttctagaagcctaaatgtcatgtcgcaacaaaaattggaactgtataacaaggttcgatgcaaaattctcttagaaacttgtgactacatgttaacacattatcccaagcaactaaaggaacaacttgatttcagcttcaggcctgtgaacagagaggtgccacagatgcaaatgaaagttccagcactccatacagctttcgtatcatacaaaatgctaatatgcctcctagtcttgaattgagccaatcacagcaaagagaaggggagtgcagcaaaacagctgctccagaactggggtaagtatttcttatctagaatacataaattgcattactcaaagaaggggaagctcaatcaagcacgtatgttttcatatgtagcagacttcatctgccttaagactatgccgtacaagctggacgataagtgatcaatttcaaacaagcacaaagcctttcagatgcaagtagtatttttgtgatagctgagacaataaaaaagtgtacagactacagactggacagattatgttgtcggatgctcatgtaatgactgtggtgtaataagaaatacgtagtataagtttgtaaccctgcttactctctattgctttctagaaaagctcaaccaaaactctgaaaagtctttggactgaaaaggttgtaacaatgtttaccaggaaggtgctttggtgatgaaaaaagagttgtcactatgcctaagaaggaaggggtgtgagctactggcgaaaactgttatgtattgcacatggtgaataatggctgttgaacatgtctactcagacttaacagtcagcccttactcatggctgttcaagtggtgttacagatgaaggtgcatccaacccaattcaaagcagcaacactcatactggtgctgcaaataccgtgtatgctagagagaggtggttggatagaaggcccatgtatcatgtcatgtcattgattcacaatttcacgtgtcgcaacatttattattagtagtattctactgcaagtctgcaactaagaaataaatcttctgttaaacatgaacggctcctgatgcaatacactggagttaaccactaaaatctcagcaattgaaagttccacttagaaaagcccataccacattaaaatggtaatgcctgtatttaattgattttgaattaaaagtggtgctatcaactttgagttccaaaactaattatttccaaagaaaaaggtaattcaataattaccatcacttggtatagattggtcttctgtgacaaccacggaagaattacacaatacatataagaatgagctacatgagtttactgtcttacttgtgagaggtcttacttgtgcctttcttgcaagtaatgcagttgttgcctcatgcttggtgccaccatgtgcaataactagtcaagcaaaatataaaaaaatatatatatttgagaaatgcacattgagtgacctacaaagcaataagcacagaatatagcgtagctgctacttgaaaattgaatcagtcataaacaaataattgcctatgctcgaatggattctagaatgtcgataaacggcacaatgctaaatactttaatgggtcatcagcatgaggcaaattcagctaacaaaatggagcatgcaaactggccaatctcagttagtttatttcttttcccagaatacaatactggatcaaatcagatatttgagtacgaactat

SEQ ID NO: 610 - DNA, 3739 bp, Oryza sativa
gaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattcttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaagcttaagacagtggaataaagcagagagagaaatcaaagcaagaaagagagagaagaagcgaggcaagagtcaagaccatctcccatggccagtggtgatagtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgccgagcggggcgaagctgctgcagatcctgaacgtgcgggtggtggggagcggcgagcgggtggtggtgctgtcgcatggcttcgggacggaccagtcggcgtggagccgcgtgctgccgtacctcacccgcgaccaccgcgtcgtgctctacgacctcgtctgcgccggcagcgtcaacccggaccacttcgacttccgccgctacgacaacctcgacgcctacgtcgacgacctgctcgccatcctcgacgcgctccgcatcccgcgctgcgccttcgtcggccactccgtctccgccatgatcggcatcctcgcctccatccgacgacctgacctcttcgccaagcttgtcctcatcggcgcctctccccggtacgctcgcttccactgatgtgaatcctttctcgctcttaaaattgaatctgatcgggggcgatcggggagcacggacatgtgtgtgcaggttcttgaacgacagcgactaccacggcgggttcgagctggaggagatacagcaggtgttcgacgcgatgggggcgaactactcggcgtgggcgacggggtacgcgcctctggcggtgggcgccgacgtgccggcggcggtgcaggagttcagccgcaccctcttcaacatgcgcccggacatctccctccacgtctgccagaccgtcttcaagaccgacctccgcggcgtgctcggcatggtccgcgccccctgcgtcgtcgtccagaccacccgcgacgtctccgtcccggcctccgtcgccgcctacctcaaggcccacctcggcggccgcaccaccgtcgagttcctccagaccgagggtcacctcccccacctcagcgcccccagcctcctcgcccaggtgctccgccgcgctctcgcccggtactaatccaacgccccccgcacgccaccgcggcgcgccgcgcgtgcgcgtagccgcagcgacgagtcaaaacgaaggagaaaaaaaaaaaccaccgcagctgcggctacggtacgtgtggcccagtagggggacacgcatccctctactgtttttttttttttaccgcgtcggattttactgcatttttaccctcctcttctcaggcctagaaaatatttcggcgcgacctgccaagaccgagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtaattttttcttcgtagtactaatatgttcaattaatttaaatcgtatcattatttgttattaacaaatatataacgatatttactttgttatatagagaatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacggaggaagtatgttcttgctgagagattcctatgctctaaccttacctacacctgccatctcaaaaatttggtagcctttcacacggataaaacgagatggataaaaagattgctctataaaataagagcgggtacaataatgaacggtattagtttcacgtaggattttgtgatgaattggaggagaggggggaagagagagcgcccacgactaatttgtcgc

SEQ ID NO: 611 - DNA, 4747 bp, Oryza sativa
aatcatactacaaaacgaaaggacgtcctatctgctgcggatgagttgattccgttgtcgaatttgtctgaatcattggctagggatgggctaatattgtctgaatcattcgacaacagccgatggctcttggggactggattgtgacttgggagaagtttcaaactttccatccttttccaagattattatagctacaggttctcagataaaaaaaaaggattactgttactgcaactagccttgtattgttctaacaggcccgtttatatatcttttaaattacgtagagacactgcctcactattattattgtttgtcactgttcgatataaacagtgtagacgcattaccgattattccaatactgcaaacagtccttggattccattccttaaatgccaacgattcctggtccaaaacactccaaaacgaaaccgaaagaaattcagatttaagcaggtcatctccactgcacatactactcaaagagatgcttaattatcaaaagagagtaaccatttccttcttgttaaatagattaatctgatattttagaacaactttcatattgaaaattttcgcacaaaacacaccgtttagcagtttgaaaaatgtgccatcaaaatccaaaacgaacggggcctataactgcatattctccggggaaaaatattgaactggaattagccattgttcaaacaggcccatttatacatctctttcaaattacgtgggcacactgtctcactttgttttgtcattgttcgatataaacagtgacgtattaacgattattccaacactgcacacgatccttggattccactcctaaaatgccaatgattccatttccaaaaccatccaaaacgaaaccaaaagaaacacacacaaccaaatctgtaccactaggcaggtcatctccactgcacatactactcaaataaatgcttaattatcaaaagagaggaccattttttttcttgttaaacaccaatagtactagtaggtttatatttgtagagtactaggtaactcccttcaactatatacttgatttaaagcacgagaaacgagccaacgaccgaaggaggccaagtccaaagatggcaacacaagcgattgcaccgatgcacgccgccgtcgtgcaccgccaccacgttctaccaccccgccgctgcgtgcgccgccgtggcgtcttcgtccgcgcctcggccgccgccgccgccgccgccgccgagacggacacgctgtccgcggccttctgggactacaacctcctcttccggtcgcagcgcgacgagtgcctcgactccatcccgctccgcgtcaccgagggcgcgatcccgcccgacttcccggccggcacctactacctcgccgggccgggcatcttctccgacgaccacggctccaccgtccaccccctcgacggccacggctacctccgctccttccgcttccggcccggcgaccgcaccatccactactccgcgcggtaagtcgcgccgcgcgcatgcagcagcagcaggtttgtcagtgagagcgacagactgacagtgcacgcgtgagtgacgcatgcaggttcgtggagacggcggcgaagagggaggagagccgggacggcgcgtcgtggcggttcacgcaccgggggcccttctccgtgctgcagggcgggaagaaggtgggcaatgtgaaggtgatgaagaacgtggccaacaccagcgtgctgcggtggggcggccggctgctctgcctctgggagggcggccagccgtacgaggttgacccccggacgctcgagaccgtcggcccgttcgacctgctcggcctcgccgccgccgacgacaacaaggcaacgaacgcgtctgcagcacgacggccgtggctgcaggaggccggcctcgacgccgccgcgcgcctgctgcgccctgttcttagcggtgcgtgacactgtaccggagcagcggcctccacttcgatcgattcggaccgaactgatatgacgctggtgcgcgcgtgcgtgcgtgcggtgcaggggtgttcgacatgccgggcaagaggctgctggcgcactacaagatcgacccgcggcgggggcgtctgctgatggtcgcctgcaacgccgaggacatgctcctcccgcgatcccacttcactttctacggtcagctcgccatcgcctcgaccaaccacgcattttccattcgctcctccaaaaaaaaaaatcacattgaacggcgtttccatggcagagttcgacgcccacttcgacctcgtccagaagcgtgagttcgtcgtgccggaccacctcatgatccacgactgggccttcaccgacacccactacatcctcctcggcaacaggatcaagctcgacatccccggtaaggaagagaaaacaaaagaaaacttgtccatggaatgatggaatcgtgcgcgcactggcgtctgatgctgacgtttggtatgcttggttggtgccgtgttcgggcgtaggatcgctgctggcattgacgggcactcacccgatgatcgcggcgctggccgtggacccgagaaggcagtcgacgccggtgtacctgcttccgcgctccccggagaccgaggcgggcggccgcgactggagcgtgccgatcgaggcgccgtcgcagatgtggtccgtgcacgtcggcaacgcgttcgaggaggcgaaccgccggggcggcctcgacgtccggctgcacatgtcaagctgctcctaccagtggttccatttccacaggatgtttggtaaatttcaacgccacaaaaaaaaaaacagtaatccatatttgctcgttcttgcatttgcacattgctggaacacaacgatcatcgagtgatctgcatcacaggttacaattggcaccacaagaagctggacccgtcgttcatgaacgcggcgaagggaaaggagtggctgcctcgcctcgttcaggtggccatcgagctcgacaggacgggagagtgccggaggtgctcagtcaggaggctgtccgatcagcacgccaggccggcggacttcccggcgataaacccaagctacgccaaccagaggaaccggttcgtctacgccggcgccgcgtccggctcccgcagattcctcccgtacttcccgttcgacagcgtggtgaaggtcgacgtctccgatggatcggcgcggtggtggtctaccgacgggcgcaagttcgtcggcgagccggtcttcgtcccgaccggcggcggagaggatggtggctatgttcttcttgtagaggtaagacggagtgcccgttccatcaacatgaagtacgagtgttttgttttttcttaagatttagtacaaatgtttactactgaattaacatcaagacatgtgatgtctctttgcttcttgacagtatgcagtctccaagcacagatgccatctagtggtgctggatgcaaagaagatagggacagagaatgcacttgtggcaaaactagaggtgccaaagaacctcacttttccaatgggattccatggtttctggggagatgaatgagcatagagcaagcatcagatccagtctaactctggagagaaattgtcttgaaaaggcaagaattttgcctcgtgtattgataaaagagagttttgtgataatctgtacatggtggagaggaattatcaggggaaccaaataactactgtacatccagtctcggaatgaaaattcgtctcaccaattcattaaaatcctgaaatactaatgttttaaggcaataattcatagtattcccatagggtaaacatataagacctccactgagaatcttgatgtcttggcaattttaaaatgaaagttcttgaactgacaactaagaatgataccatccatgatcttaacccattcgacaagaatttaaaaggctagaacatatcctgtacacagctaacagaccaccaaatgtgaagtcgacgaatttttggcatcacttaatgcgagccacagtcaccacaatgaagacgaacactgcgagcatgaaggacattctcactgtatcgtcatacaaatcatagtcctcactctgagcttgaaagagcatgttcacaagcttaagtatgctctcaaggaattccttgatctttgcttgggtggtttccatgacccacttcatcactccaggagaagcagaagaacttccattgggatcagcctccttagctgaacgaaagtaccaaccagattaatatcgcttatccaggcccaaattgatcttttattttattattaaaagatgtacttaaaatgctaaagctaaaagccacataccatcctgaaaggacttcctgaattcttgcaccacctcatttttcatcacggcatcccatacagacttatcagttgacaaggccataaccattttctgcatgttgggagatgaatgttaggcaaagaccgaaagaataataggtcatctctggaaaataatatttggtgctaccaaacaaacaagttcatcattgctatacataaataggaactgaatcaaacccacattcacctggacagaagaatctacttgcaataggtggaatgcatccagcacattccgatgttcccttgtcaaaagagcagttgagttaaggacaagcatagcaggttcaatacattcctctgatgcagtgtctggtgtagagtgttctaagctggctaattggtcaatcttaacatcagatggagtagaatcctcaatcttaata

SEQ ID NO: 612 - DNA, 7277 bp, Oryza sativa
tttcagaggggaaaaaatgtaactcattaataattttgccactataattttactgttcgctcatttcagtcgctaaaaattagtgctagtccaaattaaatcccaatagatagatagtgcaatttgatttattataataaaactaaactatatggcattatatccagatggttcagaccaagttggtactgttcaacttaatgaaactaggaataaactatgatactataacttcgagatagttcagacagacttggagcgaattaactaagaatatacttgagacttgagagtgaacaaagctttgtcttactagtgagattatagttagttacgcgattatcttggacgacactgattaatacttcattccaagttgacacaagattggataaaaaaaactcactccatgtagagaatgttaattaaaatatctaaccaagctgcctggatcttttcgccagctgaccaattaaaagaaggaagcatcaataaaaaccaaagcccattagagatggacagctccttgtccatatatatactccctctgtactcgtaaaaggaagtcgttttgaacagtgacacggtctccaaaatataactttgacttcttgtttttataaaaatatttattaaaaagtgatatatgtatacttttatgaaagtatttttcaagaaaaatctattcatataattttcacattttcaaactcaacaacttgagagttatttattatttatattcctaaggtttgacttaaacattgttctaaacgatttcttttacgagtacggagtactgagggggtatattccaattagctatcaacatactaattaactatcaaccttaataaaaacataattattagacactttgattccttattcccaccacaaccaagatgccctctccatgccatttggtctcttctctctccctccttgcaaattgcatgaccctctctctctctctccacttctctctataaaccttcctctctcccataacttctttccattttcaacctacaaatatactaatctctctctagctagtcttcacctacaaatctctctctctctctctctctctctctctctcttcatggagaccaccacgcttgtgctgcttcttcctcatggcggcgccggcggcgtacggccggcggcagcggcaacggcgaagcgaagctacgtgatgaggaggtgttgctcgacggtgagggcggtcatggcgaggccgcaagaggcgccggcgtcggcgccggccaagaagacggagacggcggcgatgatgtcgacggtgcagacggagacggcggcggcgccgccggcgacggtgtaccgggacagctggttcgacaagctcgccattggttacctgtccaggaaccttcaagaagcttctggttcgtgcctataatctactgaatatatctgatgtattgtgtgcatgtacatgcaatctttcggatgaattaatgaatgatcaaatcaaccatgcatgcatatatgtgtgtatttatgatgtttttgccatggctgatttgattttttgagtggaagaaataacatatatatggtgaataaaccaatgttcttcagttatttttgtgacaattaaattatatgtgtattctacgatcatccttttcttcttatcgtttggttattaatacccttctcgtccatgtggaacataaattctttgattttttttattacatgttgctttggccagcgtgggtgtacttgcaattgcatgctttctgtcatattataattgaattagctcttgatttttacatgcaaaagaataatttatttattgagttgctgatgatcacgtaagcctatgcatgtgagatgtgatgtgttctccggcctaattaagtatcgacgtactatatatatgcacgtacatcaagtacggccgtatttcataatttgattattgttactgtaccagacaaacctagtgcttaattattgacatatacccaacatcgattaaagtcagtgtgacacaattggcagaagaagataacaaaaatcatagaagacatatataccacaacagtaaaaattacagtgcaaaaagggataccagaagcttcttaattaggtgaatggtcacatttagtagtagtaatacacagtaataacacattatttgacgaataaattaagcggaagtgcatgatcagcagcatataagcaagcaactacgagaggtcaaccgttgatccgtgaaaatgtgaggttcacattctaggaatcttttagtgcttgaatctaatcctttcgtttgttttcccgtggactttttactttgatcgaataaacttatctgaataatgcgaaggtcaaacatcacatgtacgtgcccggttcttcttctagaaattcagccgcttactataatcgatgctggtttttgaatttttttaaagacatttattttggaacaacttaaaaaaagtgcacaaaccagggtttaccaaaccgtttgaagtgaggttactgccactccatggtttggcaattatcacgaggtgcgtcgtggttccaaaaactaataaggttatcgtatgtgataaccgcgataactgacggttttgtaaaccctgcacagacaacataattatatttacaggactgtttggacttcattaacactgtagcatccactacatccgtcacctccttggctctcttacatgtttagcaaagtcaatcatacagacaaaccagaaaagttcccaacagacacagaatgctacttttctagtatgggtaattaagcatataagagaaacttgaaagcatacaggaaaccgatgttcactagtcctgagtttttttttggtgttgttcaggtgcaaattaactgcaaaggttgattccctgaaaggaacttgtagcacttgctgactgacacgaacatgcatgcaatgtaatgcagggctaaagaatgaaaaggatggctacgagagcctgatagatgccgccctagccatctcaagaatcttcagtctggataaacaaagcgagattgtgacccaagctcttgaaagagcacttccaagctacatcctcacaatggtaagtaccataatccatgacaattggcaatcatgtatgaattattgaaatttaaaaaacctaaaacttttttttatttgaacaggaagtaaaattcagcatttattctctcttttttttttgaggaaaatacagaacttctgtaaagggaggaaactttaaaagttctcttcttttatttcttacctcaactttgattgagaattctgtcggcagatcaaggtgatgatgccaccttcaagattttccagggagtactttgctgcattcaccacgatattttttccttggttggttgggccgtgtgaggtatatattacatacacagttcctccttttgttacttcagttcagaaaggaatagctgcctgatacctgattagtgcgtcttcacaagaatgaattcatgattgtgcctctgctgaaggtagccctgcagaatgaattgatacgaagccacacgttaatttgagaaatattgctacagaagatcttaaaatgctgttgaatgtaggttgcgacatataatatctctttgttttcaggacattacattgtttaaagtagttgtacgaagcatttgtggtgcaaatatcatataaagtatggaataaatgcccttgtatggataacttgtcttctgagtgatcattctgtcattgaacaaaggttatggaatctgaagttgaaggaaggaaagagaaaaacgtggtatatatccccaaatgcaggtaattcaatcatcatcaagaaattgtttcacaagtttgactaggaggaacatttgtaaagaaaatttcttcaactgctgggtatcacgtaacatatcggtcaaacggtttcctactcccagctcttcataggcagactacaaaaattttcaggtctataagtagtaacctgatgatttgcaattaacatatgactctgcagccatcaattagttctgaatgaattgttgcagtatgtcaactcttactcaagttaatccactcatgaaaaacaaattgaagaactatggctgggacacaagttgtattgtcaacgtcgtaattgtggcaactgacaatcctactcacactccacaagctgcttattatcaattctacccacgttagacaaactaccatgattaacactgggttaagaaaaaaatagaattttaagtgcagatatatcaataaatactgaagaaccaccttaaaaatacataaatactgaagaacaggatttctactggtgttgctgtttttcttttctttttttttaatctccaatcctatttgtggcagatttctggaaagtacaaattgtgttggtatgtgcacaaacctttgcaagattccatgccagaagttcatccaagattcacttggcatgaaggtctacatgtctcccagtaagcttcctctgctctgattcatcaggaaagcctgaatatcagtgggtaaacacaacaacttaaatataatttggtagaataaggtaaaaataatcaaactccattcctttgcataaagttggcaagaaactaataatggattgtcatatcaacatcatctcaaagttgaaaatttgggttgaaacctggtgtgcctctaacttctcaggacattgacctaattttactatagcggatcattatacggactgccgctaaaacataagtgaactcaaaatatcaactttcgactttaagcagaattagtgaagtaaagttgaatcaatgtaataggtccatagaccaccaacggtttagagctatgagaaatacagaacttaatttgacatattaatttcatgccacctctacctaccgacaatctgaggactgtgccctttttgggtatgggaaccactggccaccattcaggaaacagaaagggctgaagtggggccaacatgtttgcaggttactacctccgttttttaatttataacgtcgatgactttttagatatatatgatcattcgtcttattcaaaaaaaaatgcaattatcatttattttattgtgacttaatttatcatcaaatgttctttaagcatgacttaaattttttttatatttgcacaataattttgaataagatgaatggtcaaatgtttgtcaaaaagtcaacaacgtcatacattaaaaaacggagggagtacaaagcaatcacaagcaagttgtacagaagaagaaagtgctagcccctacttgtcattcttagtgggaaacggcaaattgcatggacaagttgtggaacagtagtgtgaaatccagaaatccacaatgtagtgctgtgaaaatacagtacaagcaccttcacatggcagtgacgagccagcatgtctcgataatcagagcaatatggttcaatttcacttatgagaagcactagttttgaatgttagtcttctatggtgatacactgaatatttcaacatcaatcattttttctaggtcaaaagatactgatattttatgacatcaccccacagaatcagatatcaacctctgttggaatttgcaaggctctctttcctttttatcctgtcgagtggttagatctaggagtaagcaatgaatgttatttactgccagtgctactaaatagtcctatacagcttatttccaattaagcaagaaggttttttccaatactaggtcaataaaaacgagaataaagcagagtccctaaagataatagtgaatgtatcaagagaaatgtaacataattacttacatcaactatatatttattcttcagattttgaagacatgagctgtgagatgatatttggacagcaacctcctgaagatgaccctgcattgaagcagccatgcttccggacaaaatgtaaggaattccgcactgaggcaccttcatggattcaatcaacactcctctatattcatactttttacttcgtgtatatgcaggcgtcgcaaagcagaatcatggtgtgaattgctccatctgatctgaaagaaattatcaatagatagatttcaaatcagtaaaatgccttaagctccatttcctttattcctttggaaaaaaaattagcaccatcattgtttttgcccacaacaccagcatgtttggaacatacactcttcattgtaatccaaaagtaatctaagaggaaatgaaaggcccaacagtaaccattttaaggtacatctactccatatgttgttaaaagaggaattgaagagcattgaaagcggggcatggagttgccgatttcaaaaagttctaatgttaatcagataaattaaatcgatgcaccccttgcagagacatattctatttattactgtaattgtagaaaatttcagttaattacagaaagatgtgagtggaaaccaagtactatttcatggacgaaaattataatgcacggattcctctaaaagaatttattttaaaactctaactgatataactctcgatccactatcagttattaggggaaatattctatttgtcactaagtattttgaggaaaatagaattctatatatgtatatggctgtctatgcactgtctcatccacccaatgtgctaaaagatttgagcagggacattgaaattattagagatggcaatttttaaagtttgcatgactatcgaggcatatgggacatataggacagtgcctaactcataaatatatgtcagaaaaccattctccacactacatcaggatattagtatgaaatggggaaactgaacatatctacatgtacttctcatcagcttgcattttgtacaaaaaaaaaaccaaaaccaagattgcaatgccagacctgcgggatttttaagttggaaaagaaaatgattcagcacctccagagaggtccatggttctagcaaataccaaaagaaagtagctatctcacatattgattctggagacattggtacaccaattatgacagacttgaccaaaattgtataaagtaacacaactttaacatattgtagaaaaaaaatagttgggatctaccacactgatgaaaccactttttgagacctagagcacttacaggataaattcacataaagaattcaaatgtcacaacaaaatcatgacagggataaccattgctactgacaaggggatcgtgcgccacattactgttctttgtctcctgatgcatgatcgtttccgtag

SEQ ID NO: 613 - DNA, 5934 bp, Oryza sativa; identical to SEQ ID NO: 604

SEQ ID NO: 614 - DNA, 11919 bp, Oryza sativa
ttgccaaatatttgtaaattactttttttttgtttaaatcatcacttaaagaaaactgagagtgatgtggcgcatctccggcctttctggccttgtaatatatatataaagatagaaaacaaatttgcctggaacaataagcccttgtgtgaaagcaactatgtttgatgaaaactagaaaaataagcacatagtatctaacctaacctagtggtactactctacgcgaggtgatagagctagtacgtaccagctagctagccaatcacgatatacaattatacatccgtatgtaaatgattcacaattggattggttaaaattttaatgttaatttatataatttcaaagtattaaatattaattttacgtacaaataatgtgattttggactcgtgatgacttttttatattaatgattaattaataatcaagtgtcgaacacgttttgttaaaaactaagcatatgaccaaactacggtttccagtgtgttcttttctcctttattaactctactttttcatcatccacccacccacaaggacgtttttaggaaaaaaaatttacaaaaactgttttaaaaatcatattacttttttaaagttcttttagctaatatttatttaataatgtactaatctatcgctctattttacagtatttagaaaaagatttctcgaccattcaaaaatacagcctaaatgattcatcttgggcatggtgtgaacatgttccacgattagtttgaaacgtgtatggaaagattgctttcctaaatatctattcaacaaaatcagccagattaaactgcacgaattacgtacgcccaattaattacatgccaaatgaagcaactgcacgccggagagatgacatatatagcaccatgtaaacctgccatatgccaccctcttgcagcccaacccaacccaataaggatataaaaccactcgcggttttgcacagctagcgcggcgcagtgtgtaaccgtccagggtgacacaattgacttataaatcacgcttttaattaattaattttcttcctaaacatatccgctaatcccccatcccaggtggaatataaacccccgcaagagggagaagaagaagaagggcgaggtgagcgaggcgagactcgagagagaggagaagatccagaaatcgcaagctgcacgctatagctaggtagctatctccggggaaagagagagtaggctgccatggagagcttcttcgtcttcttcacggcggcggcgttgccggtggtggtggcggcggcggtgatcgccgggctgtgcattacggcggcgtggctggcgaggccgcggcgcgtggcggaggtgttccggaggcaggggatcgacggcccgccgccgtcgtcgttcctggcggggaacctcccggagatgaaggcgagggtggccgccgcggcgtcggcggcggcgccaacggcggacggggaggagaccgcctccgccggcggcggcggcggtggccgggacttcgagaaggacgggttcgacgactactgcaccaggatcttcccttacttccacaagtggaggaaagcctacggtacgtgtacacaagcctctctcctctctactgctcgatttcacatcactagctacatgcatgatgcttgcttgctttgcctgttaattactccgctcatgtgtgcttaattagcttaattaattcacactccggttaatcaagtcatgcaaaacccacaattaatcagctatcaattgagatgagtatataccagaatatatatacttacagtaaatttaataaaaaaataaaaaaaagaaaagaaaagctctctcgatctctctgtgacgatgatacaagaaatttgtggttgccctagtaacaagttgactagagtataaaagctgctaaaatgtcaagagctctccatataaaaaagaacagtgggggagaataattaatactgtcccaaacagcgagaggaagagagggggcaaacgagaaaagagagaataaacaaaattaatgcaggatggaaaccgtggttgggacgaactactcggtttgcttccagtcaaccgtcctgcatcattaagctatggattaataattaattaactgcagtatataaatatatatactcccccacatatattaatcggtcgttggtccaattagacaacagcaaagccatgcctaggtacctgtctaggtaggctatgactgtagtacactcgtactactcacttaatagcacattagtgctcttattttgcgaattaatgaaactttaatcaataataactatatataactataatatatttagtataatttaacaatatatctattcagcgtgctatcgtttcttcagcctatcaatcaacttaaaaaacttagtgttaaattgattttggtgttttcttatcgtaatttttcttcagttttggattgttttttaagttgctaacaattttagttaacaaagctatttggaaggagaggaataatgcatccatgacaaaagtatatgcttcataataattttcatataccagatcttgcccctggtggtgacgtgttaccaaataccgactggaattaatttcttctctctttctttttctctctgccggtgcaatgaggcgacatttttgagttataactgtgcgtatgaatgcatgtattaattgctgtttgctgaggttaataggctagcaataccgttgttttgggggaccccgcagtttgacctagtagagtttatcatggacgcagactgcccctacctgttcttcttcacggacagcatgattaattagctatactagtggtagtactcgatgtcattaataattggtctctccgtacgtgaataattatcgatttttgactttgacaagtactccctccgtacttgttaaggaagtcgttttagacagcaacacggtctccaaaacacaactttaacttcttatttctataaaaatatttattgaaaagtgatatatgtatacttttatgaaatattttttaagacaaatatattcatataatttttacattttaaaacttaatggaaagttacttttccaagatttgactcaaacattgttctaaacgatttcctttatgagtacggaaaaagtatgttttttcactgttcttatgaagtgtacatggaaagtgatcgaatagctctgagcagtactctaggtagggaattacttttagttgcgtacaaatctaacaattaattaatatgccatttttagtgaacataattgtatattttctccgtttcacaatgtaagacattctagcattttccacatgcatattaatgttaatatgtctagattcattaacatcaatataaatataagaaatgctagaatgacttacattataaaacggaggaagtaatttatgctagaatgacttacattataaaacggaggaagtaatttagtacatcaccttcgtcgattattacgaaaacatccatcatatcgatcgatatctgtgtatttgctactccagaaaaatattttctgagaccgacccacagatgcatatatatgcacattattgtggcggttttcctttctttttagatcaatcggtggcctgacggccggcccagcttcgattgaaattaagctgaataattattgtggccgtcatgtgctaatcacccatataattaggcgtggttagaacctgactaagctatttaagccggtcagttaggctttcccaaaacggccatcaggccatgcatgttgccattagctgtccgagcacgccggccaaagctcaaccctcgtgatcacatcaactcgatctccccgatgcttatccctttttgcaagcaaccggtatgtggtgcttagataattaatgcaagaattaacagtgtacctcctatcaatttgccgttagctatgcatgtaatggattagaaattctatatgcatgttttcgtctaacagagtttgatcagcagcagtacttagctaactaattattctgtaatttatataactactataagctagagtttaagcagagtatgtaagtatgatattttaactaatttagttcttgtcatatggcactgtagttgaaaccataaaccgatcaattaataggacaaatattcaacctggttgcctcactgcatgcgttgttttagtttgacaaatgcatgcatgtgtatgatattttatttgcttggcccttaataagtatattatgttgaagtcatgcatcttgacacagaaacttggagcaaaaactatataatatatttcaagaaccaaagggcctgaatactagtacttgcctacatcgatcacatgatgctagtgtcaatcttatttaaggtttttatttcttctttaatgtcaaaatggctattgtttaactatctaaaaacaccaataattagaagactcccactagaccatctcatgatgcattgcacgtaggatcgatatatatggcaacattaattattttacttgaacatctaatcgcgttcgctattattcaacttatgttacatgttctcccctaatttaagcaaaggccggtttgaccaacgggaaacaaataattaaattgatcttccaggcccagtacttatattaattacctagtcattaactacattttctccatatttaatttgaatgcttcgttctgaaatatttaaaggccattaacactaacacggcacacaagaaattaatttaaatatttaatttggctagcatgtatacatatatatgttgatatgcatggatatatatatatatatatatatatatatatatatatatatgtatatatatatatatgtatatatatgtatatatgtatgtatatgtatatgtatatgtatatgtgtgtgtgtgtgtgtgtgtgtgacaatagctaactttagatatgtttttttttcgatgatacatggtcccggcctctgcatcacaaatgcacacatccaacgaatatcgtacaaataataataaaaaaagtgatgggacaaaactcccgactcctacataagacttaggactagtgagctaagggtgtgtttagttcaccaaaattggaaatttgattgaaattagaatgatgtgacggaaaagttgaaagtttgtgtgtgtaggaaagttttgatgtgatggaaaatttggaagtttgaagaaaaagtttagaactaaactcggcctaactgaaaacaaatcaattgatatttgttttcagttatgccgagtttagtttgacaaaattaaacgaaaccatacaatatataattacaaatcaataattaattcctaatgctgcttgatgctactagcttctctcctacacagtgccattgactaggtaattgctcctaaccctagctagctaagcatgcagctcgatcgaatcgatcgagcatgaaagcaacaggtcgatcgatagatggtaagccatgacgatcaatatgatcatatcatgcatgcatgacactgtagagtgtgtactacgtactaccaccactccaccaaccatgcatgcattcctcccccctctctcttgcaccttttaaagctagctaggacgtgtggggacttcaatatatttcttgtgcattgtctctcctacaaggattccacatggagatgtgcatatgcatggggttacaccaattaaaagtgcagcccacactctatggattgaaggtgctagctagatctctgtactctatccgtcccaaaatataagcatttttagttataaatccagatagatagttatccagattcgtagctaaaagttattatattttaggatggaggtaatatagtttagatggtggaaattaagtctagtagctatggggaaaaatggcaaaaataaaattacagtatggggttgtactggaaaattttcatttgaatatatctcttcacaaatatgtaagcctaaatttaatctaaatatatatgggcacaaatgaattaaaaaacatattttctatgaacatatatagcaggaataatatgcattcctcgattttattcccttcaagtgttcatatagtacgttaaaagtttgggttaaaaattttaaataatttctttagttattttgaaatggtatgaatgaaataagagcgtatacccttaagtcataaaagatcatccagattgaataaaaaaacaaagttaagataattaagtagatgaatgtaaatgtgcatatacatatcttgtctttctgttgactagttgtctgttcagaaattatatggcggaaaccctaactgaggtgaaaattcatgtgtaccaagacaaaaaaagaaagttctgaaatcacacaaacaatctcataagtagataagatgatagtgaacaaccatgtaaagatcttttccaaatttaactttcatttgtcagatataaaatgacaaattttgaatcagaaaatattttttttgtttgaaatttaccctcgtttcttgatctgaacagtaccactagatacacctagctacatgtatggtcgattgtgataggctcacacacatgctatagcttgatggttgtcatggtggttgcctagttggcaaaagttcgatgtccagctgtgctactatcatgataattggcagcagcctagctagctagttcaaggggacaatattacactggctttaataatttcctcgtcaccaccttttacctcaaaaacatattcttgaaaaaatgaagaatatgatcatttcaccaaaaatcatggactggccatgattaaccaactcattttggatggttttgttggattcctcaaaccagacacatcattctctgtgtcgagaatggagatgacgtgactagcttttatgactttagaaacatactccctccgtctcaaaaaataaactttaggtttctgtgtccaatgtttgatcgtatatcttatttgaaaaaaatatgaaaaaaattaaaaagacaaatcacgcataaagtattaatcatattttatcatctaacaataattcttttcgtgcttgtgattgtgagtattggaattcttttaatatatgctgaatatactaatgagcataaagtataacagactaatcaagtatgtgagttattcaatccttggcaatttccaatacaaatacagacacactatgtatggaacttttttatatatagtctattaaacaatatatctttgagccgtctgaaaccaaattatatgatatttttttagttaatcataccaagatcattaattgagtaggaatataagacttcaagggggaatcaacaatattaattgtttctgagaacaattattcaaagcaattcataataaaagcatatttattttaggagtgggtacacacactatctagcttgtaccatatataagtcaatgaccacgatatatggctagccacctccctccatcatgaaataaattaacctcatacgaatttagatatagaatatgtccagatttattgattaaatcctagattgatttattttaggacgaagagattacctgcctgcctgcactaaccatctgcgacgccgacgtgtcatccatcggtcgacaaaacgtacgcaggccaacacatgcatacgtacacacaattgcccatttgcaccccgctccccatgtccacgtcagacggcgacacgtacacattaacacatgtacacgtcgttttcacgtacgagctaagcaaatccaacgtacagaaaatagttaatttacccggttgccaactgggacacgtacgccggccacgtcacaggtctacgtggcgcggtgtgggccgggctaggagggttaaaagcccacgcttgtgtgctttggtcaactcgtgcacttattactctgaagagttattagccggttcgatgtgtcgcgattactgttgtaattaagtctgtctctgtggcgatatgtacgttgacgatgattaaggtggtgtttggatctagagacttaactttagtctctgtatttagacactaatttaaagtattaaatatagactaattacaaaactaattacataaataaaaacttatttgcgagataattttttttaagcctaattaatccataattagaaaatatttaatgtagcatcacataggataatcatgggttaattaggctcaatagaatcgtctcgcgaattagtctaagattatggatagtttttattaatagtctacgtttaatatatataattagtgtccaaacatccgataagatagagacttaaaagttttaggtggtgtttagatctagggacttaactttagtccctatatttagacactaatttagagtattaaatatagactacttacaaaactaattacataaataaaagctaattcgcgagataatttttttaagcctaattaatatataattagagaatgtttactgtagcatcacatatgctaatcatggattaattaggctcaatagattcgtctcgcgaattagttcaagattatggatgggttttattaataatctacgtttaatatttataattagtgtccaaacatccgatatgatagggacttaaaagttttaatctcatctaaatatggttttagtctcatctaaacagggtctaatagcagaaagttacgtgagattcgtatactcgtacgtacgtatttgcatcggaattttcaaaatcctagactctttctagtactggtggtacagtttggcaaatctggttttttggatggtttcagcatgtttaatttgcagtgtggaattgttgagatgctagagattttttgcagaacttatgtgaaatttaattaggcgtttcaactgtggctaaacgtgaagatatagcgcgctagagacgtgtgtgttggcagtgttgctttgcaatttgcataggctcgtggtgtttggttcagaaatttatttaaggatccggttgttttttttttcattttccttggtcaatgttgtaaagaatccgtagaatcttggcaagaagattctcccaaacctccaggaaagaggagaagattctccggaatcagtggaagtagtgcagtagctattgactgggatttttgtaagcccggtcaataggttcccctgtacccttggagagaccctgcaagtgcacacagatcacgtatatatccacatgcctatatgtgcatagatcacataggcacgcatcaaaagctttttaatcctagctagcttactttaatctttgattattttcaatagaaatttaatgacgtttaacttgattcatcattcggcgacgtctcttgaacatgttaaaggctgggccgaggcccaccaaaaacggaggcccatgagcaaatttcaaattctgactcgcgcgcggtggcggcaaaattttgcaggcgagacgtacctgtactggctgcggcggcggccggcgctgtacgtgacggacccggagctcatcggcgagatcgggcggtgcgtgtcgctcgacatgggcaagcccaagtacctccagaaaggccaggagccactcttcggcggcggcgtcctcaaggccaacggcgcgtgctgggcgcgccagcgcaaggtcatcgcgccggagttctacatggcccgtgtcagggccatggtccagctcatggtcgacgccgcgcagccgctgatcgcctcctgggaatccaggatcgacgccgctggaggcgcggcggcggcggaggtcgtcgtcgacggcgacctccggagcttctccttcgatgtgatatcgcgggcttgctttgggagtgattactcgagggggagggagatcttcctccgcctccgtgagctgtccgggctcatgtcggagaccagcgtcatcttcagcatcccttcgctgaggcacctgccgacggggaagaaccggaggatctggaggctcacgggggagatccggtcgctgatcatggagctcgtcagggagcggaggtgcgcggcgagggcggcgagggagcacggcgggaaggcggcgccgccgtcgccgccggagcgcgacttcctcggctccatcatcgagaacagcggcgggcagccgcggccggacgacttcgtggtggacaactgcaagaacatctacttcgccgggcacgagacgagcgcggtcaccgcgacgtggtgcctcatgctgctcgccgcgcacccggagtggcaggaccgcgcccgcgccgaggtgctcgaggtctgcggcggcgacggcgccgccgcccccgccgcgccggacttcgacatggtgtcccggatgcggacggtggggatggtggtgcaggaaacgctgcggctgttcccgccgtcgtcgttcgtggtgcgggagacgttccgggacatgcagttgggtaggctgctggcgcccaagggcacctacctgttcgtcccggtgtccaccatgcaccacgacgtcgccgcctggggcccgacggcgaggctgttcgacccgtcccgcttccgcgacggcgtggcggcggcgtgcaagcacccgcaggcgtcgttcatgccgttcggcctcggcgcccgcacctgcctcggccagaacctcgcgctcgtcgaggtcaagacgctcgtcgccgtcgtcctcgcccggttcgagttcacgctctcgccggagtacaggcactcgccggcgttccggctcatcatcgagccggagttcggcctccgcctccgcatccgccgcgccggcggtcaggacgccacgtcacaagttgacacatctactgcacccgtgcatagttctcataattaattggcttctgtaaacagctagtaagtcgtgaactgaaaaaaatacatcacacatacagagacaacagaggattaccattttaccagcatacatccatggcataccaaaacaatttactatacattataattaacatgatgctatacacagtataaaaggacatgcatttttctgcgattaatggattaagccgattaactgtttgtcaagtgattacagtgtttaattcagaatctagtaattaatttgttgaatttagatagtctgtagcctgttcctctctgaaagcaacagagcagagcaaaaggcaaaatcaagtttcagaagcacatggaaaagtatgatttctttggcaaaattgttgtgccattctcttatgctataggcctgtggttgagtgagcggccgtttgattgggacgccgacgaacaggtgtcttttcgtttctgctttctaatttctggcactaataaaaacatgttggttgctgagttaaaatcaccaaagtggagtggagatcgcgatgttatcctgtagacttgttgtatctggtctaatggtctctgtaagcaaaacgatcagaagtactgaattagttcaattttttgatagacctggtatggtcttttaaattcaacttttgaaagtacagtgaaatacaaatctagtgatgccatattgtgggcttgtgtagtataaattgtgaatcaagcctacggaattttttgctgaaatacagtacgtgcctgtcttataagaaaaacctgaaccgagaagccattagcgttgtcacatacgacgccacgctcggtgactcggtgagccagcgtgtgcaccatcagctcgccagcagcgcgcgccaagaaagaccagcagccatgtcggggtccggcgacgccgcgccggcgcggcacaacgcgggtcacggtcggcgacgacggcgcgtcctcgtctgggccagcttcgccgcgctggtcctgctgctcgtcgccgcggcggccgccatcgccgcgctcgccgtgctccggccgcgggacccgaccacggagctcctgtccgtgaacgccacgggcgccaccccgcgcgtc

SEQ ID NO: 615 - DNA, 7669 bp, Oryza sativa
tccaaagaaacccttatgaaatgagacattgtaatgaattttgtgaaaaaaccagcatgagataagatatcatggtttctattgcttgagtctcgaatttctacatttttaatgtatgttatcaaacaacatatttttgttgatttatgtggaccacaggactcaacaacaagggtgcatttatttaagcatctcgctaaaacttaccggccacacacaaaaccgcacagaacattagtgcacgattaattaaatattaaccgttaaaaattttaacaacaaatttctttgtttttttcttaaaaaaatttctatataataatttttccacagtttgataaacgtgctaactgaaaccaaaaaaattatttcaagttgctaaaaaaagaaaaaaagaactcattcggagtgtcaacgaaagggccggactagtgtacagcgtggtccgccacgaaggcacaaaatcactcgcaatcaaaacgtcgtcacctacctactctaccatcaccaaaacatattttaagggcatgtttggcacagctccagctccacccctcttgtagctagagctcagccaaacagtttcagctccaccaaaactgggagtggagctggatggagctctcttacaaaatgaactacagttgtggagttgggtttagtcagcttcacaattccactccagacccaactcctagagctaaatttagaagttggagctataccaaacaggccctaaagagattaatgatgagagaagagcagcaggatacatatttatagctacctgtagcatggactcaagacacagtgtatgtataacaggtgggaccagatattaatagtatagtatgtaactattataggaatgtgctattagattggctatagataaattgaagctattaattggctatactattaaacttgctctaaaaagacacgagcccctaaaaaacgtagctccaccccacccggcccggcccacatccgcaccccgaccaaaatcccccatccgccgcactccacgcgcacgccaccgcccccctcaccccgctgccgtgctcgtctcgtgctccccctctcctccgcctttagtcacctttccccctcactctctccacgcgacccagatcgatcgccgagctgcacctgcacctgcaccccgaggagaggagaggagcaatggcggcggggtaccgggcggaggacgactacgactacctcttcaaggtggtcctcatcggcgactccggcgtcggcaagtccaacctcctctcccgcttcacccgcaacgagttcagcctcgagtccaagtccaccatcggcgtcgagttcgccacccgctccctccaggtcgacggcaaggtcgtcaaggcccagatttgggacaccgccggccaggagcggtacgcccctcctccctccctccatccccatcccatccccacccctctcctcctctccccgccgctgcgagagtagatccatgttcttacattcacgtgggacgcccgagcggtttggatctcgccgccgccgaattgcgttgcgtgtgtcgacgcggttagccaagtgcgtaggattttttttgatgttggtagatcttttgctcgatccccgaaatggaaagggtttgactcgtttcggttgtggtaaatggtttttcagtgttttttttttgctttactagacttatcatgcttgattgattgattgattgattgattgattgctggtgctgtttgtgtgaaatgagctcgtcaagtcgagttgggttagctccgccaattctctagttcatctactagtgtttggataaagaggttatccttatttaattgttagttttggtgatggtatcttgaacccgctgtgtgtttagatcgtcctatacaatcgtggaaaactgtccaaactccacagtagggccttttttgcattgtttctcttgaccatcaatagttattgtgtggagagaagagcaatagggcttgtgatgcatgcgcgaatttatttagaaacatggatgtctttgcccaactaaaataacttcttgtgaccagaaagtgagatgactgttttcaaatatttggaggaaggttttaatattgagtcgggcactagcggttataatgctaaaaataggtactcaatgcatctctctgctcagcttcgtacaatattgaattggggggtgattattgtaaagacaaagatatttacttatctactcaatacatccatttgattatagagcttctgttgccattttcattacatttccttatatcattacaattttcatgcttaaaaactcatgtcctgcacaccaagcgattcccatactactggagaaaacattgcaagcatttttgctgagtatggttgactaattttaggactaattctagctgatggttggagtcgctcgtatccatccattctgcctttttgtgcagttgtgttgaataatagaagcccttgtttactgtgagctggtagcttggtttacctcttcttttagttttagatagagaacctgcctatacttacagttcatgatcctgcattatttttcccatgttgtcccatttctttattttcagtcctcatatatatagagttatgtttttatgtgctttcacttctataattaagcatgtcagtcagttaataatatattcttcattatcacccatctctagttacctgttaccacaatttgttccgcattaataatgaatagattaggactactgcatatcctgtctagatctcaccatacatagctatcccagtgcaccatgtattcaatcaactaaaactctactactacaaaagcataatcgtcctcctcctaagatcctacccacacacttccccagaaaaaaaccaccacccagaaaaaaactggccctctatgggcaaccattggcccgtagaaaactgagcccatagagcaattgccccatcttctcccgtatcctgttgcaacacacatgcatgtccctagtaactgcaaaactcacacaaactctaggctgaacaaggaaaatatccaaagtatgattgatgtgactcatagtgatgaaaaatcattccattgaagcagaaaaagggggagagtagtgtatctcctctttctgggtgaagttttggctgtgtttctcaaagggcgacactgctttgtgccttgaaagcactatcttctgctactgcagtgaagaactgaaaatagccacgagggcacatggcagttctctttggagggtaggggctttttgttggacatgggaattggaactttcattggactcaaagtagtgattgtctggaaacatggttttcttgggttcattttgatgctatctgttgttaggacttctaatataactgtcttgtaaaagttggagcattttaatgcggatgagacatgagaatataccatataggcatagcgatgtaatattggacaggtgcttgcaacagtaatttgattacatgcagcagtagaaaattcattttgcttcatcaagacatgagcaatgttcaaataaaactaaattttgttgtgctgttctttttcttctataagccatcagtcagtaattttttaggggatattcctattgttctcttgcgtactttggtatattcaactgaataatattggattgcataccctgacctgaagtagcaaatgtagtagggagctagggatagctgatgatttgctgctccccaataattgcatttgatggctttactatgaaccagatgtcagtgaggcatagggtggcacatcttcattaccaccattggtgattggcaattttgaaatcacccatagtattatatgatgtgtcacttaacataccaaataagtgctgatgttttctatgcagaattgcattttttgctgtccactaccacaacctgtttatatcaaataaggcacttgaaccacagaagttgactaagtcaaaagtttcagttccagttggcagtaggactgctatgctatagtattacttggtgcaaaatcttgcagttttagcttttaacaatgctacaacatgtggagattgcattcctgatagcagccattcatggcacaaatacactttacccaatatcttttaaaaaaaggcacatgtatgtttgtgcagtatggatttcgaaagaagttatgtttggtcatggttttgatatggatgaagtccatacttttcgtcccaaagttcatttttcggactaaattcagaaatagtccacttctggtctttgaacttatgcttgaagtccattattcaccctcattgctgccactatgggagctccattgatctgcctatggcaaattcaaccgcataacaccatgttcttgaagctcctagtccaattcctacaaataactagaggaacagagactcctgtcctcaagaaaatcaagtggttcttagtgtcagacattgctttgctgctgctaaagtatggcaatcaccaattaattcctttaccaagctcactccatctagttcctcattgcatgttctatccagtgatgctgatgtctaggcaaaaatcaacagtagcaacagtgagagaggtaggggtggatttggggaagggctagcagctttgtgatagttatttgataaaaaacaaattctcatcgccggatagaatgtggagcgagaaactggatggaggtgatcgtcgtggaggaatctcaatcatggtttaaaaagcgtccctaggcgtctgagcgccatcagggagcagagcgtccccaccgcttagggatttatgcatgctgggaaggaaatcgcgtgaagataggacggaaatcgcatgtgcgacaatttagggagagggaagggcgaaagatggaaagagaatagatatagcagtgcaccaatttagggagagggaagggtgaaagatggaaagagagtagagaatagggcgagcagagattggaaacatgggaaagatggaaagagaagatggttgtctccctcctgctgctcccttctccaatggatcttcctcgccccttcatgttcttcctctcttttttgcctcatatatttctagtatgcctcttgtgcttgtgtggaaggcgtcgccttaccctcgccttaaacgcttaaagcgtcgcctaggcaattgagcaggggtgggtcgccttgcctcgccttgtcgccttaagaacactgatctcaatgatgatggtgtattttgacactgaagcaatgtcgaagcaatgtctcgccaaagacattcttgatctccttctggatggagaatctgctctggttgtttgtaggaattggacaagtagctctgtaagcacgggatacatggttgaatttactggagaagtgccgagggggcagaatagcaaagctccctggtcacagcaatgttaggatgaaaatgcactttgagcaaaagttaagagggccaaaagtaggcttcttccttcctggggttaattggatccatgccattataaatttggttctatgaacttctttcaattatgctcattaatactggaatacttagttcacccataggaatataggattgagatccaccagccaatgtgcgcctgcattgtgttactcagacctgtagataagtaactctaccgttgagtagaataaatttggttaattccgctgagttatctatgctaaggacaataggaagttgaacataacctaaatgtaggtgtcctgtaggatggacattaaccttaaattctccagatatatcttgtccttttcttgctagactaatttgtgactatttttttagtagtttcagcactgatttatcttgcaaggcagaatgctgccttttcagtttacttctgccttcacttataaagcatctgttcttggtgcagataccgtgctattactagtgcatattaccgaggtgctgttggagcgttgcttgtctatgatgtcacccggcactcaacctttgagaatgttgagcgctggttgaaggaattgagggaccatacagacccaaacatagttgtcatgctagttggcaacaagtctgatctgcgccatcttgtagcggttcaaaccgatgaagggaaggcattcgcggagagagaatcgctctatttcatggagacctctgcgctcgagtccaccaacgttgagaatgcatttgcagaggtcttgacccagatctaccgcatcgtgagcaagaggtcagtcgaagcaggtgatgatgcaggttctggtcctggcaagggtgagaagatcaatataaaggatgatgtttcggcggtgaagaagggcggctgctgctcgggctaagctcttgctgtattttttttgggacctgtgtgagcttgtgttatcgccgttccagcgactgagaaattgttagtagtattagcaacttctatgttacgtagagagtttattgctataactgaaaggtttggccagatcagtttagatcttcctattgttgtatggtctccgcggcaactggggcatggtgttggttttcatgtgaatccattgcagccatgcttgaactgttgaatcaagtagaaatatgttttacgcttgcacgctgttgatttggtaaaaggggaaatgataagcagagtgtacacttgtactacatggtgggatgcaatttggcacgcaagcaaataaataacttacatttttagtattagtaggtacccgcaaaatacaagaggacgtcaggacaatggtcatggtaactaactggaattttgtcatcttggttgcttctcattttctcaatggtatccccaggccccagcatggtcatcatgcatacgagaacccttagacagggagaaacattatcccatttgaagtcaaaccatttcctcattctattacagttgacccacggcaaaaacttcaaagcaaaccattccctcattctattgcagttgacccaaagcaaagacttcaaggtaaaccctacaggagactctactggaggcaaaactcattcaacaagacgtgtgctcttgcgaatttttttgagaattaatattatttttatggaaaatcgcaaaagtagtggtcaaccggggaaaatcgcgaaagtaggtccctgtcgaacgggtgcagttcgatagggcgcctatcgaacggccagagcgcgactggcgaggagatcggaaggctgccgttcgacaggacctgtcgaacagcccctgttcgacaggcagggctgtcgaactgcccctgttcgacaggatatccgtcgaactggcgcagttcgacagggtcgcgttctctatttatttgtaataagttattttttttaataaaatgtaatttattttagtgtgtaagaaaggaaaatatttttgtaatgttatatgtatatgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaatataaatgactaaaagtttaatacaaatagat

SEQ ID NO: 616 - DNA, 4664 bp, Oryza sativa; identical to SEQ ID NO: 227

SEQ ID NO: 617 - DNA, 8731 bp, Oryza sativa; identical to SEQ ID NO: 231

SEQ ID NO: 618 - DNA, 5404 bp, Oryza sativa
tagatatgaatctagacatgaattctcccagccaacctatccaagttcataactaaaaagatatatggatgaatgtagtacctttttaaccctttcttgatttgtcaattgtttccaaaactaaaaaatgtgctgtggaggtcaagtggtgtgtgaatgagtatgatgtatgaacgtgttgtgcatgttttcgttgtatttatctagtaactatttgcaatgtttgctactagattctaaggtgagagcaataaacttcactatccatccttatatatatatatatatatatatatatatatatatatatatttagatatgaaactagatatgagttctctcagccgacctattcaagttcataactaaaaagatatatggatgaatgtagtacttttttaaccccttctcgatttatcaattgtttccaaaactaaaaaaaaaagggagagaaaaacttcaaagtgtgtatatatgcaaccggggagtgataattaaggttattaaagaaaaataccatttcagatttctcgaaacgggtgatagctaggataggaataacattaacggctagaaaattggtggatgtgtatatctggatatatacaagaataacaggaaagtcaatcgtcggttaccataatctcacatattctcacaaatagctagtactaattaatacagtacataattacaacactcttactgacggatatacactgcagccaagagatagcactgtacaatgcccgtactattttcgtgtgactgttcgaccaagattctatttattgcattgttatccatgcttttcttggctggctcaaaattcgataccaattaattctgtcatacaggtcgacatatgcagatacatgttttcttctgattatctgattatggaaggcattaagacacggtatactactgtgcatatctgcatcagccagataggtcctgcagggactgtataaatacacaagagaggctatatacagttacctcgtcggaataaacctcacccctgtacaactccggccaccgattccggcgaccaagttggtacttgataaactccggcagctatcgattccgttccggcggccggctagcagctagctctgtggtcgatctcctcgcggtaggtgttaccctcttggttaatcaccgtccatttttcgtaatccagcttgaactgataagatgagtatagatgctttttgcttgcaaggttttgtgtcgcaatgctagtttctttttcttttttcttgttaatatccatttttctttttcttttatcaaaaaaaatatgtgggtgtaggggtggatctaggggggaaaaaagcaggggctaaaaaaaactagacaaagctccaacttatttttggcctttctgtatctatgtcggaaaattttggaggctcaagggtctctaataatccatatattagtagcgggcgctcaaaccccgtctccgtgatagatccatatatatgggtggtttttgtttgatctaaaaagatttttttttctttgtaatccttatgttgagcgatagatattttatttttatgtaagatatattagatatctaagttgaggctttttttaagggctaatatttttcattcacatagatctcaatgttattataatttttccatgtcatatataaacttaagaccgaactaatgcatcttgtttttacctttgacttttcattacttttcaataggacctaaaagggattagggagtcctaattgccctaggctttgtctttaccccttgtatgatgtgaacaccagacataggttcaataggaatgaatagtttgcggatacatatgagataatgttttgcgctatatgtcaaagttagaaggtggtgaacataaaacaaagttaaagtttcactgaataataactagcgacgatgaacataaagaaattattgaagtttaccctcaagaagtagtaatattaatgattgattttgttaattttgctagctagaatatgcatacaacagcagatgttatcatcctttttatttatacgtactgtcatccttttctcctttggtatagattggttttatgaagttgatggaaaattgaccacagatgagtttattattcattcatgaaccgtgaacttctcttaaaaaaagtaaaataaggaagttcaatgcgaataatctatatgggggattaattacttgtcaatgcttttcatgatatttaatgttttcgactgtaagattaacaaattgtgcagagatgtatttttcatgcatgataatttggaagtgcacccacattgttccatgaacttgcattgctagttttatgttaaattctcgttcacaacaaattaactagagacaattaattatcatgatatataggtaatttagcatcaaactgatcatttacaatcagcattactgtttttgaaaacaaaaaaaataaaaaaaaatgctatatcgttacaacggtggtttattttactaacatcatcatgacatcagcatgggatctaggtaccaaatactgttacctatgagtatcatgtatgataccccgatattagatatggttcctatgtttatcatgtctaatgctagtatcatataagtaccaaatttgtgccatgctggcgttatggtgatgccagaaataaagtattccattctggaatggtatagtgtcttctggtaatccttatttagaaaatgtattataaccatttaaatatagtatatgttccccttccatctcaaaatgtaaatgattttgggtagatgtaatctatagtccttaaaatgttagtagttctggtggtgtccattcccacaccatctctactactaccgtgtgagccccacaatctataccattacattatcttttaacgagtcctcccccgtttcaccgttggctctcagtacttggactaaataagtgtttgttaattgatttaataaattagaaactcaatttgttgtccgttacaaagcacaagctcttagctatcctaatattattaatctgaacaaacttatatcacatccatctaaaatctcgtatattatattttgggacgggggagtaagaatgatcgagtgcacgtacattttaggtcgtaaatttactatctttgcaaaaagtaattaacgatggcttatatacctcttctccggtgagcagctcaccttcatcaatggagtaccacgtcggcggtgtcatcggacagtcacccaagcccaaggtcgtcttcgtgctcggcgccaccgccaccggcaagtccaagctcgccatctccatcgccgagcggttcggcggcgaggtgatcaactccgacaagatccaggtgcacgacgggttccccatcatcacgaacaaggtcaccgaggaggagcgcgccggcgtcccccaccacctcctcggcgtcctccacccggacgccgacttcaccgccgaggacttccggcgcgaggcggccgccgccgtcgcccgcgtcctcgcggcgggccgcctccccgtcgtggccggcgggtcgaacacctacgtcgaggcgctggtggagggcggcggcggcgcgttccgcgcggcgcacgactgcctcttcctgtggaccgacgtcgcgccgggcctgctgcggtggtacaccgcggcgcgcgtggacgacatggtgcggcgcgggctggtgggcgaggcgcgcgccgggttcgtcgacggcgccggcgccgcggactactacacccgcggcgtgcgccgcgccatcgggatcccggagatgcacgggtacctcctggccgagcgctcgggcggcgaggcggccgacgacggcgagctcgccgccatgctcgacggcgccgtgcgcgagatcaaggccaacacctaccgcctcgccgcgacgcaggtggcgaagatccggcggctgagcgcgctggacgggtgggacgtgcggcgcgtggacgcgacggtggtggtggcgcgcatggcggagggggcgccgcacagggagacgtgggaggcggtggtgtggaagccgtgcgaggagatggtcggccgcttcctcgaggcgtccgccgccgtggatgacgatgacaatgccgccgccggttcgccggcggcgttggcaccgatgacggcggcgtgtcgcctgagggcgcagctggtgcagctgcaatactaattagaatggagtggcttggcgttggctagcgttagtgctactactataattaatatatatagtgcaagcagatcgcgtttgattagagtgacaattatatgtcgtcgaaagtacgttttgtgatggaagtaacatcatccagtcactataagtgggacccatatgtcatcagtttaattaaagagatgattttttttgcggggaaattaaagagatgattaggaagaaggttttccttatttattcacagtggagtgctattttacaaatagttctagtatataaatatagggagatggattttcataattggagaggacatgcattccctcgtttttttataccacctatatatatatagaaaaaatgataatataattaatacaaaatatatcacttcacagcctccatgttcaaatttgtaaacaaaacaaattaaaccaatactaattaatgtatgttcatagttatatatatttgtatatttcatggtaatgatggttttcttgcattttatattataagatgttttgatttttttaaacttttaaaatttaattgattttataggaaagcgtagcaacatctaatataacgccaaattaattttactaaatccgacatctatagaaatgttactacatgcctttatttttataaatttgtttgaatttaaaacaatttgattgaaaaaaaattcaaacattgtataatataaaacaaaggaagtatataattaaggtattgtagttcgttgttgcacgtggaatctcgtgtctggaactcgatgatctttagttccaagagaggaagcaaaggtagcggacggcagggttgatcgatggcgagtggcgagatccaatgccgactgcaaccgtgcaactaaccgccggcgccgccgtctgattcgctgcgacaagctgggctgctgggcagcagctaagcaaccgagatcatcgagacggtctcagaatctgattcggattggacaaccagtagtttaatcgatcgatcgcctgtatatatattttgggttagtttatcccgtacacatagaatcgattgatcgatcggcactacaatacagcgagcgagagagattgatcggtcgagagatgagtggatccgtgatgatgatgcagcggttggcgcgtcaagcggcacacgcggtcacccagcgtgccaggaatcagacggcggcta

SEQ ID NO: 619 - DNA, 3481 bp, Oryza sativa; identical to SEQ ID NO: 561

SEQ ID NO: 620 - DNA, 2708 bp, Oryza sativa
gcttttgtgcttggcccgaggataatgagcaatatttgcttaaagttgcatgttttcttctccaatgcaggtttgttttcatgagcatgcaaattatctaaatacatgtgaattgttctagttgatgggatctattgcgatagaatcaaatggcctctaatcgtatagtaacagagctagcaacagtaatataaccatcttaaccaggatggttcaaaagcaagccatatataaaaggagttgtttattaaatatatgtattgtatcaactggaatattacacaagggctaataattttgcaatgaatttatttgataattggcattgtatggctattttgttttttgcattttgcggaaggcatgagaaatgccaaaacaagtaaatatagagcaaagtattttacaacgattgttagtaagtatttttgaggtagatggttggtattatattaccaagtttcaaagtattcttttaccagagaacatataagtaacatatgtatgtttcaaagtgcccacatttgaatttactttcgatgaaggattgatacggattttttttccttgaaaaatgtgtacaagcacatgtttacaaatcatcaccatattaagatgaaagtaggcatatggtttaaaaagttaaaggagctcatcaggtttaatttgttttatgcttacacacgtattgaggatacaattttaagggttgagccgttaactcttatgccaaaaatatctccaaagaaaaaaaatcgatcacaattgcttggataattgtatgagtatatctaattgaatttgggccccatcaagatgattaccatacacattcaactgtacatggattgatatgccaaattccggtaagtggaggtgccaagaggaaggaggaaggatttatgctttgatctagaaacatcaaggcggcacactttcccctttcctatataccgaggaactcttccaggtaatacgaacccttagctactttcctttcatgctcaattttcacccttcttgtgattgcttcctcaatatgctgggaaacaagttagtagtgattattggtgccacgggaactggaaaaacaagactctcaattgagatagccaaggcgattggtggggaagtggtaaatgctgacaagatgcaaatttacgatggcctggatattacgacaaacaaggtttctttacaagatcgatgcggcatatctcatcaccttattgcgtccatccctcgcaacgcaggtgattttcctgtgtcattttttcgatctgctgcaaaaaccacaataaactgcattgccagacgtggtcacacaccgattgtggtgggtggatctaactcacttatccatggtctccttgttgacaattttgattcgtctattgtggatccttttgggcaattggaggttagctatcggccgacgcctcgatcgcaatgttgttttctatgggttcatgttaatgaggtgattcttaatgagtatttgaaacatcgtgttgacgacatggttgatgctgggttagttgaggaaattgaagaatattttgacacattatcagttaatggacatgttccatatgtgggattagggaagaccattggtgttccagagctaagcgagtattttactggacgggtgagttgtagtgatgctctttctatgatgaagaccaatacacagattcttgcatgatctcaagtcacaaagattcatcgcatggttgatgtgtggggatggcatgttcatgcccttgattgtactgaaactattctagcacatcttactggatcaaataaatatatggaggatttggtgtggaaacgtgatgtaagtgaccctggacttgctactatacaagattttctgtgataatatcagaagatgggaagctagtttctcaaacacatcggctattgattttgtctacaataatggtttaatcgtctggcttgcttagtaattttacagatcatggcatagtaacttaacttggatcattttgggtgtgtttggaaggagcaaacatcaattggtgtatatgaaattacttggaggccttttgtaccttaaacacttggatgccttttattttacataatagttatatatagttgtgacggagcgtggggctcctcaccgggaggccgcgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgagtgaaggaatccagagactcgagagcgagagagagttcaggttctagcaaacattcgccagagtcccaactcccctttcgtcctctccccccctttcttaggcctgggcctcctttttatctggtcaggggtcaccacatgggcctctagctacctaagaaaggaaacatgcttttacaatgagggctagtctacagccggaagtgacctgtgacaagccgagcgcacgtctcttgctccgctcgcccctcttccggtggacgcccatttcaaccttcatttaatggccagcgacttccttgccatacttgcgctgaagcctggaatgaatctaaccgggactgacatacccactcctggagttggcacgccggctcc

SEQ ID NO: 621 - DNA, 4097 bp, Oryza sativa
ttataaaaaacgtatcgtttaacagtttaaaaggcgtacgtgcggaaaacgaggaagaggggttgggaactcaaaggaaagacacagccgggttgggaacttgttgctgtcaccctactccctgatgaatcctcttgtccaggtttttgcatggagtaggaagtaggaactatcatatcaacctagcctactagtttctcaggcatcagtagcccagtagtggatgcacgaacgaattttacctgttgggggtgagaagctagaaccgggcaggggggggaaggaaggaccagcaacaagtggacggatgatatggaggctgatggaaccgatcgtccggaggcaacttgcaagcaatgctacatttgctcccgcagttgcgttgcacgacgtactacatatgtaaccagaaaaatgccacgacgatgcagatcgatatatagtcaggcagcattagcgtggtcgagtccccaacgctcggcattgcctcatcagttaatccgcactcgcctttttgttagcgggacacgcatgcgctgtgtgtgtgtgtgctcccttcgatcgggcacgagctgtgtgcggtggcatgggcgcatggcagcgactggtcgaaacgcggccgcacgacggacacgccgctcgatcccccgcgcggctgccgtgctccccctctcgtctggatcaccggcggcgtgggcggctctcttccacgaggcatgagctcggttttttttttccctctgctcgcgacggagagggaaaaggctgctgcttcttattcttattccctggagcgatcagctttttctccgccccccggaggtgaaaacaaagcaacgaatggaaccatggaaacgaagtgaaggagcgtgccttcgcaatcatggcctgaggccctgagcggctgagcccctgaggcctcctgagtatatataaaccaagcatggtttgcctcctgcattgcccgtgtgaatgccaatgatacagagccccccaagagcagagcaagcgcgagaacacacaccaacaacgcaacaaaccaccaggcgtgcgcgtgcaagcgcaaggcttgaaacggagagacacgaaaagcgccaaggtgttcgcccatcattataatcagcttataagggcgcgagcgaaaccgcacagttgtacacttggactcgcaaactagactctccgtctccttgcgctgcgcgttatatcggctctgcctatataagtgtgctgaggcgactggggctcggtgagtgttttgggtgggccggctttatgagcagtctcggtttgaagatccgcaccgtcgtccgctcacctatggcggccgcggccgtcgctggcgtcggaagggatggtagcttcgcctcccagaagcggccacgtcgggttagtgtgagaatggagagaagcagagtcggggacggttgctgctgctcctgctctggccgcggcggggtggcgtccactacggcggtccggccgtccacggggatggtggtgatcgtcggcgccacgggcacggggaagaccaagctttccatcgacgcggcgcaggagctcgccggcgaggtggtgaacgctgacaagattcagctgtacgacggcctcgacgtcaccacgaacaaggtgtcgctcgccgaccgccggggcgtcccgcaccacctcctcggcgcaatccgcgccgaggccggggagctgccgccgtcgtcgttccgctcgctcgccgccgccgccgcggccggcatcgcgtcgcgcgggcgcgtgccggtcgtggccggcgggtccaactcgctcatccacgcgctcctcgctgaccccatcgatgccgcgccgcgtgaccctttcgcggacgccgatgtcgggtaccggccggcgctccggttcccgtgctgcctcctctgggtcgacgtcgacgacgatgttctcgacgaatacctcgaccggcgcgtggacgacatggtcggcgaggggatggtcgaggagctcgaggaatacttcgcgacgacgtcggcctcggagcgggcctcgcacgccgggctgggcaaggccatcggcgtgccggagctcggcgactacttcgccgggcgcaagagcctcgacgcggcgatagacgagatcaaggccaacacgcgggtcctcgcggcccgccaggtcggcaagatccgacgcatggccgacgtttggggctggcccatccgccgcctcgacgccacggccaccatccgggcgcggctctccggcgccggccgcgccgccgaggccgccgcgtgggagcgcgacgtgcgcgggccaggcctcgccgcgatgcgtcagttcgtcggccgcgccgacttcaacgccgcagcggtcgaccagctagccgcgcggagtcggaggcaatgccttcgcggtggcatggtggccggctgagcccgagcggaggaaaaaaaaaaaagcttgcgtgcttttgggttcaaaatttttcgataggccgccgattttggcgggcccgatggctcatctgacacaggtcggtggggccacaggacatgctacagcgaaagacagagcacaatacagagcaagcaggaacaagaaatagagagaaaaggcagagagctgtgaagttttgcagagaggactgtgaattccttctccctggcctggaggctgcttaatcttcttttggattcatcaacctttttcctagctagccaccattgtatacagtgtaatctactgctcccccttgttcaaattttgaaatagttttacattttcaacctgaccttgaggaggatattacaggattcatcaccatgcaccagatgcacttggttttctgctcggcctttttcgtttttgtctccatgtgtaatcggggcatgctttgcatctctgaaccctgtgcttttgaccattgcgttggttatctgttgatcgcttggaactcgattctttaattcgatctgcagagtagtctagttgcatgcactgggtttagttgcttcccttgttgacatgtagtggtggattctctgaaacattccagctggtagcgtgcactggagccgctgattaagtgcgtaatctcatgcttggtgtgtgattaaggggaggggtttgtgctggccgcgtgagttggtgtctttgtactcttgttgtgccagctaccaaggcagttcgagcctagacgtgtgatgcattctcatactcctgttttcctcttcattctctctttctctcacattccttcagtgtgactgttcgattcgcacgcaccgacatcgccgggttctttttttccattgccgtggtatgttagagcaagtttaatagtatagtcaatggctgactccaaatcatttatagttagcttaatagctaattcatacaatagttatctataaacatatactacacaattaatatctggtcccacctatcatacacacatgtattttatagtccgtgctataactggctataaatttatagctcgttactcttctctcttctcttttatctttttgaaatgtgtctatggctggtttatagtctatacctgctcttagctactgacgatcctctcctgcatgagtatttttgtctcctttttacactcaccaagacaccaaccgttacacgactggtgagtcggctgggtttgacggccctgggtgacgtggctgcgtgtgatgtcgttattctattctgcagccacaacctggctgtgggttggagatgttgagcgagaagaaggcagagactggcatcctctgagacttgttgatgatgtcgctcgcctgcgctcgattaggatgtggcaccatactgctagctagtactggagtattattctctggagtagccaagctgtttctctcatgcgtgtttacttaatgcaaacaactaaccccctgcgtgctgcaaatataatactgctgctactactaacactgcgtgactttcagatgcctcctgcctcagcaggaattcacatcagaacagaagccggccgccaccattgccatcccgaacaaactcctcgaaaccaaagctcctttcggacgaaccgatgacaagtactactatagaagctatactacccatcc

SEQ ID NO: 622 - DNA, 3075 bp, Oryza sativa; identical to SEQ ID NO: 402

SEQ ID NO: 623 - skipped

SEQ ID NO: 624 - DNA, 6334 bp, Oryza sativa
tctgtagttttgtgataaattgtacaaaaatacctgtagttttgtgaaatttactcttttttaaaatatgtttatagctggcttaggccatttaaagtgcaaggacgtggcgtgtggcaatgtagagccacgtaggcaagtcgcttgcgtggaggagagaggggagtggggaccgttcccaacccagcttcgtgtgaccaagtttggccacacgggccaaacgaacctcagcaacttttgtcagaaagaaaagaacctccgcgagaaacaagaaagcgagagagggagagaaaggaggctcgtcggagtaggggcgctcggggtatggggctcggcggaggctcgctggagtaggggccgccactgcgtggggctcgccggagtaggggcgctcggggagcctcccgagatccgccgctcagcggcgccgccgtcttccgggcagagctctcgaagctcgccctcctcgcgcgccggtggcgttggcggggcccgcgtgtggctacgcagctccggtgctgcgcctccaccgtcgacgacagcgccgcttggcgctgccgccgtcttccgccgcgccgctggacgccgccagatctgctgctcgtcgccgcgtgggccgctccacccggttggaggaggagaggcggcgccgcgcttgggctgccccaccgccgagctctgccgcgccgttcgccggtgctgccgagctccgccgcgcctgccggagcacgctgccatggccgccctggagaagacacgagagaattaggtggagggtgggggaagggtgagattttttatattatctatgggtcccattataaattttctaaaccacacttatactgtgggtgcagtgtcatttagagttcccaaaccacctatgttgcagctgtggtataacaatttgctaggacgcattgctactgcccttgtaccctgctataagaagataaccaatgacatctccactcgattttctcggcgcgcgtgtgagggtgtgaggataatttttattttaagtggtttttaagggcggagagagagagagagagagggcaccgcactacttctacttgtgtgtgtgtcgctcgctgggcttcgccacctttccgtctctttcctctctcttctctctccccctctcctggaggagagagaggagaagaggagggggggccgcgccaagagccacgcgcgctacagtctccttcccacccgcgaccgcgagcaatggagatggccagtggaggaggcgccgccgccgccgccggcggcggagtaggcggcagcggcggcggtggtggtggaggggacgagcaccgccagctgcacggtctcaagttcggcaagaagatctacttcgaggacgccgccgcggcagcaggcggcggcggcactggcagtggcagtggcagcgcgagcgccgcgccgccgtcctcgtcttccaaggcggcgggtggtggacgcggcggagggggcaagaacaaggggaagggcgtggccgcggcggcgccaccgccgccgccgccgccgccgcggtgccaggtggaggggtgcggcgcggatctgagcgggatcaagaactactactgccgccacaaggtgtgcttcatgcattccaaggctccccgcgtcgtcgtcgccggcctcgagcagcgcttctgccagcagtgcagcaggtcactctctcactcacctcgccattgctgatgtcaccactgcttttgctttgctttgcttgctctccctcctctttcacctatctctcttgtttatttgcttcttgttcttgtttagtgctagtacatgtgttgttattgttgtgccgttttgtcttttgggttattgtgttgttgttactactcgttttactataggtttttaaggtttatgagcacggccaccacattagatgcactgtcaagtggtgtgtgtgggacctttcctgctaaaacaagctgatttcaactctctgaaacttcctgcatttcatctatttttatctttgattgtgttgggagtactacactagtagtgttaatattttgactggtgcttatgagatttttaagttggtaggttgatgaggaaaatactcctttatatggttgagtgatgtgacttgcctgtctgcctgcctgcctgccgctttgcataagattcctctgtgttagtaagagccactgtttatttgtactggtgcttactctacttagttaattagccattagctataaaattccgttgatgttgcaagcttagcaatggccacggtaagaatgggagagagaagttggctaaagctgttgctttgtagtttgtactatatatgtgtctttgtgttgcaagatatgcaactcctactatgctgtgacttgagctcaaggttttcagttatctatagatccttactactactgagcatactaccacttctgtatggtagcatatggtagcatagtccaagttccaacgcctcgccagttgttcataatctatactaccacttctgtgcatttgttacttttatttaatagtttgtctcattagctgacaagcatatgcctgttttgatatctgcccctcttgtaatagtctatggatagcttggactgtttgatgctttaattttttactagcaacacttagggcccctttgaaatggaggattagcaaaggaattttggaggattcattttcctaaggattttttcctatagagccctttgattcatagaaagaggataggaaaacttccgtaggattgcattcctatgatcaattccataggaaaataagcaagaggttagacctcttgtgaaactttcctttgttgagtgtatcttgtggtataatcaaagggctcttctctccatttcatgtgttttcaattcctgtaggattggaaaaacatacaacttcaattcctacgtttttcctattcctatgtttttcctatcctgcgtttcaaaggggcccttaaggatgaagggaagtaagagaaacatactagagaatatgtagtagtatttctacattccatatttgtagcactagcccacaaatatctttgccttgtacttacttcataccagttccccccttttcagagcaaaccaacaatttctgttgccttatatatctagtgtcttcgtactaatatatctgttccaaaatgtacctgtccaaattcatagctagaaatagctttatttaggacggaagtaataactgttgttagagacttggttcagacttttggttatgttgaggctactatcatttcctttacgggccaaattactacaaatgagaattcataaaaatgtcaagattttatgattgttgtagctttatttaggacggaggtagtaattgttgttagagacttggttcagacttttggttacgttgaagctactatcatttcctttatggtcaaattactaacaatgagtattcataaaaatgtcaagattttataattgagctgtgccagtgctaagtgtgtcactatctgatgccataatgcatcattataaaagccagatggaccattagcttttatgtgtaggacacctgccgtccaattagatggataaccatctagtgtttgtgtactgttattttaagcccgacatctcacaactccatgaatgattacagtcttcctttcacatggtgtccttttgttgtgttaggaatagcattttttatttatgggtgtaattatgaaaggcactaggagagttgctgctttatcttgatgggatttgtagtaataccatctttaggatgacaagaaatcttgttctgagttagcatgggctgccttttgacctgagctacggtttgctatgtttggcttgcatcatgcagatctattaggataataagcatataaaagttgcttgcattgtgcattgcttgttttaccttgattcatgtaggagtaatttgctcgccatgcctcgttttgctttctgagtcaacagccaaatttagatgatgtaccttctgttgcttcaaaaactcagtcactgcacagcagcagtggataggattcagaatcaatctatccatgattctctgttcacataatatgacaggttccacctgctgcctgaatttgaccaaggaaaacgcagctgccgcagacgccttgcaggtcataatgagcgccggaggaggccgcaaacccctttggcatcacgctacggtcgactagctgcatctgttggtggtatcatcagaggctcttgttttctttgcatcttgtgtgtttgttggtaactactggttgcattcgctgatgtgttgtttgttgcgattcttgatccagaagagcatcgcaggttcagaagctttacgttggatttctcctacccaagggttccaagcagcgtaaggaatgcatggccagcaattcaaccaggcgatcggatctccggtggtatccagtggcacaggaacgtagctcctcatggtcactctagtgcagtggcgggatatggtgccaacacatacagcggccaaggtagctcttcttcagggccaccggtgttcgctggcccaaatctccctccaggtggatgtctcgcaggggtcggtgccgccaccgactcgagctgtgctctctctcttctgtcaacccagccatgggatactactacccacagtgccgctgccagccacaaccaggctgcagccatgtccactaccaccagctttgatggcaatcctgtggcaccctccgccatggcgggtagctacatggcaccaagcccctggacaggttctcggggccatgagggtggtggtcggagcgtggcgcaccagctaccacatgaagtctcacttgatgaggtgcaccctggtcctagccatcatgcccacttctccggtgagcttgagcttgctctgcaggggaacggtccagccccagcaccacgcatcgatcctgggtccggcagcaccttcgaccaaaccagcaacacgatggattggtctctgtagaggctgttccagctgccatcgatctgtcgtcccgcaaggcgagtcatggaactgaagaacctcatgctgcctgcccttattttgtgttcaaattttcctttccagtatggaaaggaaattctaaggtgactggcgattaatctccctgtgatgaataataatgcgcgcccttgaactcaattaattgctgtgccgcatccatctatgtaactctccatgaatttttaagtatcagtgttaatgctgtattgtcgaggacttctgctcgatatgttatttctcttatgttgttcatcatgaatctttttctgcttattattctggtgccgggttgtccttaccacagaagattcagtttcggttggcgagagtaaacaccttccctggttgtgacaaaagctccaaccttttcacttctcggcctgtatttgatcttccccttctgacgctgttatactacttttaagcctgtatgtttccagccttccaggtgaagggccatactgaagagaaaacatgctttcagggtttgatgcattgtgtactttacaagtgtacttaagattttgtacaatttatatatgtacctgctctgctgctgagtattgtaggaaagaatcagttcgaagggcgtgtgttcatgtaaagtgagaccacatgcacagcgtggatttgcagcatgctctctgcaccagtggtgttctgttgatgcctttgatgggctggctgaggtgagaggaggatgatccatgttggcagcttcttcactctgaaaaataaaagagaagaaatgttcagatttgcagacaagtggagagcagtgatatattctacaataaaacattaccaccttgcttttctgtgatgatagatactccatggaattttgcatcaagcatctcttgttttccagccactgtttgctgggttgttgcttcaatttcgtcccaattgattggtcacctttggttgtgacttgagagcactgagcactgaaacttttgctgtcagcaggcaatgcacctcatccatgtcacgacagagggagagagcccacataaatggccaaagaggacacatacagtggcactgatgcagtcattgcaacataattgacatcatgctaaacagtggtgtaaccatatgttagctagcctgtgatcagcaaacagtgattatggatcttaatgtcacatgcaagatttgacacagttgtaaaaccatcattgcattgaagatagatcccagcaacaggtgtatgatgtattgctagaatgaatcaaaaatatcagtgccatcctaaacacagtactac

SEQ ID NO: 625 - DNA, 5070 bp, Oryza sativa
ttttgtaattatccaaatgcccctatttgattcacgcttaataatttaccactggcaagagatgatttcttaactatttgtcacttttgtctacgtgacatgccatcgtggcgtgcccacgtggaaaacaacgttgaccccacccgttagccccttccccctcattctgctactcctctggccatcaagcctcatcctcctccagatcttggcagcggaagcaggctggcatcggcgctgtcggaggtggatctcgcatagctctcgacggcgaggaggtgcacgaggaagagcaacttttggcgaggtgagcaaggacccgatccatggcggcgacggtgcgctgcgttgtcctagtgtttgtccttgtcgccgcgtcctcccttgttgcggcggcgcgcagggcggcctcgcgttagctcagcgccagcgaaggcacaggagaggttaacatcgacaccgccgtcgacctcaacaccaccagctgaacctcaacactgacgcagggtggtcttgccgaagccgtggccatcgtcgggttggtctcacctttttctccttttctttttttttaatccctacgcgaggtccgtctccgatgccccgatgccgccgcgtcgctggcctgattccaccgccaagatctggaggaggaggctgtgatggccgaagaaggagaaggagaggggaggggctgacgggtggggtccatgttgttttcctcttaggcatgccacgatggcacgccacgtaggtaaaaatggcaaatagttaagaaatcatctctttccaatggtaaattattaagcgcaaacttaagagaggtatttgaataattgccaaatctaaaagtggcaaatagttaaattcccccaaatttaaagcagcgaagcagtggaggcgacaaaaagatgagcacacgatggcacacccgcgatgccgcgcgcgcgcgcgccacctataaaacgcccgcgcgccccgcgccgcctccctccccctcctccccacacgccacccgcacgcgcgccatggacgccatgaggcagagcacgccgcgggccatgctgctcctgtgcgccgtgctgatgctggccgtggcgccgccgggcgcggcgacggcggcggcggtggccgggtgcgagtgcggtaatgcggcggcggcggcggtggcgggggaggacgcgcgcggggcgttgcggctcaagctcgtcgccatcgcgtccatcctggcggcgggcgcggcgggggtgctggtgcccgtgctggggaggtcgttcgccgcgctccggcccgacggcgacgtgttcttcgccgtcaaggcgttcgcggcgggcgtcatcctcgccaccggcatggtgcacatcctccccgccgcgttcgacgcgctcgcttcgccgtgcggcggaggcaggggcggcggaggcgggttcccgttcgccgggctcgtcgccatggccgcggccatggccaccatgatgatcgactccgtcgccgccgggtactaccgccggtcccacttcaagaagccgcgccccgtcgacgaccccgccgacgccgcgcgcgccgccggggtcgaggagggcggcgccgagcacgccggccacgtccacgtgcacacgcacgccacgcacggccacgcccatggccacgtgcactcgcacggccacggccacggccacagccacggcagcgcgccggcggccgccacctcgccggaggatgcctccgtcgccgaaacaatccggcacagggttgtctcccaggtgagctcatcaccaaccgtcaagctcaatctcgttacgcacatcacaaaacaaaatacagtaaaaatcaaaaataaaaaatttgggcggttcaaatgaaagttccaatttgggatactttataaagatgactggtactagtgtactaccaattgctttactttgccaccatccatttcaaatgtccctctcctttatgcaacaatcacaagggaacatagatagagatgcatagtggtattctacactacacaaattagctgattttgatgggagaaaggcatgtctctttctcttttgtaagagataattcaaatactgacaagaagatcaatcctttgtattgtaactatctgaggtgtctgcccactctgcaattggggataaatcttctctgctcagcctcacaactgaaccccctttgcagattctgcacccaacattgcaaatgttgtaatgtctgaatgaaccaagctttggtgctacttttcgaagaataactgacaaaagaattgtgattgtgcaggttctggagctgggaatcctggtgcactcggtgatcatcggggtttcgctaggcgcatcactgaggccgtcgtcaatcaggccactcgtcggagccctcagcttccaccagttctttgaaggcattggccttggtggctgcattgttcaggtatatcacaataacattttacagccatgattaacatgaacatctcacattacattcataccgcggtataagataatcgacaattcgacatagaagggttgaaactatagctgtgcgcttgtttacctacattgttacatggcaaattgataaaatatctacacgtgaaaatcaggtaaaaggcacctgggctcatgacagaaacagaagggcatgctccattagcaaaagcgtgcgaaaaacgacatatagagtatagacagagatatttatagctcaaatgatagaacttatcactagctacacgactatactgtacaaagcaaacttgaagtaggaccatcaataattgattccgttccactatggttcagaaatccttcactaactgacaagctcaaacaagctcccagcttctcaatgccagttttttttttcaggatacacaaacaggaattgctgcgtcattttttgcccttctgttttcccagatgcttttaaaactggacttcagatttagcatatacctaaaaataccgcgttttcagaaatgggttgagactggtttgtcatgtaacactggccaggattctcaaccattttcaattgttatcagtatactgtatccactatccagtgctgatcaatatccacgcagatattactatgtctgagaagaaccacaatttcagcagtttactttagttcattcaattaggtgaaaatccattccaccataagctactttccataaaaatgaaaaagggacagactttaaagtttctcgtatgagacaataatttgacatactttgtgtcacattttcttacacaggcaaattttaaggcgaaagcaacagtgatcatggcgactttcttctccctcactgctccggtgggcattgcactggggatcgcaatctcatccagctatagcaagcacagctcgaccgcacttgtcgtcgagggagtcttcaactctgctgcagcagggatactgatctacatgtccctggtcgatctcctcgctgcagatttcaacaatccgaagcttcaaacaaacacaaagcttcagctggcagtatacctcgccctcttcctcggcgctgggatgatgtctctgcttgccatatgggcatgagatcttcagagcaaccaagagctgcaaatttttgaatattgtctctgaaaaagacaccctgagcttagtttgtagctgacagggtttgatgttgtcatagcattactgcaaccagcttttgtagaatctccatcaaccagaattggagaaaaagatggcctgaatacgaccgaaagtttagagtttactgacatgagtacacaagtcaaaagttcaggacaaatctgattcttgggcaaatggtgtgcttccaccagtatagcaccaaatgaagtgaacaagaatcaaatgggttagtcgaggtagtggtccttgaacagattttctcttcaagtccaaaagctttgtataaaaatgatgacctccttttggagtcaatgtcaatgtacagattctcagctagggtaaatcctttttgtatgacaagagctctgtgaagtttgttcacttgttcagtgaagaatcaaataatccccagcgttgtctcctttttctctagtctttcagaaatgcaaaactgtagcttcttattcctgatgaaatctgcaatttgtttcagaaatatataccgcttgtgtggctcacctgaaacctgaattttattccagaaacctctgaaacctgacactgatagtttaaactgttgccactgaatgtatggtttgatttgattctctgttttaaacagaacaatgctgaagtaacagaaacattcttttgatttgccgcgttgttcttccctgcagaattgtttaactggcagagaatatatgcaaaagggattaaactggaccatgctgagatcaaaaggcaaagatgcagagaacgaaagcatgaggagaacgcaaccatggcatgaggcccctgcggccctgcaccgtccaatgggttgcaggacagaacaggatgcttctctgttttcttttcctctcttgtacaggaggatgcggaaacgaacacacactaccacacacgcataggtatcctcggcggtgcatgaacatgatctactgaaagatacaaggaaaaatcgttcacgcggttttttcacagtgtactcctacaattggtgaacacggatactaacttatggacatttaggaggtttttggcagggctccaaatctaaaactgatataattttgttgggactaaacaattttgctatatatttgtcgacaaattttcttctaaaaatttaacaaatgtaattatagtacaatcgtagtgtaattacactgtaacttgaatgtaactacaatgtaacttgcccataattttgaaccattaaattgtttcaatatttgtgcaagtgaaggaaaaaagtcatttcgcgcacatatatgagatgattcgttcccacgacctccatttcaccgaaatagcatcttagttagagatttttgaaagttacatacaagttatatataaattacatcacgcttgtactataattacatctgtcaaatttctaggagaaaatttgtcgac

SEQ ID NO: 626 - DNA, 5621 bp, Oryza sativa
ctcaacacgtaaacatgctacaccattatccactaacaataattacaagcatgcaatatcatctataatttattgaatcttacaaaataacacgcaaagcatattcaattatcgcctctcacatcgtttccgtaatttttaacatatttatccatcattttttaaatacttaatatatatttatccatatattccgtatcaatgcacgggatattatttagtttgtttcatgattaaaccttagcttttcatcattttttcctatcttcggcctggtttagttcctaactttttcttcaaactttcaacttttccatcacatcaaaactttcctacacacataaattttcaacttttccatcacattattccaatttcaatcaaactttcaattttggagtgaactaaacacaccttccacatctcgcgatgcaaatcttggccaacaacataatatttcatttataatctcctacagagctagctattaaatttatttctctccaaacatagcataaaacaaatttatttgttgttaataactaatatagtgtttactccttgcttgattgttgaaatgacatattaaggattatttagtaataccggcaacaaatcacgtgcctcactaaatccttgttataaatgcaccaacgagagcgtacactcatcagcaccaggattttgaacccctatataaccacatctttagtgctttcctcgatgattcatctctttatatttttgttcgataaatatgaataccattatatatgtattaactattaagtcacaaaactttgactgcatatatatacgtcgccagaatgttgccgtgtacaacagaaagaattatatcaagtacggtggcttgctgtagaaacttcgtctgctaaatctaatctaggctccgtttagttcacaccaaactttccctaaacttccaactttccatcacatccaaaacttttctacacacataaactcttaactttttttttcaaactaccaactttaatttttctaaacttctcctcaattttagaaactaaacacagcactagtgtacgtcctttaacatcacttaaagtccagatagctaggcaactccactagattggcactagattagcaaatgtaatctaatctaggagagatgacctagctttgcatacttccaatcgatgaatgtcgacactatagcaacactgccaattttcaatcagtactatcatggagacgacttccataaactaccagtagattagatgctgctagctaattatttttggaggagctcatagtttatttatttattaattaataattccagctccggtttcgtctctgcgaagagtagtaatagaagtacgagtagttctttaattcctcgttaggtctgaagatctatcatgcatgctttgatgagagtaattaagtacggcaagcatggagcagcaagtacacacttcaattcttttctgcttcgaaaacagaggaatcgacatgtgcatctcacatttggtggaggaggtggcatcctcacctgctcctgtgtcctacaaaattgaatttctttctctttttttttgaccaatttcattgaaatagaagaaccggattagtgcatgtttcacattttcatgcttatacctgttgtggcaaaggcaaaccacacaaaaaattggaaacgcatcaaggccagccaaactgttattgttgctcgaagaattaattaactaagtagttataatttaatctcagttgagcgcgcgaacgccccagcaatcaattatttctcttcttttttaaatttgtttgtttacatgcaacggatcggagactgaaatggagagtccacgggttcaaaaggcctagaagaacgaagcggagcttagctcgcgcatgtgccaacctgaacctccgctgcgaaacgccgcgacatctcgccgcgcgagctaagcttagctgcaggtgagccatcggcgatggcgacggcggcgatgaccaaggtgttcgtcctgctctttctggtggcggcgtgctacctgccggcgcacgcggcggcagcggagtgcgactgcgcgacggacacggcggggcgggacaaggcgcaggcgctgcggctcaaggtcatcgccatcttctgcatcctcgccgggagcaccgtcggggcggcgctgccgtccctgggcggcaggttcccggcgatccagccggagacggacgtgttcctctccgtcaaggccttcgccggcggcgtcatcctcgccacgggcctggtgcacatcctccccgcggccttcgaggcgctcagctcgccgtgcctcgtcggcggcccgtggaagcgcttcccgttcgccggcatggtcgccatggtctccgccatcggcacgctcatcgtcgacaccgtcgccacggggtacttccaccgcacggacgccaagaggaaggccgcggccgtcgccgacgagccagccgacgacctggaggcctccgacgagcacagccacggccacgcccacggcatgtccgtcatgtccgtcgctcccgccggcgaggaagacctcgtccgccaccgcgtcatctctcaggtatgtcatactacatctcccgccaccgcgccattcaagaaacagagctgcgaaaacaaaaaaacgcaaccaaattaagaaaattcaatcaaaatttctgttcttattttcttaatcgattttgcttgtgcgtccttgatggtggaggtgctggagctgggagtggtggtgcactcgctcatcatcgggatgtcgctgggcgcctccgacttcccgagcacggtgcggccgctcgtgccggcgctgacgtttcatcagttcttcgagggcatcgggctcggcggatgcatcgttcaggtgatttacccacacatttactccgcactcacaattgtcaatttcaacctgttttttttttttttcgagagagagagagagagagaaagatttcaacgtttttggtgttcatatcctatcaatccatcgtgcttactaactcgtccgaagataccgatttcaaacaagaggacaactgatgtcttgtactaccaaaaagttagaaaaagacgttccgattttgcagatttacagatgggccttagtactttgaggggcccagttgttaaatcacgactcaaatcgcatcccatcctacttccctgggcggctgggcctccactaattaatctcaatcaaaagtaatccttctattttatattattattaatcgttttaactttctttttaaaatttgactaagtttatagaaaaatataacaacattttaacccaaaacaaatatattatcaaaatatattttatgttaattttaatgaaattaatttcgtattgtagatgttaataatttttcggaattgctagaaaacttccgcaagtttttttttgcccccaaaaaactttcagatttgtggccatcagatcgcattgagatttgtgcatgaaggaaaataattggtagaaagaaattttcacccatctcacgcgtaagaacttgatgctaaccaaaacatagtagaatataagttttatataagttatattacagttacagcgcagttgcagtgtggttacgatgtaatttcacttcaattatattatagttatatctgaaaatttttcactcaaaaaacttactgcggttttcttaatactccttaatctttctataaatttaggtaaacttaaataagtttgattaagaaaaaagttaaaataacttataatataacctgttctttcttgtttctgcaggcaaagttccgtgtcaggtcagtggtgacgatggcgctcttcttctccctgacgacgccggccggcatcgtcgtcgggatcgggatctcctccgtctacgacgcgaacagcccaacggcgctggtggtgcaggggctcctcgaggcggcggcagcggggatactcgtctacatggcgctcgtcgacatcctcgccgaggacttcatgaagaccaaggtgcagagaaggggacgcctgcagctcgccatgaacgtcgcgttgctgctcggcgcagggctcatgtccatgatcgccatctgggcgtgatgagtgagtgaccatcacggccagcatgcgacgtgcggcgtttcaatttgttcggcaggaatggcaggtttttgttcttaggcgcgtctgatcacgctcgcgctctcgcgaagacctgagaattcgttcgaggatctcaaaagagagaccactccgttggttgaaactgacgaggagaggggtctcccgtgcacgatatgtagaacagttcagtgaccatgttactctgacttgactgactgacccgtcatcgtcgtcgttgctctcttactgtgcagaacttgtagagtcgtgcacttgcgcctaccactgtccttcatcttggaggacaataatgccagtggtgggcagaattctggtcttgatgtgaatccgtgatgtacggggtaagacaaggctcgtgaatgagtatactccatatctgtaaagctctatcatatccgaaggtcatcacgagttagttagagtgttaatccttcctttctgggggaaaaagacattatcaagcctgacgctgtccatgtgttcagcttacatctaaacatggagcagtccgataaaaggatattccatatatgtttttccaccctccagaagtaccactcttctacattttacaactactcctcaatcatttttttttcaaaagaaactactcatcaatcatcatgcagtagtatcttttctatagcaaaaatggtgggggtggaggctccctgtattaatttggagaggatgggaactataggccctgtttgcgctaggggctctccaccaccactgcaacttgctccgtctccttttttcccagtcttgcataccgtaaaacactataatatactttaacgaactctaatatatttgtcctcacttttaatgaatttcaatacgtttatcctatattttagcaaacttcaatatattgtttaatcggttttgctatagttatgtcgccataaatcttctctaattacagtcagtttgttagccctcaaagtttcgtttagattcatgcaggactacttaatttgccatcgtgcgtgcaagcactagttcgtactacatacacatgcacctgtgctgcttgctgtgatttatccgatcgatcacgttcctttgctatctacatgtaaaattacactctatttacatatgtaattttaatatttacatatgtaattttgaaatttacatatgtaatttcgagatttacattataaatatactaaaattacatatgtaatttaggaagttacaatgtaaatacatgccgactattttttggtgaaaaatatggcgccataaatatagctacacccttgtttaattgcttcaaagataagagtccttgagggacaaacacaaaaataaagatactttgttgatttgcaggtgattaccgctgtataaaaatacatactccctctggttctataataattgacacgttttggacagggttgaggttaaatttttataactttgaccatcaataactttaaaaatatt

SEQ ID NO: 627 - DNA, 3005 bp, Oryza sativa; identical to SEQ ID NO: 345

SEQ ID NO: 628 - DNA, 4089 bp, Oryza sativa; identical to SEQ ID NO: 367

SEQ ID NO: 629 - DNA, 4230 bp, Oryza sativa
caggtggtttccacgaggtaggtggggcccaccggtcggcctaacaaaagaagaaagagtcgaaagcgtgccacgcgcacaagctgccaagacggaaccatcatatcggtgcacatatcattggcggcaatgcgtagttgacacctggacggctcaacataaatccatgtactactggatgcatgtgtcgtcatcgtctttagtacagtatgtgaagaacaaattaaagccgatcgatccatttgttttgcttccatatgcatgagtttatccacaccacacgtacgttgtggtcccccctgcccactggtagctagctgacgtggagccacgtacgtacaattataattactgtgtatatatgcatgcgccaaggacaggtcattagcttcttgcattaccaattgtccttgggtggtactactacgtacgcggagtaatatttgttttagtatatcatgccatggttaatggtttgacgatattctcttctcatggtatcttatcttcgccttataataaatttattttgaatgtatctatattcatattataaaataaatttattttggaatgaagatagaagacgattgaaatatatatttgtatggctctttcattgtattaccttcatttgccactgattaattttacaagagttagatttgactttttgaattatttgctactaacttcaataacatatgaagccatagagagtactaagaacaatgtcattcttttttgaaaaaagataaatagtgaaactttgcaaataaatagtaatccggtgacaaaaaatgcaacgatcaaaggaggtagcaagtagtacaaccctatgtcaaactgaacttacgactaaatcgcttggacgctgaaatttcaagttatttaatctgacatgcatggttaagtgtcaaatgtggtccagtctttggtactcacatccacgccacctactaataactagttaattgtctattgtgcccctagttaattagctctcattaatcaattgctttgtagtaatccatccatgcacccacctctctttctcccgaacagcaagaagatgagccaagcccatggcgtctataaaagagagccctaccccctccatctcaaaaatttcaatccttcctcttccttagcttattagcttccttccttcactagtgccagttttcctcctacgtaatctaagctagccaggtcgtcatcttcttccttcagctcacgctgaccaaacaccatctgttattctgtttgtttgtttttttttaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccatcaagtgccccgtgccaatcatcgccgaggtcaacatctacaagtgcaacccatgggaccttcctggtaactaactaactaatcaccatacatatataaactatccatgtatcaattaaactcgatcaaattaatgccttcaaactgaccaaatttaattttgggctttgaaaatggatatggaatgttgcaggtaaggcgctgttcggcgagaacgaatggtacttcttcagcccgagggaccgcaagtaccccaacggcgcacgccccaaccgcgccgccggctcggggtactggaaggccaccggcaccgacaagtccatcttgtcaactccgacgagcgacaacatcggcgtcaagaaggccctagtcttctacaagggcaagccccccaagggcgtcaagaccgactggatcatgcacgagtatcgcctcacaggcacatcagctaacaacaccaccaccacaaagcagcgtagagcatcatccatgaccatgagggtgagattcatttaattacttaattttagttcattattaatttgtttttctcttcgtcgtacgtcttctttgaaagctacgtcgttgtttgaattggcatattgaaggaagcaaacgtgcatgttgctcttagttaactcactctacaaagtcaaatttgttgatgttgattgagcttgtgttttattctttattttaaaaataaataaagcaagtttgcacacttctaattattgtttactgcatttgtgatattgttcatcagctggacgactgggtgctgtgcagaatccacaagaagagcaacgacttcaattcctctgaccaacacgaccaagaacccgagggatcaaccgtcgatgaacagcttgaagacatccatgacaacaactcttcctctcaacaacctcctgctccacctgacatgaacaaccaacagtcagatttccagcccatgacggcgatgagcatgagcaagtcatgctccctcaccgatctcctcaacaacctcgactgcgccgcgctctcgcagtttctcctcgacggctcatccgacgccatcgctgagcttcctgctcctcccagccctctaatatatccaaaccaaacactaaactataacatcaacaacaacatgccacacgccttcgagtcacgcctagatcatcacgatggttacgttaacaattataatgttaatggcctaaggaggaagagaatgatggcgtgtagtgcaacttcttttgatgatggcagcagcagcagcagcagtgactttttgcatgttgccaagaaaccgctgctgctgccaagtgattcaaggggcagtggttttggaggaggttactgcaaccagcagctttcagagactgcgactggttttcagtttcagaacggcaatatgttgagccatccatttcctctgaaccagcagctactgctgaacaatcatctgcagatgcagtagctagtaggcgtctagatccgtttaccgatcgatctgaagagaggtgaattaatttcaacgaatgaaactacagattcagagaggaagatactgattgttccatttggatttattttgaggagttgcatgacagatagacaaacagacggaattcttgatgtaacccatgcaaggaaagattcagatttcttcctatggcattaatttgtgagtttttttttgttttcattttcatgtacaagaatgtaaattataaatggtaatatcgtgcaagctagtactcaagccaatttatatgataatctttatgcatgtttcttaattattctggtatcaagcacacgaaagaaacatgctactttgtcgttgattcattggaccttacaaattaaacaatttgttcttgtctgaatgtgctgatatataattggtcttgtactatgcaaaggactagttggtgggctagctagcatttgcatcttcaaagtttcaatccttatccattttgaaaggattagataaactttacagttgaggtcggaatatacctttgcctgctcaagattcctttcgagtagattgagatggctctgatcatcggcgccaaacgagtgccctgcagctaggagtagcttgcataacaccacttgtacatatagtacgctgatcaattgtactttcaaacaacaatactgactaaattcttgctcaatttgtcaaatacttcaggacaaaccagctgcttcatcaactaatctctacgactccaaccaaaatgacaaattaatggtcgtcttgtccacaattcagtactgaggaagaactgtgcttcagattgctagaccaatatccgaaaacgcaatggcgcctacttaattaacacgcgtcatcagcgacctaattaaacaatcaaaacagcattgtttatgtcgttcaaggacaacggaaagacggcggcagagcacgttgctcaacggagtggttgatcaagcgtgcaaatagcatgacatcttcccactagataagcccaaattaaactaagttgattctctccacttgcttaaccacgtctccctattggagacagcgatttgtttattcttctgaccctaacaattcatcgtgtgtcctggtctacctctacggctctagctagctagcaacaaccttcaatctctcccatagattggattaattagtaagcaatcaccaagaaacagctagctaaagcatgatgattaagtcacgctcacacatgcatgttagagaggctgcttataattggtgcttgtgcactagtttaggtgaaggattaggataggata

SEQ ID NO: 630 - DNA, 3806 bp, Oryza sativa
aaaatataattgctcctttcatttaatacttatatcacaacatgtagccatatgagccaaaactgtattagccatattttagcgaataaggctcaatgcgattctgtgtctgagctctggcctgaaaattcttgtaactttatctcacatatggtgtgtgaggaagcttctcatgagtaatatattccctatttccccgcaaaaaaaaaaacttatatcacaacaaaaatggaaaagaccaacactgagtattgtagaagctagtacttttggcaaatgtgcccgaagatccccaaaacagtttgtggcataattcagaagattgttagctcagaaatcatttcagactaggatattgccgacacatcagagttctcgtgtaatcacgaagcaaggaactgtacagtgcagtgatgatatacaactataggagaggacgaactgatactgacggatgctgtgtgtaaaatatctctgtaaaatcaggaatactgggagactgattggatgataggtttatacggtcacaatcatctcgttaaacacacttttcattaaagaggaattaccaaatacagtaattgattcgacggtgccgcgagaaatgtgctatatataaatgctcacctatatttgggcagattagttaatttcaggaattttccacagagaaagctaaatgagtgctaaatgagtcgcattgcgtactactacaagggtccaaacagaaattgatatctgaaattagcttttcttaagataacaatgatatttttttttattgaagcacaaggtgtgcctgaaatcgaattctgaaaggtattcttatttttcagaggaaaatgtacagtggtaccattctgaaagctaattgagagatgacaaggcgtgagaaggaccaaactgtcctatatacatgtggtcattttccatctcttgcaataggttatcaagacccctcctgaaacatggaccgtccagatgcgatccgacggacgaaaaaaaccaatggcagaatatttcaggctctggcatatccaaacataaataagtaacataaggttcagctctgctccatccatgcatcgcctccattattcatgcttcgattctccatgctttcctctactgctcattggtaacattcggcaaatttgacaggtgagctcagtattttaaatcttaatgtagtactttggtgtgctaatctttgctctgttcaaaagagaattctggtttctttgctattttgaaaagagaattttcgttacaggacttcaacttccataatacttttttttataattaaggcatgatatatatcttctttctgaattccacgggaattgcactttttcctgagaaatttgtaaagagcatgcctgttaattgcaaggggcccctaactctgttatgagaaaagagaactatataagatgctcaataagcacctctttttttttttctgttaactgaccaaagcctgtctatctgcatttttttttgttttttgtttttcttgtgtgcagatgggtatattggtcatcttggtggacctgcaatgctgccgctgcgatgccaagatcaggaaggtcctgggctgccttgaaggtataataaattctgcccgaatcgtccatgtttgattgaattttcaaggctaatcagcagtgttcctgctcaattgggagcaaaacctctgttaaaaagggtgtgtttgaatgaatataattgaatatgaacgcagaggagtactgcatcgagaaggtggagtacgacgtgaagaacaacagggtgatcgtgcgcgggaagttcgacccggagaagctgtgcaagaagatctggtgcaaggccggcaagatcatcaaggagatcctcatcgtcgacgtctggccgccgccgctgccgcagccgccgccgccgtgcaagccgccgccgtgcgagaagcctccggaggactgcaagcccaagccctgccattgctgcagctgcgagaagcccaagcccaagcccaagccctgccactgcgagaagcccaagccctgtcactgcgagaagcccaagccatgcgagaagccgccgccgtgcaagccggaggagccgccgaagccgccgccggagaagccgccgccgaagccggagtgcaagctggtgccgtacccttacccggtgccgtacccgtacgccgggcagtggtgctgcccaaagcctgagccgccgaagccgccgccggagccaccgaaggagccggagccgccgaagccgtgcgggtgctcgcacgccttcgtgtgcgtctgcaagccggcgccgccgccgccgccgccgtgcgggtgctcggggggccacgggaactgcggctgcggcatcaggccgtggccgccgcaggtgtggccgccgccgcccgtctgcccgccgccgccgtggtgctacaccgaggacaacgccaacgcctgctccatcatgtgatggccggccggcggtcggcgtcgatcacgatcatctctgctgcttaatttccttgcttgctactacctctgctcctttccttgcctcggaaatcggaataaattaaacacgaggctgatcgatgtgtttgtaattaatccatggtgtttgtgttgtgtgctgtgtgggctgtataataattaattacagtatgttcatgtaaatttgtttgtttgtttgtttatgttgttcgatatgtataattatgtacaataattaatcgtggagaggctcactaaactcataaactgtagagtatcttggctgtaaaagtgtggcaatttatctttttcttgtgttagcattggctacaaatagtttttggccgtcttttctcttcgtttctccccttctttatgagattaattgtgtgctgacctagatcaaattatagcgcgctgacctagttttattgtaactgctcttatggatgtctgctaacaccatcaaacatgattaccgtggtatatttgtcttaattactactaactaggactacctaggggcacccttgcatatgtttttttttcgaacgaccagatagatttgagtcatttgactagcgttatattaataggagggaaaaaaaatacaaagtacaaatatccaacaggccgagaaaagagaaaaaaaactgtacatgcctacgtgcaaacaagattgcacgaagctctcctcactcctcatggcaacattctcccaatgtgtttagcatcgaaaataccccaccaacctcgtcttggatgtgactggtcatttggtgtattgtcgcctccttttccctctgaagattcttacgttccattccttccaaatttcctaggcgatgagcaagaaaagagatctgagccctttttgtttagttacttccaagtcgcttgttccttgtgtccaccaatgcaagaggtttctactgtcattccatttcagaataagccaattgagaactccaaaccagatttacttcgaaaccaggcattcgaacataaggtggtcgacaatgtcgagattccggattagcagagttatttggtttgagagtcacattcctacaaccaatagaaaaccatcctatggaccatttagatagtgtcctagtatttgcttttatatttgctataaatattcttcctttattgtttttggagttcacaaacttaataatcaaactttgtgattttttaatttccattaacgaattcaaggaaccacctttatctctcatcttcattgcacactactgatttctttcatccttagggacatatggttgatacggagactgtttttctatcattatc

SEQ ID NO: 631 - DNA, 8011 bp, Oryza sativa
ttcttgactttatgttatacccataccgcgtggataaggctggtgggagatattgtaacaatttcgaaaggtttataaaacacgggacaagaaataggaatgagtaaccacttatctcacatgctatgtagaaatcataggcagcatacagcctgcatggaatcaatatggccaaaacactaagtacaggaaatattaaaaagtcgccaggcccacctgtcaaagctaacccgtcccccctcccctctcccatggcgcacaaacccccatctcctttagagaactcacaataatacatttttgtgtaggcttggatcccaccataggggaaggggtatctcgtgtagctttggattcggaggacattttgcaagtcgccaattccgcatgaagagagggtgtggtccatacagagaaagagatagtggcacctcaagtgtcggggatggaaaatgttgatgccgttattgtaaggaagacattgttcccgagacgtaactctaatgctattgagacatcgtagcaaagaagactacctctataacagctacaaaatggtcaaactgtgaatttgtgcctgaattcaatgtggtagttagcaccttgatcctggttaccactacctctcgagtagatggcatctactcgagaggtagtggcagccaagaattaacaacataggccggtgatgacgagggagacagcaccatcggtgaccatgggaacaagggagagggcattaatggaagtgttgctaacccaaagctactactatgaagataagtactgtaggattagtactctcaactcagtggcatgcttttatccaaaaggctacaatcaagagttgcttccagggcaaatgcccttagttatgctttcttttttaatccccaatgggctctcctctgtagaattttcttccaactttatcctctttggagtttggcctaacctaacatctaattatatagttaccatcgtacaacgttactctcaagcgagaaccaagtcgtcatagttccaaagtaggaaaagttattccattaattagctactcggtccatgcaaagatcgtaagcatatttattttatcatcgagaccaagaaaaaaaattaactcattcgatttgtactcccatgtaacaaactttttcatatgcatgcaaaagggttggagaatgcatggcagctcaagtttcggtcaacaatttaatcatacacagtaaaacgaaaagagactctcttcatttaaggctcggatgcatggagactatatgaataagctcatctcatttggaaaaaaataatcaaaacaatgaaatatgcttaatacatttggatttggatggagtatctccctatgacgaaagagacgagggattgcctacttctttccacatcaacctttgaaggctatggcagagctacatttgcagcgcagcctctctgcatgatttcttactagataggattaagtttcaagagttaatttcttgtactcttgggcgatccatgctgtcaaatcagcaactaacgaggcataatctcgatcactagctctgatctgatcttcagctagcgccggcgagctgcagaggtctccatccatggcgccggcggtcagtgcatcgcagggtgtcatcatgcggtccctgacgagcaagctcgactcgctgctgctgcagccgccggagccgccgccgcctgcgcaaccgtcgtcgctgcggaagggggagaggaagaagatcctcctcctcagaggcgatctccgacacctgctagatgactactacctcctcgtggagccgccgtcagacaccgcgccaccgccagactcgacggcggcgtgctgggctaaggaggttcgcgagctctcctacgacgtcgacgacttcctcgacgagctaacgacccagctcctccaccaccgcggcggcggcgatggcagtagcactgctggtgccaagaagatgatcagcagcatgatcgcccggcttcgaggggagcttaaccggcggcggtggatcgccgacgaggtcaccctgttcagcgcccgcgtgaaggaggccattcgccgccaggagagctaccatcttggcaggcgcacctcgagctcgaggccgagagaagaagtcgacgacgacgatcgcgaggactccgccggcaacgaacgccgccggtttctgtcgctgacgttcgggatggacgacgctgctgtgcacggccagctcgttggtagggatatttcgatgcaaaagctcgtccggtggctggccgacggcgagccgaagctcaaggtggcttccattgttggatccggaggtgttggcaagacgacgctggccacagaattctatcgtctgcatggccggcggttggatgcgccgttcgactgccgggctttcgtgcggacgccccggaagcctgacatgacgaagatcctcaccgacatgctgtcacagctgcggccacaacatcagcatcagtcttcggatgtttgggaggttgatcgactccttgaaactatccggacgcatttgcaagataaaaggtaattcatgtctacatctatctctagtatttttttcatgaatttacaaactattttctcaaatttccccttttttatccttcatatagtaattaagttagtaactatacatatgaatttaatttactcgacaatgccaataatattttaaattacttttatagtgccctctattagtagatacgattcgatcgagccatgaattatactggtaatctaaacaattattatacccacctcattctactaacagcaattgagttgttaatataaatagatatggtctattgcatgaaaaaataaaggtaaagtgtttacattatttctactactagtagaagaactacaaagttgtttgtatttttaattattaaatgtaaatgaaagtatatgtttcatacccttgttattttttttaggcgactaaactactagtacattatttctactactagtagaacaactacaaagttgtttgtatttttaattactaaatgtaaatgaaagtacatgcttcatacccttgttataattttttagactaaactaccacaatggcatgttaacttatagcagtaagttgtaatttattttcttttcattttctcagttgttacaagaacttttttttacttaataaaaaatagtcgtaagggcctcccttgttcggtcaaaaaagaattagactaaactcaatcgtatttgtacataaacaaaatttaaaatataactaaaacgaaacagtgataaaaatggtgcaatttaactgctgcctcttgttttaatgtctgacaatgttgattttgtatatatgtttggccatttattttattcaaattttttacaaatatgaaaaatataatatatgcttaaattacttttaatgataaaataaatttaaaaaaatgataattatatttttaataagatggatgatctaacatatatatgtccaaaagtttgacatcaaacattaaaaacaagagagagtatttgcttaggagtacgtgtctttttccatgtctaagaacaggtacaatagcaggttataagctagctataaacatattttaaagagatataggaagagagagaagagcagcagcctacagatctgtagccagctgcagcacggactctaagacgtaatgtgtgtatgacaggtaggaccaagtattaatagtatagtaagcaactattgtatgaattggctatttggctctagatgatttggagctagtagtcggctatactattaaacttgctcttagatatgtggttaaatttaatttctgaaatttacaagatatagaacatgtcttcaccatgtttgcaaagttgataaaatgaaattgcactcaactttttaaattcagcatgctatcccacgtatagctttttaaatatgatttattttttcgtacattagaagtttaatgtttacgaagtactaaatgttctgcaggtacttcatcataattgaagatttatgggcttcatcaatgtgggatattgttagccgtggtttgcctgataataatagttgcagtagaatactaataacaacagaaattgaacctgtagctttggcatgctgtggatataactcagagcacattattaagattgatccactgggtgatgatgtctcaagtcaattgtttttcagtggagttgttggccaaggaaatgaatttcctggacatcttactgaagtttctcatgacatgataaaaaaatgtggtggcttgccactagcaataactataacagccagacattttaaaagccagctgttagatggaatgcagcaatggaatcacatacaaaaatcattgactacttccaatttgaagaaaaatcctactttgcaggggatgaggcaagtactcaaccttatttacaataatcttcctcattgtttgaaagcatgtctgttataccttagcatctacaaagaggactacataattaggaaggccaacttggtgaggcaatggatggctgaaggtttcatcaattccatagaaaataaagtcatggaagaagttgcagggaactattttgatgaacttgttggtaggggcctggtccaaccagtagatgttaactgcaaaaatgaggtattgtcatgtgtagtgcaccacatggtattaaatttcatcaggtgtaagtcaatagaggagaatttcagcattacattggatcattctcagacgacagtaagacatgctgacaaggttcgccgactctcgcttcacttcagcaatgcacatgatacaacaccactagcaggtttgagactctcacaagttcgatcgatggcatttttcggacaagtcaagtgtatgccttccattgcagattataggcttcttcgagttctgattctttgtttttgggctgatcaagagaaaacaagctatgacctcacaagcatttctgaactgttacaactgagatatctgaagataacaggtaatatcacagttaaacttccagagaagatccaaggactacaacacttgcagacactggaagcagatgcaagagcaactgctgtcctattggatattgttcatacacagtgtttgttgcaccttcgtcttgtactacttgatctgctccctcactgtcacaggtacatcttcaccagcatccccaaatggactggaaagctcaacaatctccgcattttaaacattgcagtcatgcaaatttcccaggatgaccttgacactctcaaaggactgggatctctcactgctctttcgctgcttgttcgaacagcgcctgcgcaaagaatcgtcgctgcgaatgaggggttcgggtctctcaagtacttcatgtttgtctgtacagcaccatgcatgacttttgtggaaggagcaatgccgagtgtgcaaagattaaatctaaggttcaatgccaacgagttcaagcagtatgactctaaggagacagggttggaacacttggtcgcccttgcagagatctctgcaagaattgggggcactgatgatgatgaatcaaacaaaactgaagtggagtctgccttgaggactgcaattcgcaagcatccgacgccgagcactcttatggttgatatacaatgggtggattggatctttggtgctgaagggagagacttggatgaagatttggcacaacaagatgatcacgggtatggatttttcattctattcccaggttacaacttacaaggattattgagcttctttctttctctgccgtggcttctatctttaccttctatgcatcttcaacctgacttgatgattgtttgaaaccaattttaatggaagttaaatgttattgttgtgaccctgaatcaggttttgtatgctaccggaatcctcttcacgtcttcagagtagaggtaattttgtttcttgtcattttacagttacagttcatctacttaaggaattaatgggaggtcctatattttctcgggtacctagaaggtgtggttcctagtcttacctccttaagaaccgtagaatgttggccctaacacttggatcaaagaacgaaaggtgtatgcactatagtatcctttatatattgcacaagtcaagacatttgttaaaacacacccagtgctagtaatttgtttactgagatatgaattatcgccaaatacccatactgagcctattagtaaaatatttacgaggtgtttgaggacagcataactttcagtaaagaatttactacgtgaggtgtgtgttttaggtattgcgcatcttgggtgcattttagcgcaaacgtgtataatatatatcccatggtactaactcatgtcttaaccataattgcacaccaacacaaaacatacactactacagagataagtatcgaagaagacatgcccaccggtgcggaagggacggtgattgtgccccacacaatggagcagttcgccctccacatgagccaagccaagcaatcccacaagctcgtagtcatccagttcactacttcccggtgccctgcttcacgctacatcgcgccagctttcaccgagtatgcgaaggagttcgctggtgcggttttcattaaggtcaatgtcgacagcgatgagctggagagtgttacggactggtatgacatcgaagggatagtgccaacatttttcttcgtcaaggatggggagaagattgacaagattcctggtgctaacaaggagttgctccgagccaaaattcgaaggcacacagcttctccttacttcctccgttgataatgacttcttttatcgtctttgtctagtatatatatggcacttatatagttaactaggaagggcaccttgtttaatgtagctttcatttttattatgaatgttaaggatgatattatattgttgaagtatttttttactccttgtaaacatgtattggttaataacgaagtagtttggacattagttatgattttcttctgattacccttgcaacatataaactccatactaaaattattaaaaaaaatgtgtcataataatggagttggtttatatctatttgtactatgtgtgatttttttaaaatatctagcatatcagtttccaaaattttactaacaatttttcttgtatgctatcaatgactttatggatttattatagtaatgaaaaatatttttcattaaaacgtagctaatagattactttatttaagtaaaggtagacttatattggttatactacctccgtcacagcacgcatcatgaacgataaatcaaatgaaattgatgaatatacatgacaatcaaagaactaggcatagaggctgtagaggctaggtccttctcctagcctcctcctgccatgcatggcagctactgcgtccctcgatttccctgccatggcagctgtggttgtcgatgatttggcggcaatctggcgcacgaaggtcaagtatgagcaaagcggcaataaatgagtctgttcgggaagcttctagctgatatagtttctctcataattaaaaggtcccctaaataatatagctttgattctaaaaaactgtagttatttaatatagaaaataaactagaaattaatcaaacgctgggaaacttagctttttcacattctcagaaattgaccaccaaccaactacttcccgtaatcttaagcaccctaaacagacgcggtgatgacatgcgtcgcttctgcttctagccgcgtagtccgcatccccagcaacgagcaaagcggagccgagccgcgcttccacgcgtggagatcgtgcatgcggctagctgtccgtctcttcacgcaattggagccgtgcagtcgcaccataggatcccttcctcaaccacttgtcgctcatctggataagggctgctcgggtgaggtttgtagccaggtatccaccaaattgccctacgcattgtagccaatgcaattagggatggcaattt

SEQ ID NO: 632 - skipped

SEQ ID NO: 633 - DNA, 4514 bp, Oryza sativa
gaggagatcccgaggatcatttcctctctattgatttggccggagaaggaaaggggcggccggattggaaggaaacagcggcggcggctcggcggcggcgcgctagggtttcggcccgaggaagacgacgggcctgacaggtgggacccacctgtcagcgactgaacgcgcgcgcgcgcgggcggctgcgaactgggccgacttgggccggggagagagagaaggttttgggccgactttcggcccaaagcccaaaagagaactttttaaaactttttcaatttaaattatttcttaaatgcaattctatttattaaaaatacttccttagctcaaataaatcccagaaaaatctaggaattatagaattaagcaaagtatttaatgaaattttatctggccccattttatattggaatttattattaaacttagattttcttttcaagacttttaaaataaattctagaaattccatttaaacaacaatttatattttttttgaatttttagggtgtgacacccgtccaccggtgccaccgacggcgacagtcggactcggcagctcttcgccgaatccacggggaggatagctgggtcggcctcctcgactcgctcgattacgacctccgccgcaagatcctcgaccaccgcgactttgagcaggatgttgctgcggcggcggatggacggacggcgtggctgacacgaccggcgacaccggtggatggacgggaacgcggacggatggacgacgcgactgacacgaccggtggcggattgacggggacgcggtggtggcgccaacggatggacggggacacgagcggcggcgtcggcggatagacggggcggcagacggacagacgaggacgaggagtgacgtcagtggacggagtggtacataacgaagaaaattcgcatcccagtggcatattctgaaaatagtacgaattggatggcatatcctgaagtggcaaattctgaaaaatctcgatccaaacccccctaatccatccatcgaatctcgttgctcgccggtcgccgccccgtctcctcgcttgccggttacaaggacgacctcgtcggggcggcggaaccctccagcctccgggctcgccgccgccgccaagctcgcatcccgcgccggccgccgagctcgccgcccaaccccaaccccaaatcaatcagatcaattcaactatccaagcctaagttgttggatctagaatccatggcgatcgtttacgcggtggtggcgcgtggcaccgtggttctcgccgagttctctgccgtctccgggaacgccggcgccgtcgcccgccgcatcctcgagaagcttccgcccgacgccgagtcgcgcctctgcttcgcgcaggaccgctacatcttccacgtcctccgctcccctccccccgccgccgccgatggcctcaccttcctctgcatggccaacgacaccttcggaagtacaaactctcttatacttactagtattactctactaatctatatgatctatggataggataagatggattcgttcattcatcttcttagtatgttcttcattcattcaagatggtaaactgtattgcttcattagctaatttaggcatttttgcatgtacttattcatttatgttcctttcatacaactattttactgttactactctattagtagcgagccagcgaaatccagacatactagtatgatagagcatcacttgttgtataattaattacaggacgaattccctttctttacctcgaggacatccaaatgaggttcatcaagaactatggcagaatcgcccataatgcgctcgcctatgccatgaacgatgagttctctagggtcctccatcagcaaatggagtacttctccagcaaccccagcgccgacacactcaaccgtctccgtggggaagtcagtgaggcaagtatcctatttatttattgccttccacacaatttcctttcatttttgctctacaatcaaatgctcattcttccaacttgcattgtgcagatacatactgtcatggttgacaacattgagaagattctcgacagaggtgagcgcatctcgctactcgtcgacaagacctccaccatgcaagacagtgctttccacttccgcaagcaatccaggaggctcaggagagctctttggatgaaaaatgccaagcttctgtaagtcaccctttctttctttctttcttgcttactactgtactatctatctcttctcttctttaccactcactgacagtacccattaactagtggtcagtcctgcactcaagttcatttgttacaagttactccctaatgacaagtcctgattgatgttataaggcccttcgagattggtacttagccatggacatttgttattccctttttttcctgccagttatagtttaccaaatcctgaattcagcctgaatgaatgtataatcacaaaagtttagagccaacaaagctgcaatttccttttctgaggccaagtctaaagagctttattcatcagtggaaataccattttgcgcgatagtatctcctaagaattcaggagtgcatgtttaaatgagcacactctgcacaatgatgaagctgcaatttctttgctagtccaaaattatgtaatcatgtgccttcggttggtcattattgttgaatagacatgttggataagtgtataactatatatcactcagtgacccttgttgaatggaataagctggtgtatcattgagtttgagaacaatgggctattgctattctgtttttgctggggtttgaaagaattggtgattaatagcaggcataacgaaatactactagtttttttttaaggatctagaaaactgtgtgtttggttgctgattgccatacattatatgtataagatccaaccctttatttattatgatgactctaagatctacagtactaataacatttttgacagcatctgacatattttgtcctgcgttgttgcagtgctgtgttgacagctgtcatagtacttctactttacttgatcatcgctgctttctgtggaggcctttctcttccatcgtgtagatcatgatccgctctacagatttacctcaattaaagcatcacaccatgtaacaacaatgcaagcctatcaatgccatgtgtcgtatctgttcagcacccaaagttacaagtgatgttttgagaaaatgatttggtgctgagttttcgttatcgggagggttgtgctccttcaagttaatatggaacggtttgtacaaaatgggatctatatgtacagtagtatgtcgtttgttgtttgtgttggctaagacttttctgtaccgttgtgcttgcacatgaattggatgttttgcctgatgatatgagtgctgtggtatgccctttccttaactaaagcgaatggcatgtaatattctcaagagaatatatgaatatggtttatgagtaatgttatcctgataaataaattttggaagaagggaaattctgcccaaaattaagtgttgattactacatggagtgtgatgaaatgatttgtagctccccgggatcagctggcgtgatgaatgttcaggtagtgggttggaatggcgtctctgaatctctgaaactttcagaatgctgaagtaatacaatacagagctgaaatttgggaggacatttagggtaacgacggaggagtctataattagtgcagggagttggtaatacattacattgatcgatcaggtagaaagcaaaatgaaaatggtgcagcatggtggattgcagatggcagagcgagcgagcagttagaaagaacgtcttttcttcacacacatatatacaagtatggattggaactcatcatttagtccttacatatacacccagcaacggtctcaggtcaatgataagagttgattattaaacagttagtggtatgatttgatgacccaaacaactacaactcctctgcaaatagagtaatatgtatatatacctacatagatagagggatagattgccaacaagatagatatagatcgatcgatcaatagtagcagcagtaggtaaattaaggaagcagcagaagagattgttaattaattaattaattaattaagcagaggcagcatgagcgggatttgtctctcggatcaatcttaaatatctgaagaagctaatgatgttggccttgagcaatacttatacaaatttgtctgaacatgaataagatttcgtatatatgcttcttatgaataatcagaagaacagaattacattgattgcaatgccgatgttctaatgcaatcatcaatcttaagacaagagtaccaatattacaaagttacagacagatcatatactagtaaatctgctaatgccgcggtggatgactctgattctattgcgttcttataacatcatcctgaaactactgcttttctgtttgcagcatcctgatacgtaaaagtgcagcaacaattgagaaacaa

SEQ ID NO: 634 - DNA, 3591 bp, Oryza sativa
ttttaatgtttaggaggaaataccacatacttaagtgtcttataggtaattttgcgataacagaaatagaagactatggtaaaataaatgtcttgtacagttgtactacagttccgtatattgacaggtgtagcgtgttcgaccatactaggctctcaaaatttaggggcctaaattttagatttcaattccatgaaaggcattttaatatgtcttagaatattataatttgttttaaaagtttcactcatcttcctttatcgatctaaacaagaacatgcttttttttttttactttggtaagtatttgtgataatcatggcgatgatgtgaacacgcgtgccgaacgtaaaactatcattttttttacttagtaaagacaacaaaaccatccgtgggtattaagagcaagtacaattgtaaagatatagcttagctacaagcacatatgaaaaaggaagaaaaaaacagaccataaatttgtagtgtgagagatgagccaagtattaatgattcaatgtatagtagactattaaagtgactgtagatgatgtattaattttgaaaggtagcagtgggttacttgactatattatcaaacttgctctaacactgcggtcttcaatttataagtaattaagtacggccctggtaattctcacaatctcacctagccaatctctccacacacccttgaggccttgacgtagacccctgaatcaacccaagtggaaaaactatcaacagtccattagctgaactgaactgaaactgctaaccagtaactaacctcctcacacctcccaatctcgtccacagcatacacacgtctacgcatgacgtacgcttcgtgacgtaaggcctcatgccctatacgcgattcgtgacgtgcgctccgtgacgtcgtcttgaccggggcgggacgacgccacgcgcgcgtggcgcgtccttgtcatggcgggcgtcgacagccagctcgcgcgcgcccccgtttttcccactcaattgcgttacagttttctcccacagatccatgcaaattaaagatcacacggtctcgttctcgccgcctatatgtagcgccaccgattccccatgaaccattcaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggtgaggtgttcttgattgattgattgattgattgattgattgattgatcggttgattgctcccgcggattcggttcttgcttggttttgatcgttggaaatgtggggggattccttcaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcaccagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagcttattaggcctcatgttcttctttatctctttgggctgcaaggtcctcgttatgcgcttgtgggcttattgggccgcaatgtcatcggagggattgttgggccgaacactccttatgtgggagctcagcccacccggcccaacttaaaaccattatgtccaaagcgtgaccaccaaaatctaaatgcctggttagcatttcacaaaccgaagaaagtaccagattcagtattcatagtagtttaatttaaataaaataccatgataaataccctagtcctgcacagcagatcggatttcaatcaccagagcagccaatcagtaaaattctaagggcaagggcagcacaaatgctcgacaaacagacataagcatcgaaaagacaataaatgcttgagcatacaccagacagctacatatattagacatcaaagtttttagatcttcaccccaaaatttttcaccctgtcacatcgaacgtttgaacatctacatgaagtattaaatataggctaaaaaataactaattatacagattacgactaatttgcgagataaatcttttaaacctaattgccccatgatttgacaatgtgatactacaataaatatttgctaatgacagtaaatatttgctaatgatagattaattaggtttaataaattcgtttcgctgtttactaacatattctgtaattagtttttttattcgtgcccgaacaccccttacgacatcctatataataagacaccctatataatatccgatgtgacacgccaaaactttctactcctggatctaaacacccccttactatctgtaaacacgaatttctaccacttcttttgggacaacataaagtggttaaatacacggtaatacatgtggcatgagccatttgcaattttgcacatataaactgaggtgccgccacggaatacatctggctagagtcattcgaaaagacatgagccatttgcagttttgcagatataaaccctaaggtgtcgcctgccagcagcaga

SEQ ID NO: 635 - DNA, 5388 bp, Oryza sativa
ttaaatgatgatcattttggaaagatctcaaaaatcttagctgatgatcaaactggaataggaggagtataagttacagacaatatatatatatttatatggaaaagagataacaaaaattgagaagtgttggttctcatgtactacctccgttccatattgatcatcatatataagggtgtgttcggatggaggtatttgggtggataggacatggcggcccattttttgtggttgtttagttggtgggcgggagtgggataggacggcacggaggggaattttcctcccagatgccagatggagggatccggccgatttgcccagatgcagccacccaagtacccaggcgagcggggcgagtgagtatcgtaggtcgtgtcacccctctcaccatgcgagctcggcggtcagcgtggaaagaaggaagctgcggcgagcccaaaggcaagaggcggcagcgagcccgagagccagaggcggcggcagctagaagagggtgcgtcgttgccgctgccgatgacgacgatgaccaggacgatgacaactggatctggaggagatggggtgtgccgacgaccggttgggtaggagacaatgatgatgacgacgaggatgaccaaatctagaggagacaggacagcagccggcgagagaggaggcagggcggcggcggtgagagaggaggcgaggggcggccgacgaagaggacatttttttttatttttttttccgtttttctcctttcctccttttatttcattctaatttttagtttctatttagatttttttagtagattggtattattttgggttcattgaatttcaagggggtatacttaccactactaatgaaagggtgattgcaaccactcatccatcctactcccccaactaaaaaaaatggatcaccaaatccacattcatccttacaaccaattggatcgccatattcactccaccaaacaaaaaaaccggattgccatatccaataaagtatggaccgccatattccatccaaccttgaccgggaaccaaacacacagtaagctttcttaccaaggcagaaaaaaaacttaaactgccatgtattttatttaatacatgagtatgtggtggggaagaattaagaaacatgcatacttttaactccccatttgcacaagaaacaagggtttaactacttctaaatgtctatatgcatacatgcgcgcatactaaatttgcatgcatagatacaataatgttgcacgtcaaatgagtagaccatggtcatatgatgatcaatttagaatatccaatttttggttatataatgatcaatgaaatggaggaactagctgtacacattctttacgaaaatgcatagtgagggaaagagagagcagagaaaaaatagagttaatcttataggtagcatatcatatatgttagctctacaataaatttataacttatagtgagctctactattaaatttgctctaaataaataaatccatctagattcataatgatagaatatgctaaattcagtactatggctgtatttagtgcacaccaaaatttgaagtttagttgaaatttgaacgatgtgatggaaaagttgaaagtttgtatgtgtaggaaagttttgatgtaatggaaaagttagaaatttgaaggaaaaacttttgaactaaacacggtgtatgtttatttatcttaggacggagcaagttctgtcgactaacctttaattattttttttttaaaaaaagaaaccactggccaacttgctttgccagctaatcgttgtctcattgccactggccaacttgctttgccagctaatcgttgtctcattgccgggctccagtagtgcggctggccgcacgactatagtatgtcgtagatctgggttggtgtgcgtttctctcctaaaataggacgtggtcctcgcagtcctgcagatatactatagcgacatcccgtgaaatgtacgatctatgcgtttaaaaaaaattagaattatatccgtgaaacgtacgatctatgcgtttaaaaaaacaaatttaggattatatgttatttaaattagtataacaaatctagaaaaccattatatatttgtttattaaagaatggaaggagtattccatggtgcaacgcaaatagcattgccgattctcaacttcttagaactcataagagaccagcgtttgagtctactcaagattaagattaagagcagacacacaaaacaagaaaggtaatagcacatagttaattcagttttaattatttgaaacataaaagatggatttatttaatattctaaagcaactcctgcatagaaagtttttgaaaaaaaaaactatttagcagtttgaaatgtgtgctaatgaaaactgaagcaaattttgtatcttaattaggccgagtttagttacaaatttttcttcaaacttccaacttttccatcacatcaaaactttcctacacacacaaacttccaacttttccgttatatcgttctaatttcaacaaaactttcaattttgacgtgaactaaacacacccttagaaaaaaatggaacctagatctctaaagaatggaacctagatctctagggtacgagtaccactagtctacattaaatgctctctctgtttgttatttgacgccatactatcttttccatctctactagttcacattaaggctccgttcttttttatttgacaccttaggccgagtttggttctaaactttttcttcgaacttctaacttttccatcacatcaaaactttcctacacacacaaacttccaacttttccatcatatcgttccaatttcaatcaaactttcaattttagcgtgaactaaacacacccttactgtcttttccatctctactagtctacattaaggctctgttcgtaagagggagttcacaactctcctctctcgttttccgtgcgcacgcttttcaaactgctaaacagtgtattttttgtaaaaagtttctatacgaaagtttcttaaaaaaatcatagtgatccatttttgaaaaaaaaatagctaaaacttacttaatcacgtgataatggaccgttctattttccgtgcgtagacaatgagttcccaaccgccacttacattaagtaccacactccaggcctcatcttctactcccaccgtcccataaaaaccaacctaatcaagattagatatacctagaacaacaaatgccaaatccccacctaggttaaaagatacggaaactgcatgagaacatatgtaagcttgtgcaattacataagctagaccttgaaggatgtcactatcttgtcacgttgcctacaaagaagagtaaaatgaaggagcttcagtacctaaatgttctcaattgctactcactcacagcaatgcctcatgctatgggccaacttacacatcttcacacattgcttggttactttgtccccaacattggtagtagtgcaatgtcagagcttcaatcactgctagacctcaatagactatggctgtatttagatccaaagtttggatctaaacttccgtccttttccatcacatcaacgtgtcatacacacacaacttttcagtcacatcatctctaattttagtcatttttcaaactttgcgctgaactaaacacagcctatcactagtgaaccttgaaaaggtttcagacactgaagatgcaagaatggcaaaacttcaagagaaagaaaagctcgagacattgatgttgaggtggaatatggatgctggaaatgccagtagaatagatcatgaagtacttgaaaccctccaacctaaccagtgcctgaaaactttggagattgttgcgtatgaaggacatgcatttccatcttggataacaagcactgagccatatctcacatctctggttgagataaggttggttaatctgagatcatgtgaaaatgctttacctccacttgggctactgccatgtctgaagattgtggagataagccgagtttttttttttttgcgaggaagtggagataagccgagttgagaatatcagttgtattgacgataatttctatggtcagaacggtacatttccttcattggagaagctgattctctcattcatgactagccttgaagtctgggaacagtcatctaggatgaatctgtttcctcgtcttgcagaacttgtcatcattcagtgcccaaaattgagagcactgcatatggagtttccatcgattgaaaaattgattttgtggatgaataataagatgttgtacagctcgaaggaaggtctgagaggtgtagagaagagcctcgaaaatctttcaatttctttctgtgaagagttgcatgcttcttcaggctgtgagggtctacaggctcttgatcgcctcaagaagttggagatatgtggttgtcatgaattgtcatgcctcccacagggtttgcagcatctttcctctctcgccagcttgaaaattgataactgcaacaaattggagattttgccagaatggttggagaacctaccttttctacagataatgtgtttgtctggctgtccaattctgcactccattcctgaaggcctaacatgtagcgacattattgttgaatattgccccaattttaaagaaccatcaggtatgtcatcagtgctctgttcatggaaagccatgtttctgattttcattgagctattcttaaagcaattgaactagctttgatagattaaataaacaattagttatccttgctatttctttttgatgttcaagtgaatgaactcatgttcagttattaatacatatcctcttgagttgaattggcacgatatgaagttgtttctttcaacacttgtgacttattattgtgtgaaaaacagctgcacgagggcaaacgaatagtcgtcatggaagattagttttacattagttcagcgatttaagggaaggccaattttccaccgctgatcttaaaacattggtcaagacaaaaacagtggtgaactggtgatcagaagcagagatttcatgatcaacctgttgatctgtttctgcaactggagattatttttaaaattgaactagatttctcattgtggatgtggttagaagagaggaatagtaaatgggaactcatgaatttaatgcttgtgaagtgtaacttgtgaaattctcaagctactgtatcttcagaaatgcatgagaataagaatgatttaggtagcaatttagaaactatcaatttgctcctctgaaattcccagctatattgtgaggcatcagcaacattattaacctgaacacaataggttggtcacctgtgtaacaaaatgcctctgacattatttggttaagccaggatta

SEQ ID NO: 636 - DNA, 5526 bp, Oryza sativa
caatgttgttgcaagaactcaacaagtgtatcaacctctcttctgtattccatctgccttctatgggtgattatttacacatttatatacagggatatacaagaggaaaatgcttcggtgcccctatccttacgatgtgcctatgcgactggccggtgggccagccttggtcctaatggtaacttgatggaggacaggagagctgcccccggcatgggggcatcgctgttcccgagggaccttgctactacccgggtaaaggcatccccgggtaatagcatgctccgtctagctgccatcaatagtgtcaatgttagttggggcgcgtagtgcgcatttattcgcgcccgctagcgccttgttcttgacttggcttgcgcgagcacatcgaggcataattcactccggctagcacatcgggctttaggggcccctcggagctccgaagcccttaggtagcctccggagctccccttccggactccgggtaccctttcgggcttcggagctcggtcactaggtgtgtcaccggagcccatggcgctgcgacctcccggagctcttccggagccggtcggccgccatccgaagcctgcttaggtcttgttcctctcgccctcaatgagatccgattctctcggatctccggaggcctccggagcaggggggccagccgcggaccgacatggccttgattcacggtcatctcctggggaggatggttctcggagcgctgcagcccttcggaggctagcgtcccttgatccggagatactcccctaacaccttcttattcaaccaagctaggaccaatgaccatgacccttttggatatcaagatgaccacaggtttagatatcctcttaatcagccaaccgttttccagtctgaaaatcaagtgtgccaacaagttgcggaccaagaatgttggtggttggtcaggctacatcactttttcttatatctgtctaagtccatgagctaaaccaaaaacatctctcgctcttgctgtcttagcttgcaccgatattctctgcatctcggcacgatgatatcactcccattactgctcttcgtcctcttcttctctgcgctgctgctcttcccttcgagcagtgacgacgacggtggtggtgatgctgccggcgacgaactcgcgctgctctctttcaagtcatccctgctataccaggggggccagtcgctggcatcttggaacacgtccggccatggccagcactgcacatgggtgggtgtcgtgtgcggccgccggcacccacacagggtggtgaagctgcggctgcgctcctccaacctggccgggatcatctcgccgtcgctgggcaacctatccttcctcaggacgctgcaactcagcgacaaccacctgtccggcaagataccccaggagctcagccgtctcatcaggctccagcaactggtactgaatttcaacagcctatcgggtgagattccagctgctttgggcaatctaaccagtctctcggttcttgagctgactaacaatacactgtccggagcaatcccttcatctctgggcaaactcacaggtctcactgatcttgcactggctgaaaatacgctgtctggttccatcccatcatctttcggccaattgcgcagattatctttccttagcttagcctttaacaatttaagtggagcgatcccagatcctatttggaacatctcctctctcaccatattcgaagtcatatccaacaagctaagtggtacactgcctacaaatgcattcagtaatcttcctagtctgcaggaggtatacatgtattacaaccagtttcatggtcgtatcccggcatcgataggtaatgcttccaacatctcaatatttaccattggtttaaactcttttagcggtgttgttccaccggagattggaaggatgagaaatcttcagagactagagcttccagaaactcttttggaagctaaagaaacaaatgattggaaattcatgacggcattgacaaattgctccaatcttcaagaagtggaactgggaggttgtaaatttggtggagtcctccctgattctgtttccaatctttcctcttcgcttgtatctctctccattagagataacaaaatttcagggagcttacctagagatatcggtaatctcgttaatttacaatatctttctctcgctaacaactccttgacaggatcccttccctcttccttcagcaagcttaaaaatttacgtcgtctcactgtagataacaacaagttaattggttctctcccattcaccatcggtaatcttacacaactaactaatatggaggtccaatttaatgccttcggtggtacaataccaagcacacttggaaacctgaccaagctgtttcaaataaatcttggccacaataactttatagggcaaattcccattgaaatatttagcattcccgcactctctgaaattttggatgtgtcccatcataacttggagggatcaataccaaaagaaatagggaaacttaaaaatattgtcgaattccatgctgattcgaacaaattatcgggtgagatccctagcaccattggtgaatgccaacttctgcagcatcttttcctgcaaaacaatttcttaaatggtagcatcccaatagctctgactcagttgaaaggtctggacacacttgatctctcaggtaacaatttgtcaggtcagatacctatgtccttaggggacatgcctctgctccactcgctgaacctttcgttcaacagcttccacggtgaagtgccaaccaatggtgtttttgcaaatgcttctgaaatttacatccaaggcaatgcccatatttgcggtggcatacctgaactacatcttccgacgtgttccttaaaatcaagaaagaaaaagaaacatcaaattctgctgttagtggttgttatctgtctcgtttcgacacttgccgtcttttcgttactctacatgcttctaacctgtcataagagaagaaagaaagaagtccctgcaacgacatccatgcaaggccacccaatgatcacttacaagcagctggtaaaagcaacggatggtttttcgtccagccatttgttgggttctggatcttttggctctgtttacaaaggagaatttgatagtcaagatggtgaaatcacaagtcttgttgccgtgaaggtactaaagctggaaactccaaaggcactcaagagtttcacgtccgaatgcgaaacactgcgaaatactcgacaccggaatcttgtcaagatagttacgatttgctcgagcatcgataacagagggaatgatttcaaagcaattgtgtatgacttcatgcccaatggcagtctggaagattggctacaccctgaaacaaatgatcaagcagagcaaaggcacttgactctgcatcagagagtgaccatactacttgatgttgcatgtgcattggaccatcttcacttccatggccctgaacctattgtacactgtgatattaaatcaagcaatgtgttgttagatgctgatatggtagcccatgttggagactttggacttgcaagaatacttattgagggaagctcattgatgcaacagtcaacaagttcgatgggaatcagggggacaattggttacgcagcaccaggttaatcctaaactgtttatgtctacctcctttcattgttttttttagatttgctctggtccaacaaaaaatacctaaagatacagatacttgtacctcacaatattaaatagttttcgatcattgcattgttagatctaacgatcaggaaacgatttggtaccgtgcccgtgaggtatcggaatctcaagatattttttgttcgaccgtagcaaatctatttttttgtttgttttcttctctttaatgttttatgactatgaaataatttttatttctggaaaacagagtatggtgtcgggaacactgcctcgacacatggagatatttacagttatggaattctagtgttggaaacagtaaccgggatgcggccggcagatagtacattcagaactggattgagcctccgtcagtacgttgaaccgggtctacatggtagactgatggatgttgttgacaggaagcttggtttggattccgagaaatggcttcaggctcgagatgtttcgccatgcagcagtattactgaatgccttgtttcactgcttagacttgggctgtcttgctctcaggaattgccatcgagtagaacgcaagccggagatgtcatcaatgaactgcgtgccatcaaagagtctctctcgatgtcatccgacatgtgaagatgtgagacatgctgatgttatgtccgagtatttcgttgtaatctaatgtgaagggtgagtgtgtgactgcttggttgtaagctatttcctgatctgcccatcagatcatgtatctgttctattgttgtatttctcagaacaaccacacacctaagtaggagtacacaatagtgtatttgtgtaatttcaatattgatgcatacccatgctatgtgctaaaattatatactgaaattttgagatgtctgaagttaacagtcaatcggggagcgattcacaccataccgcgaaatcgacctaatcagctaatctaattctacaggctgcctttgcatgacagtgtgatattaaattagcccagccctttttagcaaacgatgggagggtcaatgctctagagaaatggatgctgttaggttctctcctctctcgattctcagaagaacacaagaacacaaggatagattatggaaccaattgatttccaccgtcgccaccaggttccaactcacgcctagactttcttctcggtacagaacgggccaagcccaagacattacacggtgaattttttttatttatacattttcttattaaagtatttacaaaaataattttttgtttcgaaaatttacaaatataatcgcttgccgccctttgggagggcgatttttaaaaatcgcccttctacagggcggcaggcgattagatttgtaaattttcgaaaaaaaaattatttttgtaaatattttaataaaaatatgtataaataataaaaattcagtatttaatgttgcttttactaatgcgcttctcccttgccttggcgtaatctggaactccgccttcgatctgtagcccgtcttcttccttgccgagttgtcgtccttgaggttctcagtctcagcacccagcaccctaaacagatgcctttggttaggaaacgtgggtggcagcaacctttccaagttggaatatctcgaaatctcctacacagatttattttgctaggtgaaagcaccgggtggatggcttcaccggggccttctttaaagcttgctgggatatcatcaaaggggacatcctcctggtcttcaactccatctatgacctcagatgtacgcacctgaacctaatcaactcagcaaacatcgtcctaatccccaaaaaggatggggccgacggcgtct

SEQ ID NO: 637 - DNA, 8288 bp, Oryza sativa
acacaacatctaactttacatttcattttggactaccccattctatccatcttcaaggccggtgactctacaaccattccacgcactaactctttctgccttttcctttttccttttgaaagctagggaatcgtcagatccagcaaggaggagtccgatctagcttccctgctctttgtcgggccagctcctgccactccaagtccctgcaaacccgacagcccctaacctcaacggtgaccataacaatagtgtgcatgatgacgggggaggggaaaagacatctcgatgactagagggtgtggctatgcatgtaaaggcggagaggaggaacaatggtggtagctaatggaaaaaagagcggtggtggcggtgtgtgtggagcggcaactagtggttattggtggtctaaggagtttgccgttgatacaatccccaaccttgtttgttgcattttttttctctgagtactatcaatatatttgtccatcaataatcataaagaaatagctagttttaaagtagtaaaaaaattgagataaaggtggagtactcgagtagggatgaaaacgctttggaaaaagacgaaaaactcttttatcgtttccatttccatattttgttcgaaatcgaaaaccacggatacaaaaatggaatcaaatattatcgaatacgaaaatggagcgaatacggtaacagatatttatcggaatataaaagccccttaagctgaacttctaaaatccatgaagagatatagctcaatatctctctgaaacaataaatcgatatttataatttttatcaattaataataatataactaggtgtataatttattttcttggagaaaaagagctatatttatctataattgcaattataaatactaaatatttccgattccgagaaaaagaaaatctgaattcgtttcctgaaattttccaaaattggttttgggcggatagcagcatttccaagagtggcaaatattccctgtaaaataactcgagtaatggttctctttggcgtaaaataaagagaaatctggcgtctcgtcgtctcctccgctcctcctctccttgcgccaacaagccgactcgcgatctccatcgggcaagaagagcagagcagagcaggggaggggatcctgcaggtgaccatcctctttctttctttctttctttctctgaattcatctctctctctcccaccgggactctctacttttgtctggaatttgctcgcgttcgttcgttaaccctagcttctcttctcttctcttctagatctggaagaagctcttaatttcagagccttaacctctcttaatactacaagtaacaacagttttgttgtttgttccccccaccccaaaaagtttaggcgcacgcatcgcccatggccaccttcgagctctaccggaggtccaccattggcatgtgcctcactgagacgctcgacgagatggtctccagcggcaccctcagcccggagctcgccattcaagttcttgtccagtttgataaggtatctactttaccatatctccttccacctattactatctatactattgaaaaattcgactcctcattttgtttgttatcatctatgtgattagtctatgacggaagccttggagaaccaagtcaagagcaaggtttctatcaaggtatctgctcttatcacggagttgccatgttgctgttcctacccccccaaaaaaaaccaagccttacttgtgctgtgcataactttaatctctatctgtttcgagcctactcattatttatgcttgagaactcatatgcgcttgtgatgtaatttctccagtgctagaattgatacacttggttgtggattcagcgttgccattcgattttcttttccgtacacaccttgctaaaggaatcaagtctaaaatttgtttcttgcatatattatattattattattattcataaaggaatccattcacgttcgacacgtacctgtcctgtgtacgctgctctgagttctgagggatattgcacaaactttatagtaatgagtaagcgagtaacagaattaagacctatcagcaacataatacacgggcataaccagacaaatcttgcacttatcacatatatgcttttattttttcggctgtacaagcatatttccacttatcttattttgcaacacatcaagtactccttgagttgctcagattccaagctgctcatctgtgtttggccccaaaaaaaaagaaaagaaagaaaaaccttttattggataaacaagcctgagaaatgtcaagatcttttcttgccagcataatcctcaccaaaatgaaattatgaataaagattagtgtcattctttctgatacccatgtagtttgttattctatggcatgatagagattcttttttgtttgtgaattgggggtaatcacagaaatggactgatatttttgcccaacaatgggtgacttgtttacgtatcttactgtaatccgctttactcctggccccttgccccttttttataaatggaagtcaaaagtatgcaaaatataggcaactcgcacattacaatagcctcagaccctaactaccacatcgcaaccatgtgcgagttaggaatgccacacccggatgtgtgtcctctatgcgatcaggaggagactatacagcatattttggtgacttgtgttttttcctggcaagtatggtttttaatcttccaaatggttggatgggcgctgcagcactgcaaccatcaatgaatcgcttgtctagctggtggttcaaaacagttaaggatactcctaaagaggtaaagaaagggctgaactctttgattatcctagtggcatgggaaatatggaagcatcgcaatgattgtgtcttcaatggtgcctccccgagaatctcggctgttttgcatgcagtggctagagagagttctctttggtgtactgctggagcaaaggcactcctcgaaattctgtgtgggttgctccccctggacggctagtttctcctagggggtgtttcggttgcacgtcgcgttccgtgatgtttttttgtgtttctgtaggggtcctttgggtcactcggttgtacaatttctcttcttaatgaaatgaatcgcagtcctcctgtggtttcgagaaaaaaaaactcacacattgcaatattgcccatattaaaacactgatttttccccataaaccaaaacaagaaataaagtaactaagtgaccctggtgtgtacatgtttattagaacttctttatctgcaatattgtgcaagagaaacaagccgcaaacagcgttggagctcaataacaaaccagtaatgatgctagaaaccgtaccaaacataagacggtactctgctagaaaccttttttttttgtgccaagaagcgacttgaccactcaacatctcaatttcccttctgatcacaagcaatctagggctcatcgctgggttcgtacgataatcacacttccctgttctccattcttgtcatagttcagtgctctgctcctctaactgtgcttgtagtatcaatcagtcctctgggccattcgtagacgcaacaggcagctcaccaagttcgggtgaatcgttttgtcgtgtttattcttgtcccattagtcactagatagttcagcactgttcttgttattctattgatgcatttgtatatgactcattttcacgaaaggtgcatcaagagcattatattactgtagctatgtagttgttatcggtgagctttgctccatgctaaaagagttgggctaaatctatagcatttaagaattagttatagctggaaagatcatgtttgtcttgtagattcgactacctgatagcagctatccacctggatgatgaacagatctgtccatgacaacctgctgggctatggtgcatgcatgcacccatgtgataagtatgtaaaacgctatcctagatatagttttgcaagaattgatctctattgctaccggagactagaaaggtgttatggattggctagggcaagggtccgaagaccgggggatatagcactcgccctctaatagcagaggcagggcttctccctgctgagctaaaagaggctatgaggcttagggctaactttagagattcattgattgattgataagagtacatggggtcactttatatatagggaggacaggcttgacatccaaggaactaatctctagtactacagaaaccagtccaatctctatctctaactttctaataaacctcatctctttcctaattagataatctcctacctatatatgagtaattcgtaatttatgatgcctaaactgctgcatgggcctggtccatgcccataacactacacccctcgcggacagatagtcttcgagcactagcagatatcttcttggaaagaacttcaatggtagcagtcggcaaatcatcaaagcgaagtttgatatttttcttgagttctggccaagtttgaattccgtaggctcgctcaatcaactcataccacattgcggcaaacctggtccggtggcttgatgcaatccaccacttctcttcctccataaattcgctgctcaacaaagaactgctcaatactctccaaccaaatttgcggatcatcctcaccattgaacgttgggagaggttcaaggtggcgaaatctccacatccaattgaaatccccgctgcacgccatcgagggtggagcatcagttggctctgataccaaatgttatggattggctagggtaagggtgcaaagactgggggatagggcactcgccctctaatagcagaggcagggcttcttcctgctgagctaagaggctctgaggcctagggctagctttagagattcattgattgattgattgataatgcagtacgtgggacccctttatatatagggaggacaggcttgatatccaaggaactaatatctagtaccatagaaaccagtgcaatctctatctctaactttctaatagacctcatctctttcctaactagataatctcctacctttatatgagtaattcctaatttataatgcctaaactgctgcatgggcctggtccatgcccataacaaaaggaggtaaacgctatcttatagcttctaaatacggcacacctttatcatccatttctagttttggcttatggaaaaatcttcagttaaagcatttatgatattacaaaattgcagatgacgttttgtcggcatctgaactctcgtgaatctgctgcttgccccttcttagttgttccttaagttgtttcggcctttccaatttagcagtacacttaatcctcatgatccaaccatggccatcaattttcaattttcaactctgagcactctcgaccaatctcccatcagctgggacctattcagctgtctaagacatacattcacaaaggagattgcatgttctgattttcatttttacttgtaaaatgtaatgtttgcatagccattttgtatgtttagcctgaaaatggttgaagcatagttaccagttcatttgttttggtgttttacctgataatgtccagtgtatgaagacatgcgataattgataaattcatatatccggccactcttttacaactgtcactgtgtgggtttaagaaatccctcttttgacaaaccgcagttctctttttcttttccaaagaattgttaatcccacactgaattgctgtattaggaagggatcacctctacaatatgtcatttatgatatgtggtgttgagatgttacgtgttctgttttatttttgacgaaaatgcaggagaactggcattccattaaccattagctaagaaatgtacatggttttatcagtcataaactggacttactattttagaatcatgaactagagttttgctaatggaaattttaccattttaaaaatcatgaactggagtttgaattaatctctgttttatttatttttgagtaaatttcataaaactacatatactttgcatgatctatcacaaaactatagatttaagaacttatttcacaaaactacaaatttaatgtcttcgtttatcacaaaactacaggtattttacacaatatatcacaaaactacagatttaagaacttgtttcacaaaactacagatttaatatcttcatttatcataaaactacaggtttagtgtcttcattatcacaaaactacaggttttagcattgtcaaaacctgtagttttgtgataatggagacactaaatttgtagttttgtgataaatgaagacactaaatgtgtagtcctatgataaacgaatacactaattctatagttttgtgaaacaagttcttaaatctgtagttttgtgatagattgtacaaagtacctgtagttttgtgataaacgggcatactaaatctgtagttttgtgaaacaagctcttaaatctgtagttttgtgataaattgtgcaaaatacatgtagttttgtgaaatttactctttatttttctaacttgctatcctgctccagaaattttccattctagttacatgagtttaagcctcttgtcattttggacgcaatgtcgaacagacctgtatttgatggattttttttgtttatttaagaataagttctctggtacagcttagatacgatggatgattgactaactttttgagcctgtatttcagatattttgtagctgggctgtttactgatgcatgttcttttctcagggccacctgcacacttacaggttctgtgacaatgtatggacattcatcttgactgaagcatcattcaagaacgaggagactacagaacaagttggcaaggtgaagattgtggcctgtgattccaaactactcagccaataaattgataactgcgaggtcagggtttgcctggtatttgttagtctcttctgctagacctggctccgcctgaagtgtactgtaccaccacattgtttgtttcataatcaatgtgtgtcaatacaatcgtatgtgctaccagagtatatcacagcagcaactgttttaatttgtatgcttatgtaattgttatgctactgctgtgttgataatgtgatataaatgactaaacgatgagtagtagaaattgtgcggagtcaccctcccccttcctcatttctgaaccctttggttctgtgtgactctttgtatgtaacatgaacaaatacctcctttcccgtcttttttttggatcctatgttaatggtacctttacattatgatgtgctctttgggcatgtttcatttcttgccaaaatcaaccctagcaacatttggcattaccgaaatgccaaaaaaattgctatggttggaagtggtaacaaatcaaacgtgctggatcttcagaaatgtttggtgctttgtgtttacctgcttttttaatatcaagattcagagtattgtttggattataacttgattaatgttctaaatgatactgtcctgctacccagttgaggtgttctcataatcttgcagaacttggatggatttttgttccccagttgcattattagagatgaaatgagtcagaccttggtcataagcatgcatgtgtggcagaattctctaaggacaaaagtttaatccttgtcagtacaaagtaagtactataattatctgcgacagtttgatggccaattgcaaggtgatcatcaggacgcagattaattaagggtgtagaactagaagagccaccggtcgaaacgtgtctgagaaagttggaaatatcttgccaactctttgctagtacaactagtaccaaggtactcttcctaccagtaacaacaatcctagagggcatgagcatgacaggccagcactgcagggaatcaatcagctcagcacagcactgcacagctgaggctgatcagcattcagcaatggcatgcacaagccaacatggaaaaagacaagcaagcagatggatctgccttcaagaaaggacgatgagagaaaaaaaacatgattttttactctagttgttttccttaatctctttttcccctaaaccccaggacagagagaaaaaggtggcctctaactccaagttaagctccagtcgaaaggtcttcacatagtaatgttttttcttaattaaacgcagattttacattagtttccgttagcatgtctttaagctactaaacaatatgtttcataaaaaactttctatatagaagtcgctataaaatacagatataataattaaaacttaac

SEQ ID NO: 638 - DNA, 4160 bp, Oryza sativa
aggctgaacttacatctctgcccactgtaaaagcccttaggaggacatcaaggaggcaaaggccatctgattccgaagtttaaattttatagtaccagttttctactccaatgatttctcaactgttggttgtcacacacgcacgttccaccagggaatccgatcaaacgattccctcccctccctccgccgtccaacccatccggctgcataaaaatttccacaaatgacgcggacgcacaccaccacaccaccacctcctcatcctcatttgccccccaacccggcatcgatcacctcgctgacgtcgcccccgtgacgtcatccggttgtcgtcccctcgtcccccctctccttcggcgatgcttccccccttgcccgtactcccacatgcccacccaacgaaggaacttgcaactcaagtttttttatttttttaaaataatctctcgtggcccccaccaccaaaactcccccgaattcctcgtaccgcggtccactgagcgccgggccaccccctccaggactggcccacatgtccgtgtgatctctcccgtggtttccgcggtgggctacgtccactgtggcgtgggccgggtgtgaagcccccgccccccccccccccccgctggcccactcacctcgtgcattcacaccggcatgggggattgggtacgctcggttcatgaggttcaactgcgccgttcaccgcgagtcaccgcgtgggccgccacaattcggtgaaccgggtctatggttctcgcgtggtgccgagccgcgtccctttttcccatcgcccacgcagcgagcgccccagtccatggaaacccctcgtgagccgctcactgggcgtagccgcacggtcccacctggcattgacacggtacgcgtcatcgacggtagaccgcgcctacgcatcatctccttcggctacagaaatggagacggatcaatccgctccaggtgagcagagtagccataaataccgacctgcctccaccccaagcctcctgctgctttgagctccatcaccagctgagctgcgaggaagagagagtgcgagagtgcgcggcagcggcagtgtagtgtcagtcactgggtgtgcgcttgcttgcttggattgaggatgacgtcatcgatgtcgccggcgccggcgccggcgtacgcgcaggtgatggaggacatggagaaggggaaggagctggcggcgcagctgcaggggctcctccgcgactcgccggaggccggccgcttcgtcgaccagattctccacaccttctcccgggcgatgcgggcgctcgacaaggcggcggtctccgccgccggaggagaagggtcggaggtgcagagcgaggtcacctgcgggggcggggccagcgccggcgggaagaggaaagcccccgccgccgaccggaaggccaactgccgcaggaggtgagaacgaaggccagagcatagctcatcacaaagcatagcatcatctgtgtgtaattagctgcgttctttcagggaagataggggggattgtccctcgttttccgcgcgcacgcttttcaaactactatacggtgcgtttttcgtataaattttctataggaaagttgctttaaaaaatcatattaatccatttttgaagtttcaaaatcataaaatcatgcgctaatggttcacctcgttttgcgtatattcccaatcttctctatttccttctcctcaaacacagcctgggagtgtttgagaaggggattgaggagattgggaagatacgtaaaacgaggtgagccattagctcatgattaattgagtattaactattttaaattttaaaaatagattaatatgattttttaaagcaactttcctatagaaattttttgcaaaaaacgtaccgtttaatagtttgaaaagcgtgcgcgcggaaaacgagagccaatctcccctatcacccctaaacgaacgataccttccctatcacccctaaacgaacgataccttaatgtactaagatttgtgtgtacgtattgcaggacgcagcaatcgtccgggaattcggtggtcgtcaagaacctcgacgacggccaggcatggcgcaagtacgggcagaaggagatccaaaactccaagcacccaaagtgagtagacttgtcccgacaaaaaacaatgtgttcgagactgtacagttggatgcgttgcgcgctgacgaggagttgtttggggtatgctacgtgtacagggcctacttccggtgcacgcacaagtacgaccagctgtgcacggcgcagcggcaggtgcagcgctgcgacgacgacccggcgagctacagggtcacctacatcggcgagcacacctgccgggacccggccaccgcccccatcatcgcggcgcacgtcatccaccaggtcgccgccggcgacaacgacgacggctgcggcggcctccaagcggggtcccgcctcatcagcttcgtcgccgcgccggcggcgccagtagacgctgccgcggcgccgacgaccagcacgatcaccacggtcaccgcgccgggcccgctgctgcagccgctcaaggtggagggcggcgtcggctcgtccgaccaggaggaggtgctgagcagcctcacgcccggcagctccgcggcgcgcggcggcggcggcggcggcggagtcgcgggtcccttcgggccggaccagggcgatgtcacgtcctccctgcactggagctacgacgccgtcgccggcatggagttcttcaagaacgacgaggttgtcttcgatctggacgacattatgggtttgagcttttgatcaccgaagaatcatggatggacacgggccgggtaaaacgatcgaaagaagatggattccacgcgtgtgtacagaaataattagcggcagcgcggatcttaatttggaacttgcaaagatactcctaattagcctggctagattagtttgtaaattccttgttgatgtgtcgtctcagctttaagctgcagacatgctagcaagtaacaacacgattagtacgtagtaatgtggttcttgattatgagctgggggtcttaaccttttttgtgtgacaagcaagagaagaggatttgggtacaatgtaatcctgttcttccgctttcgaaaaaaaaaaacatatagcttcacgtgcctaatcctctgctaaatgttgtgccataactgtagaaagattcgccatttggctacgactttactgtacatgccgttctttccgtcaggccaatcatacaacgctgtggctcgcacgtgtccgcagtcatatgggcccagataacatcggcctccacaatggatcgatttctggatgaagtaggccaagctactccccagagagctcaagtacctgcaagctctaatcattgtatcccaaagggaccacttatacatttggcgacaaattttgttctaaaaatttgacagatataattataatacaattatagtgtaattacactgtaacttgcatgtaactacagtgtaacttgtataaaagtttcacgtaattttgaatcgttaaatctattacaagatttgttttggtgagggagaaaaaaaatcacagcacacacatgtgtaagaatttgttcccacaacctctattttaccgaaataacatattacagagagatttttgaaagttatatacaagttacactatagttacagtgtaattacatgcaagttacagtgtaattacactacgattatactataattacatctgttaaatttttgggagaaaatttgtcgacgaatatatagcaaaatcgtatctgaaacttttgtcctttcttaattaacacaacgatgccgaagtttgattttaccaatctcgacatggtaggccctgtttagttcccgaaacataacttttcaagttgccatattgaatatttggatatatgtatagagtattaaatatagaaaaaaaatcaattagacagattgcgtataaattgcgagacaaatcttttaaatctaattgtgccatgatttgacaatgtggtgatatagtaaacatttgctaatgacggattaattaggcttaataaatgtgtctcgcagtttcattgcggaatctataatttgttattagactacgtttaatacttaaaatatgtgtccgtatatccg

SEQ ID NO: 639 - DNA, 7203 bp, Oryza sativa
aaagaaaacttctttggagaacacatgctaaccaattaagcacacaagtaagccatgaatggcagtgaaaaatcccatccagaattattcaggcatttgtctggaaaagttgcaaacgaatgacttctgcgaaaggggatcgcattgtcaccagaaaagtggctatcctgtgcagtgcatctagctattaatcctgcttatgattgaggcacgaaaccatctattcagaatttccatggttagtcctccgtgtaacatcattcgttccaattatctgaatcaaataaatcgcgtgataacttactactctctccgttttggttataaaatgttttgacttttggttaaagtcaaactctatagtaatatttacattactaaattagttttattaaattaataattaaatatatttttataataaatttatcttggatcaaaaaaaatattactattttttctataaatttagttaaacttaaaatagtttgactttgaccaaagccaaaacatgttgaaacctgaaatgaagggaatatatattttcttcctatacagttattagaactactagatctcctgcccaacatgttcttattcttttacctccagccaagaagatatcatatcagcatctgaattatcaccaatttagttctagatgcatggtttgatgaagaccgacatggcaacaggacaatgcatgcaagcccttcccatggaagtatggaacagttggtgtgcatatgatcaatgcaggtgtaaacgcaaaaaaccaggaatgcatcatgcatgcatgttcaaagggacaaacattgcgtagccaaagactgcctaagcaactaggggaatctgtttgaactcgcatcgcagtctgctcccgaccacggaaaacatttttcaaagtggaccatttggggtggcaaacttatacttctttttttctctgtagaatttgcaaactacttttccagaccagctaactttgctgggctctatggatcgactatggatcctgcagcattgatcactttgtcacgagtcatgacacctccgtttatgctccaacactataaatacgtcgggtagctcaccctttcacctgcaactctgcaatagctagcttgcaacctcgcattctcgcttcaggacctttgctctctgacaaacctaagctcgatcatgcctgtcaatatgatctccaagtacggcatacatgttgcatatatttgatcgatgcatatgaacagtagcagtatatagcctgtagtgatttcaagtcatttcagttagtctttccctgaatttgtttgattcctgcatctgtaggttacttgagaaggctgttcttccagcactggatgttgcacctcctgtaaaaataggaggtagatttatcatactatggttcttcttaatttgttgtttgtagcattcttgccatctcatggcacgtttaacttacttttgcatgcgtgttactactacaaaattcagggcctcggcgtacgagcgtgctgcgcaatccaaacatggagaagcttcagaaggggtacttattcccagaggtacagaattaatcacgatttcaccaaccttagtttgagcatatgattctccagacacttgatgataaattgataatatacgttaatttgtgctcctcgttttgatggtttagattagcatcaaacgtgaggaacacctgaagaagtacccagatgcgaaggtgataagtttgggtatcggcgacacaactgaacccataccaagcatcgtaacatcagctatggctgaggtatttatttactctacttctgtagttctgttttctctcttgcattggagcatgcatgcatgtttttccttttctgaaaaaggagaagcatgtgtaaaaatgtttaaccaaggaaagctacatgaggaatctcaagcaacaaatagctggtcatctggttcttaatggcgtagctagctagatggcactgtggtctatggaccacctaaaaatttgatcaagattaaaactataatatatgtgctagttattaatataataaaaattgtatagtggaccacccatttaattggcctattacatatagatggatcacctttactttaaatcctagctacgccactcttggttcttgtcatagcacgaattaagaatttaacatttggacacatggttgttctatgttttcccgtggatcatctttactctaaatactagctacgtcattattggttcttgtcatagcacgaattaagaatttgacatttggacacatggttgttctatgttttcccgtccatcaacattaaccttttgttgttgttgttcaccaatgcaaagattctctacaatcgatctgctagctgcaacagcattttgttaaactgagcacgaatactaaagcaaagcataccattttgtggacctctgcttagtacacctttcttttaataagtacaccttattaatataataattattgttttaaacaagagtgaagtccactcttggattatgaatcgtttttaaaatatttatcttttaaatatggtgactacatgtacagattagtcttaaaaaatattttaataaaataatatatttgttaacacttttatacaaattataatgaaaaataatggtcaaaattattttttcagagaccgtgctcttatccaaactgacaagtattatcaacccgtatggagtatacaaatgtagcaaaatggttatacgtagtggggcgaactagggttaaaaaccagcctaatattaactactttgtttaatattatatttttttgtcttaaaataaatgtgcaccgatgagatgggtgcaaatttgcattaacctaaaattaagtgaataaaataaattacttggcccaaccaatattcagtctgttagccttcattttgatttatttttatgacgctacatgcttgctccaccttttatatgagccaacgtactggtctgaaaattcttaagctttttacaaaagagaagcactcaagcaagggctcacttgcgaagaactgcacaagaggtttcgtcctaaatatagaagaggattacgttgtaatatctccgtcccataaaaattgtatttctagctccaaggctttgtcccacaaaaattgtatttctagccatgtggggcccaaccaattgattcatctatataagtttccttccatcccacataatttgggctgctaatgcttgtaattttattaagtatgctaattatatgggttaattctctcaaacttccttttaatcatttgtatatatggaatatgtgcatgcagtgggttcattaaataaggttattgtggtcatttttcaatcctactattttgtcctaaattagctagaaatgcaatttttataggacggaggtagtactaaactactactaatatatattttttttcaaggaagtgtcaagattcttcttctccatcacttggaaatttagctgtacctgtccttttgacttgtcacactcttatctcatgccaaatttgttcactttttctaccaaaaaaacacaaactttgcactctctatcaacccctttttctcttgtcagaaccaagataccctgatgtcactgcagagacatcacctcatccacatcatgcatgccttccagttctccctcttttcctcatatactgccataatctcctgcaattttagtgcaagtgccaaactgctaatgggaagatgacaaggagattaggagaagagcactatcatatctaattattccatgatctgtactacgtccactgcatgtgcatggctgctgctgatttaactaaatatgtagtgagctagctttggagaaagatttgttgtagactagtatcgcatttgtggattgacttgcaattggtggtcaattaatcctaatatacaacctaagtgctttcagatcactggctgtgacaccggcggttttctgctcgtgatgctgttgacatgacaaaatggaaaatacaatccgatgattgcgactaaggaaaattttaagcttacttgacttagggtgggcctatagggtattggtttattcctggagttaaccaatcctagcccaaaagaatttatcagaagaaagcctaaaaagttcagatttttttcagatacaatttacttgaatatatttttctcttaaataggatgttccatttccattttgtagagtaagaaacattttatcctattttttgcagtatgctcttgcattgtcaactcctgaaggataccaaggttatggaccagaacaaggccacaaggtaatacaaaacactgaaaacccccaactctgaagaaatctaggtagaacatggtttatcatccttgttttgaagaacaggttttcatcctgtttgcaaagaaaatactacagagatttcaaagagatataactatgacatttcactaacacaagatatatatgctctttgaaatgcatgtgcagaatctgaggaaggaaattgctgacaaggtgtaccctgacatggggataaaagagagtgaagttttcatttcagacggagcacagtgtgacattgctcgtcttcaggtattgcaagttatttcgcgtgctttcctacttaccaactgatcaaattcacttaatattctgagatgtgaaatgatacaaatctcatctttcatcttccttatctaaaaaaaaaaatctcaccattctttctcctggattcagacgctgttcggtccaaacgtcaccattgccgtccaagatcccacatttccggtataataacaaacctatccattaattacctgtgtctaattgcgaataaataaataaagtagtaggattatatgcgtaataagtaaaccattcgtgcaggggtacgtggacaatggcgtgatcatggggcagaccggcaaggcggacgacggcggcaggtacgccggcatcgagtacatgcggtgcgcgccggagaacgccttcttcccggacctgtcgcgggtgcggcggaccgacgtgatcttcttctgctcgcccaacaatccgacggggcacgcggcgtcgagggagcagctccggcagctggtggagctcgcgcggcggaacggctccatcatcgtcttcgactccgcctactcgtcctacatctcctcctcctcgtcgtcctccacgccgaggtccatctacgagatccccggcgcgagggaggtggcgatcgaggtgtcgtccttctccaagttcgccgggttcacgggcgtccggctggggtgggctgtggtgcccgacgagctgctctactccgacggggtccccgtggcgcgggacttcgaccgcgtggtgtgcacgtgcttcaacggcgcgtcgggcatcgcgcaggcgggcggggtggcgtgcctgtcgacggaggaaggccgcggcgcagtggcgcgggtggtcggggtgtacagggagaacgcgcgggtgctggtggagacgttcaggtcgctggggaaggaggtgcacggcggcggcgacgcgccgtacgtgtgggtgaggttcccggggcggcggtcgtgggacgtgttcgcggagatcctggagaagacgcacgtcatcaccgtgcctggcagcgggttcggccccggcggcgagggcttcatcagggtcagcgccttcaacagcagggacaaggtcctcgaagcgtgccaacgcctcaaaagcttcctcgcatgatgacattttcttcagttatacatgtactactacatacatacatacatactcactccagactcgtaaagaaagtcgtttaggacaatatttaagtcaaaccttaggaatataaatcatgaataactctcaatttgttgagtttgaaaatgtaaaaattatatgaatagatttgtcttgaaaaatacttttataaaagcatacatatatcactttttaataaatatttttatagaaacaagaagtcaaagttatgttttatagaccgtgtcgctgtcctaaacgacttcctttacgagtctgaagggagtacgtaatagctttgcggtgagctgacatttataccgtctctgaccggccaagtcatgaagtcaaaagtaatgcaggtgttatgtatcaatcaaaaatacatgtaagatcatagctcaatttggaataatacaaagtgatttcaggtatctaacctgtccattgcaatgactaaaccagctgctgtccattgcaatttcgttttgttcatgtctgtacttaagattggaacagagaaactcaaatgattttagcaagcgcaacgcaataagggtactgtgattctttctgagccatgatctgtcctcaagaccattgaagattgttttcattggacatcggaagatcctattttggctcgaatcacagcacttagccaaaaattaacttactcaagtacacatttaaaagtgctggacagctccaaatgttcccttctgacgccatttgttactcatcactttcactttcctcctcactttcgtcatcttggttaaagttcaggtggttcaggttttcctctagaggtggcaagccatcgtcggagtcagcgtcagatccttcctctgtgctttggtgtgatttctctgccgctatgacgcggaaatattgagggtcaatatttgcactctaaaaatggttagcttatggcaaaaatagctgagatgtaattattaccgtttacaggtgactttggaacattagagttacttgacaaccaagaattctgcacattgattatctcggtgccattttcacactgcgagtatgctttgagcagctctctgcacatcataacaacaaaagggtgcgaaaacatctggtgacacaaatctaaaataaatatgcagtacatagtatccagtcttcataaacataatgcagtaacagagaaagttgcaatcatttgaccatcatattcagaaatccttgggtaccatgggttcttagcatgattcagtgtacattgtcgtctgaaatttgctggataaaggtaacaacaccgatacaatataatatgcaggatagcttattttgtcctgtcatcaccccagattaggccagtaattagcatgttgaaatttgaaatgtaaactaatatgcttcaatctacttaattgctgtgtgcaggtgctgggtttgcagaaa

SEQ ID NO: 640 - DNA, 4783 bp, Oryza sativa
gttgatgaggagacgtactacgagtaagattatgtcttgtttggttcttccagacatcttcggagtattttcagatttacaatttggcgttgatctgtgcattgtcaattagggcggagcctcattacggatgggctgatgtcgttggagactcaacacaacttctgtcgatacaacctgtcgaaaggccaccaggagtgtacccaactattgacttcagcgcttcatctccagctccaccttcggatgatccaccaggcatgcctccttcgcctctggaatgagtcatacctgtgccagtacaaaagagaagcttttctgcataggtttccaattttgcctgtaaggggaacattctttgtagaaaggggatcaaccgcagtattgcgttcattggttcattcattctttcgtagcatgttttccttccgcggcttagcgttttatcgttccggactgctgtttgatcaattaggcgaaataatcagtggctcgcgatcatattgtctctatgcttatccatgtgcatttttgcataaaagctccgtataaataacggaggagaaagctctcaatgatatccacgcgttttttagcattgccttgcgatgtggacacctctgtttggctgttggtttgtgtggcgaagagacgtcaacttcgccctgctgtttccattttcctcgcatccagctccggcctgtctgtcctgcttgtatccaagtgtgctgccgtggacgaggctactcgttcacatttgtgactttgaagtccagattggcctcttgtgcaatttaattagcctgacttgggttgccaaagtcttagcgtagtcaagctccccttgaagacgctaagctgcatgcatggctaacgtttgtagtcaaatttccatcggtaattttgaaatttcagtgattttttgttctccaagtctgactcaaaccaatcaattccacacaagttcaccattttctactttgatgcaatcgaaccaaaggatagggaaaggcccacgctgcaaccatttaagtcgccacaagcactagcatcgaggcatactcctcctgctccagtgtcaacacgacagtcaaacaaacaccaagcctctcattcccacctctcgaggagagctttccccaccatggcgtcgctcaccgccgccctggccacgccggcggccgctgccctcctcctcctcgtcctcctcgccgcccccgcctccgccgccaacttcacctgcgcggtggcttcaggcaccacctgcaagtccgccatcctctacacctcccccaacgccaccacctacggcaacctcgtcgcccgcttcaacaccaccaccctccccgacctcctcggcgccaacggcctccccgacggcacgctttcctccgcccccgtcgccgccaattccaccgtcaaaatccccttccgctgccgctgcaacggcgacgtcggccagtcggaccgcctccccatctacgtcgtgcagccgcaggacgggctcgacgccatcgcgcgcaacgtgttcaacgccttcgtcacctaccaggagatcgccgccgcgaacaacatccccgaccccaacaagataaatgtcagccagacgctgtggattccgctgccctgcagctgcgacaaggaggaaggctctaacgtgatgcacctcgcctacagcgtcggcaaaggggagaacacgtcggcgatcgctgccaagtacggggtgacggagtccacgcttctcaccagaaataagatcgacgaccccacgaaattgcagatgggacagattctagatgtcccgctccctggtacgtgccttgctgttactgtttagtatggttcttgcaatcttgtgatcgagctcagaagttttttgtttaacagtgaattttctcagtagactagtcttactagtactataagagaagaaacttgaattagttaggcaggtgtttagttcacttcaaactttctaaaattccatcacatcaaatgtttggatatatgcatggagcattaaatatggacaaaaaaaaaaccaattgcacagtttgcatgtaaattgcgagacgaatcttttgagtctaattacgccatgatttgacaatctgatgctataataaacatttgctaatgacggattaattaggtttaataaattcgtctcgcagtttatatacggaatctatactttgttttgttattagtctacgtttaatacttcaaatgtgtgtccgtatacttcaagaaaattttagcacacgaactaaacacggccttactcgtattactacctctacatggttgactggggagactgaagattagctgtgttgttctgttagtttgcatattaaacttaggttaggtatggtaaattatttgcaatatgctgataatatattgctcggattcagtggtatttgcaatgaacttaggctatggtccccttgcatgatggagtttatcagaatcaaaatatctggttgtgactcggaaagttgctctcaagaaaagatagctagctgcacatgcttcgatcgttgagagattgagacaacatgacacatagctccactagcacatgagtagaaagccacaaaattccatcgcaatgttgaggaatttaagctttagagcttgaattcctgcactctttggacttgtataattagttagccgttgctatcaccggacaaactatctgactttgtggtttaaaattacggaataaactaccaataccaatccacaaagttgaccctcgctactcacaaggtttcaaaatatactattatagtactatcttagatggatcttgatgtttactactattcactttcttcggtaagaatgtcatatgaaacgagttcctagacctagtactaacttctggaaaactggtgtcctcagtgtgccgttcatcaatcagcgatacctcagctgatcacaatctgatgctcctcccggatggcacctatggattcaccgcaggaaactgcatccgctgcagctgcagttcaactacctaccagtatgctcccctattatttccatctccttctaagttgtttctgatcaagcagtaaccaaagaatttacatttcttttcactgtgtcaaccaggctaaactgcactgcagtacagaacaagggatgcccgtcagtgccactgtgcaatggaacgctgaagcttggtgagacgaacggcaccggttgcggatcaacaacgtgcgcctacagtggttactccaacagttcatcgctcatcatacaaaccagccttgcaactaatcagacaacagcctgccagagtaagttgagcccgcaaacctgtacaaactcagagtctctgagtttgtttgagttaaagaaacggcaggtttctaatagttgattttgcaggaggaggatctgggaggtcgcagttcgctaggtccatgtggagcatgtctgttatctccttccacatggtgttgatcattatctgtttcctttgatgttggagactactgcaactctagatggtacatttcaaagagttctctacgatctatgattgttgtatacgatatatgattgttgtcgtaacttagattttgatgactggtttatccagctttgaaatttgagttttgactctgttctttagaggatgagtggcacttgtacggctgcttgaataaaacgtcgatgtattgtattcgatctgcatctgaaaaggaatattcattagataggattattcgaaataaaaagatcccacatgtttttgttataggcgttacatgttctggatggatatataatgtaccatgcggaagtatgaatggacttcccaccttccaatcttccatctacacttcaagccttgcataaagcaaaattgatcttagcaagtctcaggcaaatgctcgaaactagtactagtttctttctgatatcattatttttgttgcgacttgtttttagtattgaagatactttaagcatgacatattttacatatttgcattaagtttctaaataagttgaatggttcaatatcattttcaaaagtccatgtcatgcattcactcctttcatttatatatgacgttggatagttcactaaaatgaattaaccaactcatatataagtggaggagggtgtgtttaaaaacggtgagggtatattcctcattttccccgaataagagggtatattcttttttatgattacttttaagtgcatcctacatgatgctgcacttgactcagttttaacacggaatttatgcaacatccgtgttggtcttcccaaatactgtatcatcagaaaatatcggagtagtcgtgcagggcgctgtcatcttggcagcaaaaccaatcgcagctagtacaatagtacaagactacaacttggatttgctttgcataggcaggcttcccatggccctggccttctcccggagcaagaacttctgcgtcttccccgtcgacgtcttgggcaggtcgccgaacaccaccgtcctcggcgccatgtaacgcggcagccgcgcacggcagaacgcgatgatctcgtgcgccgtcgcgcttgccccgtccttcagcgtgacgaacgcgcacgccgtctcgccccagtggtcgtccggcctcgccaccaccgccgcgtcgagcaccgcgtggtggccgaacagcaccgactccacctcgatcgagctgatgttctcgccgcccgatatgatgatgtccttggcgcgatccttgagctggatatacccgtcagggtggcgcacgc

SEQ ID NO: 641 - DNA, 9448 bp, Oryza sativa
aaagttttttaataaatcacaccgtttagcagtttgaaaagcgtgcgcgcggaaaacgagagagttgggttgggaaaataggggaagaacacagcccaagtcccctaggaactcccctcttccccccttccctagccccccctcctaacatgtccccctcttcaaaaccctaaactctaaccttacctcaaccgcggcgccatcaatggagaaatgggctttcacctttgttgccgccatcaccggtaagtcctcccctcctctaaaattttagtgttaggatgagggtgattaaaatttctattaatttcagtcacccgaaaactagcaatttccttctctaaaaagtatttattttttgcaaaagaaattaaatcagaaccaaatttatcccaagacacaatgcgatagtggattcttggaagatcctctctcttctcactttgctagctgccctgagtgaacttttgccatcgttcctcggatatcttatgctattctctctcctagagctctgtttctgtccaatgagatctagtctagcaataatccaaacagaccctacaattcaaaggacaatagaacaaacatctcttcacatgtacacaaaatgtccaaaaagaactcaaatcaaaacaaaaaatatcccaagagacacggcacgacggactccagaaaaatccacttattagtgcgtccttactacgccgattgttcaagataacttttagcattatccctcggacaccctatgttactttttctttctatcccagcggttccctttcatctatcctcgtttctaaaatcaccgaccattaagatcaacgataattcaaacaacaaacagataaaaccttcctctacatgcacacagattcaatcataaattcctaaacaaaaacttaaacttacacaaaaataaaatgaaatgaaaacgaaaaaaatccatgatgggggagacaaatggtacagtggattctcggaagatcctcccatctcactcttgcccctgggctgacttttgccctcccttgggcatccatctcctctccctccctcccctcccctcccatccctacccccaaaatcgccgaccgaccgcccccaaatcccatccaagagccgtcgcctcctccaaagatcggatttcgagaccccccagatcggggggagagatccccgtgtcgtctggtgtggtgggtcggcctccgccccccggccgccgcgcttctcttgatctttctttcttttttttgatttttttgcgtttcccctccgggagaggggaggggaggagggttcttggatgggctgctttccgtgcttcgggtcgggcggcaagggggaggcgaagaagggcggcggcgggcgcaaggacggcggctcggcggatcgccgcgtcgcccgggtcggatcaggtgcggttcttgtggtgggggtgtggggggaaagggttggatcttgggggtggttttgtttgtaggaaatggtagctgatgatttgctccgatgtggtcagttcatgagattttggtgtgattcggatcaatgggcgattcgaactttgtgctaacacgtattcgattttagcgaatgggttggagacaatctcgaggtttcggcgcggatggtggtgtggtggtatttgggagattttccttttgtttgtgttaggctattttgatggtatgagtgcttgatgttagtatgcgttacttatctatttgtagtttatctgtgatgttttggatcggtaagctaggtcatcctttttggtttatcctataactgatagaagccagcggctttagtgatattttcgtggatggataggaggttgtggatggataggaggttgcagtatgactcttgcagtattggattcagggggacaaggaaattaatgtttcacttcttgtttatactgataaatgatgtggaagtacttgcaagactgctatagatgtatatgaagaaatggacgagtcagggagacttagcttccccccaggaaatatcacctgcaattttagcaataatcggtaacaatgtggttaaccttgttagtaaagctgacctttgaaagcattctatctgtttgacttattctctgggctacaatgacaaacctatggacaacacatgctagtgttggtacgtatggtagaagacccagatgcaacatcaaacaagtgccaaagaagcgtcattttgtacttttatttatttccatacaacatggtacattcaccacaaaattttaatcctggtttgtgatgaccaaaatggccaatgtgttttagaatgattaggcaggttatctcagttcttccactggatatgtttttaatatgcacaacacatctgtaaatggactggaaaattatgtgattttcatgaaagatcttctatatgacattcatcaaaacggaaatgcatatttcaatttctctaatataattctctgtctggatttttgtcctatgctccaactccaacatgcatgctgacaaaagtgaaacctttccgactttgtcctgacttaaacatattttttattcacccccctcaatcgataagacaataaatcaatataacttgtataatgatgatattgagcgcagtttagctggccatggattccgtttgtgtttcaagatgaggcattgattttgtagggatttttcatcagactgtaaatggtctaatcatcaataactaaaattgtacctgcttttcacatttgttattataaaagctcaaactatcgtaatatgaggaggcaccacattttctccgagtggtcaaaatgtacaactctaatcagagggagaagaaatgagtcagcatttggtgtgcccataaataagagaaaattccttatataccattggatgttaccctattcctctattgccattcaaaaattgacgtttaattatttttcacattctcatttcttgttcctctttcttctcctttcctctcttcctctctctcctcacctgctgtttcctttttatttcttccttcctagcctgttctgtcttcgaggatgttaccctattcctccatggccttgttcctctttcttctcctttcctctcttcctctctctcctcacctgctgtttcctttttatttcttccttcctagcctgttctgtcttcaaggtctgctgtactgagcaccgtggatgattacatcaagccagaataccatgaagttggggcccattgtcaatagagactgaggtcaaagccataatgttgggggacaaatacaaagaatggctgaaattgaagccatgacgacgggaagagcacattggcagcagtgtgagcttggcagtgcacaaattgaggcacgatggcacatgaagttaaagctcctcgtccaaggattaggctgtctgcgcttgaaatcagaacacactggcaacaaaatctaagttccttcctctcgttctaaacccaaggtccatggtggctaactggccatgaccttgaaggcagtggttgtgtttgggaatggtgtggatgtgtctagcagcagtagaaagacattaagtccgtccactgacaacaatgcttggctgcagggggctgcatccatggctgccgaaatcaaaacttgagggtggcaaagcttttttggctgtggggacgagctcagtggcagctgaatttgtaatcaatggtacatcgttggggctgggagaggtgagggaggcaactaaattacatgggtgattatgtgattgggataggagagggaagtccagcagttgagccgcttagagtaccttgtggaccatggtagcgtgccatctggcatggtgggtgaataagagagaggagtatttagtgcagctggctgtaggttgatattagtgctagtagagtagggtatggtcgttttattttttattggtggcacattggtaatgttttgatactaaaatgtactaatgtttctcttccgcgtattcgagaaaaatgaagaagagaggagagcagaaagagattggatgaagatgataagtggccgtgtaagggcaagaataggattttgccaagaaaaaaaaaacctgaccactaacaatgcgtcgtcctaccagagtaataaatggactagggcaagaaagggttattaaatatgggtcggtggaaaataagtgaacatcaaattttagatggtaaataggggatttaagtaacactcaatggtacataaggaattttctcagtaaaaaagggaagtttactaaatagatattattactgttatatttgatttgtttaataacaaacataaccatattctcaatttaggtattagagcattttaagcaatttaactgcacaatcatgtggtatctatgacttgtttttactattttactatttattctttaggagtagttcacctttttttgttacattgatgattcaggtggcccctaacactagatcattttctctagataaatcaaaatcacagggtggattggactctaggaaggatgcattcatcccaagggatgcgaatggtcaacctattgctgcacacactttcacttttcgtgaacttgctgctgccactaagaacttcagacaagattgtctattgggggagggaggttttggccgcgtatataaaggacacttggagaatgggcaggtttgtgttctgaaatatgtttttcgtggttggggattttttgaattctctatggttagctactgtgcacttttggtaatttgcgtactaaaacaccacattatggttactgcatttcttttaaccccctatgtgatctgtggagcattagaggagacatgtttccttaaagtcttgatcgatgagcttaccaaatatgcaggctgttgcagtgaagcaacttgatcgcaatggacttcaaggaaatagagagtttctggttgaagtccttatgctcagtctattgcaccatgataacctggttaacctaattggatactgtgctgatggggatcaacgtctccttgtatatgagtttatgccattgggatcacttgaggatcatttgcatggtaaatttgctactctactacactcatgaactcctattgtatttgtatgcctatgtcctgtatattcaaagacacatgtggcattatacatgcagtatctgtcaactcagcttgcaagtacctacatgtgtttattctatcgttgtgagctcgttataactcacacttccaacagtataaagtttcttccagaaaaaggaaaaaaaacaacagttttgtgggttatcctgtattaactcacaattaataaatactagttaaaataatttgcgtcgtgaaagtggtttaccaaacagaaaccttacattgttgttacttcaactttattgtctcccacatatcctgtctcaagtttatatatctagaataccctatgatgtaattatgctcagatacttgttccattgctaaatcatgaaaacaaaacattgtgtctataatctggacttgatttacttagcattatggtttttcgaaaccaacagactcttatgtttccataaaagttggtaatatgcaacaacgatgtctgcatcagactcttaagcgcattgtttgttcataagacgtatttagtttgtttaaattaatttgcatgattcataaatggcaacgttttgtacttttgtgtgttagatattccacctgacaaggaacctctcgactggaatacacggatgaagattgctgctggtgcagccaagggcttggaattcttgcatgacaaggcaaatcctcctgttatttacagggatttcaagtcatcgaacattcttcttggtgagggataccatccaaaactatcagactttggcctggcaaaacttggccctgttggtgacaaaactcatgtttcgacacgtgttatgggaacttatggctactgtgccccagaatatgcgatgactgggcagcttactgttaaatctgatgtgtatagttttggtgttgtgttccttgaactgattactggccgcaaagcaatcgacaacaccaaaccacttggagagcagaacctagtggcatgggtatgttcatctattgtctaaattttgtcataagcttgatggttgcctatcgatatatcgtagcaaattcatttattttacaatttcttggatgaagcataggtactaaaacattgtagttaaggaaaaaatgaactaaaagatttaaaagtataactaggatgggagtaaactgtttttcctagcttggaaaatgaaataatccactagccaaaaagctaatgtctcaaaagacatttttggaaattgtgcaaggttagtcttttatttacttctcagatcatataaccttttctaactgaaccttgagactaacatttatatcaaatgcctcatttgttaattcatatggcatttccctcgtattttctggaacgcaatcttcgaaagccttacactgtagcacatataacatgcaatcttcgaaaactatttctattcagctattgttattgcttattcatccagaaacagtaacttttcattaggcagtttgaccagggtcagcccttcttggccttggatttattgtcagttccaaaccaattttgattttttaagaatgattttacatttttttttacttttcttattagcaatcatgaaaggagaaagcaattagagcgatgaagaaaacccctaaaattgatcatgaagtcaaaagtttaaattaaattcagcttagaattatgatctggagctgaggagctcagccaagcgggtaaaccagctggtaaagtttgttgatttgactttataatctaaaccagctgagcatacttgtataattgtcaagtttacctcaatatcggattccaccttggttctgaaatcctcttataatacaagaacggtgtctcttatcaagtgagcgtaaagtagtttttttttgggggggaaagtaattattttattttgattgttaacaccagtggaattaggttatttattattgaccattgacactagttcttgtgatatcttgatcactcctttatctatactaatttattacctgacaatatattttcttgcagttgcagatttaaataagctttactttcgataaatattcagataacacaattttggatatctgataccattgatcttatttgcaggcccgtcccctgtttaaagaccgcaggaaatttcctaaaatggctgatccattacttgcgggccgatttcctatgcggggcctgtatcaggctttagcagttgctgcaatgtgtttgcaggagcaagctgccactaggccttttataggagatgtggtcactgctctttcatatcttgcttcccagacatatgatccaaatacacctgttcagcacagtcggagcaatgcatctacccctagggccagaaaccgtgttggtgcgaattttgaccagcgtcgtcttcactcaccaaatcaccaacaatctccagatttaaggaaagaaggcaccacaacatcaaaatatgaagctgaggttagcaggactaattctggcagtggctctggtcgacgagctggcttggacagcatggatgtgacaggttcacagatgggtagtcctgctcacgcaggaaggaagagggaatcatcgcggagtactgataggcagcgtgcagtcgcagaggccaaaacatggggggagaattcaagagaaagaaagtggccaaatgctcgtggcagctttgatagtacaaatgagtaaacctctgaagcagaaggttcagttaagtcgtcattctaggggaaaaaaaaagatgaatcacttgcagaacccaactgggtcgaattaggtacatggggcattttcgctccatctcggctctgcggtctatgtgaatagagcttctctttttcttttttctgtcctggagacaccaccgctgcttcagagctctcctctcgtccatacgaatagcatcaccgcgatctcatcgtcgacgcgcctattcctggcgtccattcctcgtgattgatcatgcaaatgtgccttttattcatcatgaagacagaaacaccgtttggctggaaatgtaggtagaaagcaaaagagaaaatttgctctggagctatccattgggtatctcatgtcgatgttgttgcatgatgagtgtcagcggctgcaccattgttcctgagtgttctagctctatgtgaagtgaagtctgcgtaccgagggatgtgatgttcttttttcttttcttttcttttctttttgtctcaatggtttgtacctagggggtacggcattttacctgtgtttcatacacctgtcatttgacaatttcatgtcggagttatctgttgttttatctctacgagtaagctgttcttcattcaatcttctaacctgtgctcttttttggctatggttcttccggtatatattactcatttttttctttgcttactaatttcttgcgagtcaatattggtggatggggtaacaaaaagcacttgtgtttccaagtacttaagcttaatatacttcccaagttttttatctcaaattgttcatggctattcctacttccaagtttttttatctcaaattgttcctggctattcctacttgtccatatcgttgttcctgtttgagacatcaccaatggttgttttttttccatttaaattaaattgaagtcacaagttacaactgcaagttacaattgcagagagggtatactgaacaaggtggcaaacaaaattcgcaacaccttgagtttgtttgtttgctgaacaccgtgttgcttctcgaagtaacattgcggacatggatcctatgcagcactgcatttggtgctgcatttgtagtagcagtgggccagtggctgataggtggacctggtcccacatatcagtggctgctactgcaggtgcggacaattcccattgcaacatggccatgctaccagtgtccattttgtcctgcagtgtttctttctgtgtactgcgacttcttcaagaaaccagacttcttcaagaaaccagatgaagaatgaagtagaggatggtacaagtcaaaatacaaatgaactaccagctgaatgaaatggagcggaggatggttcaagtcaaaatacgaatgaacttggctacttgctgtttaagcatctcctgccggcttggcaatatttcactatttctaaagtaaaatatgcatatttgattgatcatcgaaaaaggcaggttgcgaaatgcgtttgatgagagggcaatttaagaaatagatcgatttaaaaataatcgagatgatactgagagaagtatacgtgactctatgagaaaggggaaatatagtgttcacagtgggggacaactataggtatataagattcgga

SEQ ID NO: 642 - DNA, 3240 bp, Oryza sativa
ttgtgatgccctacagcaaatacacgttcttacgacatcccctagttaattacacgtttttcggacgtcctgtagcaaattttgccgtataacaattacattactatcctcatctttccaaaccaagggtaggaagtagagaacttctctaaaagtgttttggaatgtaagaacatattttgacacaagttttgaatgctggaatgataagcaatttgaaacggagagatttatcaaagttaggacgtacgtgctctggtactagccgtacgatgacgcccaataattcaaccgaagaacaaccacacctatcgatccgaggtggcaaggtggaaattttgcgttaaagctcaatttgtccctggtgaccgtgacatcagattgagtatcactgagtctaccaattgaaggttgtatatatccgaggtggcacagtgaaaattgatacgctatgaaacccaacaagattgaaagaaattcataattgaattaatacctaccgataaagggtatttgtttagacccatctcagagcatgacatgtagtcgtacctatcatctaaaagcatttaaattagggtctgttcgatttagattattaaacaaattattatcgttgattacctaccaattgattatggaaataaattaaatactttaaaattaaacttaataaatagtttaaaacaagtgatcaaagcagtagaataaagtttgttgagagattttttgaaacatagaacaaataatcagttccaataatccggcgaataatctgagaatcagtgttctaactgtaaacaaagaccatgatctcatatatgattattctcccaaccgtcctatatatgcccaggtctcaaatgtcagctcttctagatggaaccaaagaaaaaaacccttaatttccacaggtcaagccacatgtgatccccaatattcctacttccagaaccctagaattccacacaaagttcagcatatgcaaccaatggagctgagttcccaactgcaacatttattctggatgatgtcttcttctcctcttgccaccctataaatagcccatgctactgctcacctttgaagcacaagcacaagcacaagcagctctagctagctacaggcatcagtggtcagtagagtgatcagttgcaactagctagctagttagattatatcttcagtgatggctccggcctgcgtctccgacgagcacgccgtcgcggtgtcggcggagcggctgtggaaggcgttcatggacgcgtccactttgcccaaggcctgcgccggcttggtcgacgacattgcggtcgaggggaacggtggtccgggcaccatctacaccatgaagcttaaccctggtaggtccagaaagatctaagtacttgtatctactgattgtacttattatctcggccgattttttttcttaaatttttgtgaatttggtcaaaatttagtcaaattcagttaaattattttcaaatttctgaaaaaaaaatcagtccaaaaagtgccgaaaatcccgaaattttggttctaccaaaatggctttcggcgaaatcgaaagtgaaaatcctgtcaacaacaaaaagaatttgattaagacagttaaaattactatagtgcagtataaaattgattgggtatataataacaacaaatgttaaaattatatgcagccgcgggtgtgggaagcacatacaagacccgggtggcggtgtgcgacgccgcaagtcatgtcctaaagtcggatgtgctcgaggcagaaagcaaggtggggaagctcaagtcacactcgacggagacgaagcttgaggccaccggcgatggctcctgtgtggccaagctcaaggtggagtacgagctcgaggacggcagctcactgtcgccggagaaggagaaggacatcgtggatggctactatggcatgctcaagatgatcgaggactacctcgtcgctcaccctgccgaatacgcctaagatgaagaggaatactgcctctatccagtatatcccacctagagtgagtgataattaaataatgagagccgcagaaatgtccaaattctcgtggcgtttgagtccgtgagagtaatttcgtgctttaagtttgtggttgtgtttatgtgcctttctatggtcgtattcagtgttaaagttatcattttgcttcatcaatgggtgaataaagagaggcaagtctgaatgtgttctgctatggtttggaggttaatatggaagattgaaaatcattgtgaatgctgccgatcagaaatactacatgctattaagacaaaggtaacaaatagtattcgtagagggcgctatagcggtaatggccctctaccactatcgctatgacgtagcggaatgtaaatagtacgttggaattattcatgatatatactctcaaatacgtgagataattaaatgctgctattggaacttagtatccgctatagcgcccgctattcgtgatccactacataggcatcaattcactaccaacccgctatatgctatttattaacttgaatataccaccaacccactacatagacagatggcacatactgagtacagtacaattacagctgaattgtatatccttaacgagaagttcaaacatccaaatatttcagaggaaatggtacatccgtcagtctatgaatccattgagttgattagatatgcatactgtgtcaggttccatttcaaatcaccatgaatttttgcgaaaacagttcaatttcaaaaggaaataggtggaacaaagaatcctatgttccaaacatctgaagaagcaaaaaacaaagcaatatatttctgtttgtcggtcactggaaatttcggccctccatatgtaattcacaggaaattttattacggcgtaatctgcaatctgaattcgctgcgaaatgcaaccacaaaccgaagacagaattttccatcgaaatgcctcgttgccgcttgctcctgctgaccaagtaagaattcatcagacacacaacatacagttacagataatcattttgaaatgtcttcaataattgcctacttggagtatcaattaatcacaactaatttaattgataaacaaacaatcaattaatcacatctaataattgggtacaagtacctttactgagttgaatttgacaacacgccccatgaagcaagcactacttcatgtgagcttcagagaaagttcagagcttcagaaactgaaccac

SEQ ID NO: 643 - DNA, 4633 bp, Oryza sativa
ctataagatcaaggatggattcgccgaggggaaggatctgattgttaccgtgatgtctgccatgggtgaggagcagatctgcgctctgaaggatattggccccaagaactagaataccttgttaccgtgtttggctacctgtctggtcgctttaagtttggagctggtcttgagattatatataaacttttgatttgagcgtaagttaagaagacatatgggccgttgttccatcttgcggtttataccgaatgatttggatgtacctttgctatatgtaatgctattttgaaccagtagttttacagtctttatggttatttatatacaatgttctttgggttatatgcaaaatttcttgtaatccatcctatattctgttgcatcattttttgggtgctctttgacttagtcgaagtgatcctcttgacttcttacgtatcggtttcgattattttggttattgtgttgaacaattgtgaatttctgtgagccatgtttgcaagtcctaaacggtcaaattttgctttccactttcaaaatgaatcgcatggagcttagctttacaggtgaaaatggtctcagatttcaatcaatgtcatttttggtcaaattttgctttccatttttggtcagattttcaccttttggtggcaacgttgttttgccaggcgtgacaaagtgaattggccgcgccaggccgtaccttgtagccaaaaggtttatatttaaaaatactttagaaaaagactattaataaaattaaaaataaagagtctaaaaaataaaaatatttttaagtttggatgtgtttgcttcatgctaaaattggaagtttggttgaaattggaacgatgtgacggaaaaattggaagtttatgcatgtagaaaagtttcgatgcgatagaaactttggaagtttgacgaagtccgtgtgcgtcaccgacatatgggtcccttctagcggtgcagaaagtgataaggttcaaccaaagtcgcaagtccgcaacgcgactgtgcacacgaggccactccactcctctcctttgcgctcgctctgctctgccatggcggaggcgctcgtcgccgtcctccggctcgcggcgtccgccgccgccaccgcacgccctcaaagccgcagcggccgccacggctcctgcgcggcgcgcgtcccctgccccggcccgtccccgttccgccgcggcaggctctgcgcgcgggccgcggtggccggcccgccggaggtggacgacgacgacgcgatgaccatcgacaatctccgccgcttcttcgacgtcaacgtcggcaagtggaatggagcattctacgtgcgcgctcgcctccctctagttcttcttcttcttcttcttcttcttcttcttcttcttctctgggtttgtagtctgcaagactgagacgctgagtgttcttgttcgtgtgcctgtgtgcttgtgttcttctcgtcagcaattcgatgcgcacgggagggtgctgcaggggatcagcacgcggctgtcagtgagcacctacggggaggacgacctcatcagcctcctgcaatcgtaatgacactccacttactcatgttaaatccttttttgttcagttctgatagcacacttcaattatcgcatttttttatttaattcagtattgtttcatgtgttccatgtttatatcatatcctttgtgattgtcagtaatcaagaacaatgttttggccgttctgttgtggccagggatccttacggcatatttacctattgtgttttccaggctgtatatcaagcaagcttcttctcagatatcgtttgtagatgaggaggattctgaagagtgggtggagtacaaaatcaaagagacaaacatgttcactgtagataaataccagcaggtgcactgaagtttgatgatctcttgacatttttaaaaaatttgtgtagttctgagtatttttaatgagcggtgttgtttagtaggtaggattctttcaagaggaaaaggcatttgctctgaggtatcagactgctggaatgctggagactgtccttcgggctggtgtgctaggagaagatgatactggtgaagaatcccccaagtaaacaacctagaaacattgttacatgcttactgcactgcgatgcttgtataatgagctgttacttatctgttttgtacttcaccagaaacttgaagatcccttctcgtaagccatctattgtatgtgagaattgcctttactctcgtgaaggcaatggccgagtaagggctttccacatcatggacccaaagggagtgctcgatatgcttataattttccatgaaaagcagggatctgaagtcccacttatgtactcttcagatgatgcagatgtgagttcttatataagcaaatgctatagtttcaaacgatctgacaatgggatgatgctaaaaatagcccttttcttttgcactagatcaccaacagtgatagaatagctccactactgggaagatgggaaggccgttctgtgactaagaggagcggggtgtatggagcaacactttctgaagctgatacggtggttctccttgaaaaggaccgcaatggtcagctaattctggtatgctgcagaattacattttgcgtatcattattctccttagacttttaactatggagtatggaaatatgtgcttctataaagatgataatcccaatcagtgtcttggcaaaaattgacctaaaacacagccgtaaacctatgggtgatggatttcaaaatttgcatgcaatgggtggacaagcgggtgtgtctgcactagtatgtgcatcagcatattgtgttcgttctttaccttacagttgcattcatataattaggtagatttatagtttacaggcattggaaaatttctaatcaggtcaatcttatgatttataaaaattataaatgcacttgcctaaaaagtgtttgttttcagtagcactatatcgtgttcataacttgtgttacatgttgttcatgctgttcataggataacatgtcaacaaaatctggatctagcacaacaacaactgttcactggacaggatcagcaaataacaacttgcttcagtttgatggaggatatgaaatgaccttgttacctggaggaatgtacatgggatatccgacagacatcggtaagattgtgaatgacatggattcttttcatttggagttctgctggatggaatcaccaggaaagaggcagcggcttgtgcggacttatgactcagctggtttggctgtttcatcaacttacttctttgagactaaagtatgaaggacaacttttacttcgataattcgtagattttctccaatgatctcattgaagtgtgcgtacttagtcttgcggcttgttactcggtatgcgatagcagagtatatatttttggacagcttcatcctatgcgaataggagaaacttatgagagcagtgttttgctcttcattggctaaaattctactagcatgtcgcattcatatatttccaagtggctttttttccctggtgtggctggggtagttaaacctttaggtttggaatttgtctccccttgtaaatgccgatatcatcctggtcgaatttggttttgttgaatacaagtattttgaaactgaaaaagattatggccgtggatcgttcttcatatttctgctgcaaaacttaggagtcaaaatttctgaccaattcgttatggggagggggaaaaactgactaattatgctggttcagtcagttgttgtaccaaagccaatttgaaaccatagtctaaaagacaatggaagacatactctacctagtaacaaaaggtgactttctgtctcaaaaaacaacgtcatagggatatatatgtgatatggatggagtgatgttacaaaggcatactcctacctctgtgactgctgttaccatcacgacattctagggtctaccatatgatatggatggaacataaaggtgatttaactccctggaaggaaacctctgttggtaatccaggaatattttactctacaataaccgtgttcttgcttctgtcttgtagtactccagtgaaaagagatatacagctagaaattactaaagaattagatgtctctaatcaaggaattaatgtgtaatacttgtttggccaccaatggcgccagcaaaccgcgtggaaagatctttacatagagctggagaaagctgctgtttatcaaagaaatgaaatatggtatttgaccatgatggttgcaaaaatatacttttgccaacagtttgaaagaaacgtgtagcattataaaactgccttgggggttagtgcgatacatgtatatatctcatattataaatgtgccaagacattccactggctaagagatactggtgaggttatatatatagcgtgcacaagatggagatttttttttttaatcttgcctcaaatcctcaatgttgtagagaggattacacttgtaagtttttggcttttgcatttgatcctatgagaaccaattggtccacgttgtgcaatgcccctccacaattatcccccacacacagctcccaaatctctgttcttgagaaaataatgctgcttaattagttgtacaca

SEQ ID NO: 644 - DNA, 4976 bp, Oryza sativa
ctaagaagcggtcaatctgctaatttgatgatcaccagttcaccaccatggcaccatgctgcacttaacaacaaaaagaaatccacgtagaacaatgtcttgtgactacaactgtcactgacatacagtccgagcagacacctgaaatgcaaatttcaacagtagaatcagtcagctgatttaaatataaacaggggtaagaatttaagcagctaaaaagcgatacaaaccctaattaactatactctactaattaagctacccaaccatctgacatggtttactacttcagaaggcagctccccaattcattaaaaaaaccactagtaatttaattatagcaaattttgctacgctacttcgtggttctatatgtaagacaccacacgaagtaaattttaagaaaaaaaatactctataaatatgattatttactagatgtacaatatcgtttagtgttaccataaaaataccaggagcaatttggtcacaccatgttataaagcaggtcctatcttgtatcctagaaacactaaattaatgtatgcaatgtccattggtaaataactcagagtatattctcctaaaaattactctatgttgtgttttgtagttaaacccacgaagtctagatgtaccgcaacagaatttgcatttaattaatcaaatgaaacgagaacattgtgtttctttttttggttttttgcctgtaatagtatacgggtatacggtacgcccggaactagtcagacaaacgattcgcgaccgtcactccgcacgctccgaacccccgcgaccagaaaccgtacccgccttctcccgcaccgggccccaccatagtccacgtcacctgctcagcgctctcccattggtgggtgcgaatagtccacagcagcatgcggggtcgcagcccgccagtcaaacctcgagggagctttgaccagtcaacggtcaaacgttcaaaggtctatataatgatcaccggaggcgtcgtcgttggaagaagcagtagccacacccacacgcacacccgatcgatcctggcatcctactctgctcgatcgaatcgctagctttcttcttcttcttcttctcctccgtctccgatgaccgccgcgccggggagcctcccgctggtgaactcgaggcccgtctccctctccttggcggcgagcaggtcgtccttctccagcctgctcagtggcggcgccggctcgtcgttgaacctcatgacgccgccgtcttctctcccgccgtcgtcgccgtcgtcctacttcggcggcgtctcgtcctccgggtttctcgactcgccgatcctcctcacgcccagtgtaagcaagcacggccgccgtagccgatcgagcatcccatttcctttgccaaattgcaccggcatgtgtggctgattattgagctccatcgtgtttgtttcagttattcccatcgccgacgacgacgggcgcattgttcagctggattacgacggcgacggcgacggcggcgatagcgccggagagccaggtgcaaggaggggtcaaggacgagcagcaacagtactcggacttcacgttcctgccgacggcgtccacggcgccggcgacgacgatggccggagccaccgcgacgacgtccaactccttcatgcaggactccatgctaatggctccattggtaagacgaacatcaagctcaacttctaaattattagtgcagagctaagaaattacgaacagggactgacatgtgggccagtagtcgcatggtagtgagtgatttatcacaaacttttttactaaaaaaaagtaatgataagcttatccggatcaacgacgtccttgcattattacgaatttcttgtggattgggaggttctcttttgacttttatgccaaagcatacatatatgatgaaatgcattaatatctcgcggccaagatatcttaatcaacatgtttttttaatgataagggacactcaggctagatttgcaaaagcaaacttcattttcacgttctccatgaaaacctaagcacataccattagtcaagcttgctacagttctaaactagatcaattagtcaaaactcccttggaaaaaataattaccctgcatgtgatgcactccaaaaaaaagatgcatgtatcattgatattgttgtgtttgcaatattgtagggaggggacccgtacaatggcgagcagcagcagccatggagctaccaagaaccgaccatggacgctgacactaggccagcggaattcacctcgtcggcggcggcgggtgacgtggccgggaacggcagctacagccaggtggcggcgccggcggcggccggcggcttccgtcagcagagccggcggtcgtcggacgacggctacaactggcgcaagtacgggcagaagcagatgaaggggagcgagaacccgcgcagctactacaagtgcaccttccctggctgcccgaccaagaagaaggtggagcagtcgccggacggccaggtcaccgagatcgtctacaagggcgcgcacagccaccccaagccgccgcagaacggccgcggccgcggcggctccggctacgcgctgcatggcggcgccgccagcgacgcatactcctccgccgacgcgctctccggcacgccggtggcgacgcccgagaactcgtcggcgtcgttcggggacgacgaggcggtcaacggcgtcagctcgtcgctgcgggtcgcctctagcgtcggcggcggcgaggatctcgacgacgacgagcctgattccaagaggtggaggagagacggcggcgacggcgagggcgtctcgctggtggccggcaaccggacggtgcgtgagccgagggtggttgtgcagacgatgagcgacatcgacatcctcgacgacggctaccggtggcgcaagtacgggcagaaggtggtcaagggcaacccaaacccaaggtacgttgcatgcgtgcgtaaacatatatcgatctgtcacgtaggtgttcgacgcgtgtacgtgtgggctgacatgcatctgtgctctatctgcaggagctactacaagtgcacgacggccgggtgccccgtgcggaagcacgtggagcgcgcgtccaacgacctgcgcgcggtgatcaccacgtacgagggcaagcacaaccacgacgtgcccgcggcgcgcgggagcgccgccgccgcgctctaccgcgccacgccgccgccgcaggcgagcaacgccggcatgatgcccaccacggcgcagccctcgagctacctgcagggcggcggcggcgtccttccggccggcgggtacggcgcgtcgtacggcggcgcgccgacgacgacgcagcccgcgaacggcggtggcttcgccgccctgtccggccggttcgacgacgacgcgacgggagcgtcttactcttacacgagccagcagcagcagcagccgaacgacgcggtgtactacgcgtcgagagccaaggatgagccgagagacgacggcatcatgtcgttctttgagcagccgctgctgttttgatcatctaatcgggccgtcaatttgatcagcatgcatgatccatggatgttgtgtacatgtgtatgtggagtgagttagcttagctccggtaaggtttgtgactttgtttcatttgtttcggaggcccgggccatgcagctgatgtctgcagaaagcagggtgaccttcgttttaacgcgttgcaattgcacagagggcgtatagggagaacgagaaaataattaagatcagtttttagctgcttaacttttttttttcaaatgaaaaatttgttgtagtatgcaaatgtaaactgtaaacacaatttggatatattgtattaaattattcatatgtccccattgtggtagatttaacatttcgttctatggctttgctatgtatgaattgtcaggcgttaatttgttgaagtacaatgaatggtgaattgttggctctttctcgtcaatttaaatcttgggtgaatagccagttcagtcctttaacttttgctcagaggtcgaattagtccttaatgttttataatgtccaaataagtccctgaagattatcatgtggtttaatataagtcattgggcccaattaaaatgccatgtcatttgtgcatgtagtaaagttaacatttaaatgtccattttaaccttacattttttattaaaaaaagaaaagaaaaacaaagggaaaaacaagaataagcaataaaacaaaggaaaatgccaatggccaaaacttttttttttgttttttctcaatagtttttccttatttcctatgaaagtgtaagggtagaatgggcatttaaatattgaatttgcatgcatagatgatgtggcatgtacacatgacatttttagagggtccaagaactatattaaatcacacaataaactttagggacttgtttggacaatactaaatgccagggactaaattgatccttaagcacaagttcaaggaccatgttggttattcactcttaaatttttgataaattgttgtcatatagtataactcaatatagtatcagaactgattggtacatataataggatcttcttcaatcttaataaaccaatatttggtagtgttcttcgagctccaaacaagtgtgtgaggggagaagataaaaggtggggaatttgggcaagggagggggggatatagaagaataagaagaatacgagccaatctccaaatataaggaaatgctaaattatatcaaatcataggttcataaattgattctaattcacctcttgtgatgtaaatcccatatgctctaaagggaaaggggggactgggggaggggggggggagatcaactatgaatgtgatatgggcaggaaagctataagctagttggcgtgggaggtgctagtgctaagaaaatggcgtagacattgaagataagagaggcgtaatgatgatgaagagtagtaagaagagaa

SEQ ID NO: 645 - DNA, 6101 bp, Oryza sativa
atgtaccaaactctctccactcaacatgcaatttgtgtttggccaagtatgaccaagcgagaattttgccacttagccagccagagctgactcattggtccctctaagcactctaaaatatagtggcacaaacaagaaattccagtcatgtttgcactggatttatcaatggtttaattgagtactccctcagtcaaaaaaaggcaaaccctgggtttccgtgtccaactttgactgtccgtcttatatgaattttttttataattcgcattttcattgttgttagataataaaacataattaatattttaggtgtgacttgtctttttaatttttttcgtaatttttttaaataagacggacggtcaaatgttgagcacggagaccagggtttgtttttttttttacggagggagtagttttgtggatagatttcttgacttgagtagtgcattcctggtccatccaatccccaccctgaccaagtcacttaaaaaacactagcaaaggtcacagattttgactgaaaaaaaaggccacttgagctgaagccgctttctccttcagcgacctagatgacatcactaattctaaactttaatctctattttaatcgaacataactacctgtactgtacacataccaaatcgctgaattactctgacatctccatcaaactaaaccacgagaaaatcgtaaaaatctttcctgacaagaataggtccccatcgtctagcttattcttgacttattaataaatcaaatggcatatttgtaaataaaaataatttatgaataaaacttttatatacgtgttattagcgagaaaagcaaatgctgaaaaataaatttgatggaaaaaacatcaaaatcaataccaaatttaaagttaaaaatttaaattttaacttaataagtacgcgatgagcaaaaatataggctttcctactaacaccatcaaaagatttattttttcattactgcaaaaaccaacgaattatctgttgcctaagactgtgactcactagcttgacacgaagaaaattcgaggaaaagaacacattgagcgatgcgatgcgatgtgatggcgatggcgtcatccgagcgccggtgaccggcgacggggactcctcctccgccgccgccgccgccatcatcgtcgtcgtcgttgccgtcgataatcctgacccagatccggctaattatattattacccgattccaatcagctgctaatcgagtggtaatctccatcacatcacatcacagcctcgttcgttcgtcgctgacggcacattattatatcctagtattatattattaattaatcgccgtcacctcgtcgccattgacgacctcttcctcttcttcctcctcctcctcttccactcccccacctcacctcgccgctcgccgtggcggcggctataaataccactccacctgctgccgtcgccgccgccatcgcctcccatcctcccgccgccgccgcctgcatcgacgacgatggtgaggctgccctacgtgaccgcgctgaccacgctcttcagctacggcctcctcttcgccttcggccagctccgcgacttcttccgcaggatcctcgacgctggcaaatccagcaatctcaaggttttttgattctctctctctcgttttctctttttttttctgatttttttttttggttatctctcgctcactcacgctgtcctccttggtgaattcgttagggctacgcgccgatttgccttgggctggaggatttctacacgcgccgcctctatctccgcatccaggtgaggttgcccttcccaccccccattgccacgatctccagagcagcagagttgactcatgaaaagtcgaatttattttcctcctttaatttggttggaagtgtcacgcgatcgtgtaatgttgggtttgtaaaggtggaaaggcataaaagctaatttagttattagtgatttgttcctttgcaatttggtggagtatgagaataaacaatagagtggcaattcgctttagcgtcctcctatgtactactagatcacatgatggagctttccatgtgaaagatgtatcatctgaagcactttgatcccatgaactagctgttgcagtggaattcacaatctttctcacttaaagtttacaattaatggctggaagaagtgaaactgctgtttcccttgagcatgctagtatgagtaggaactaatatctctagtagcaaagcgaactgtcactctatcgtggagtatgagaataaacaatagagtgacagttcacccagatattagatattacactaaggaactaataatatctctagtctgactgtatgcgtaggaagtaggtattagtgaaccatataggttgatcactcctgcaatggtaaattcagtctaactgtatcgtaagttcactgcttaaactctagaatgatgtattaatcttccttttgtttgtgtgtcgttattgactttgtgctgtcaattatcacggcaggactgttttggccggccaattgctagcgcaccagatgcttggtttgacgtggttgagcgttactcaaatgacagtaacaagacactgcagtatgtatttctcacatctgattcagcacctagttagcataagaaaatgctgaatattatcttaggatgcatgctattctctgatccaatgcttcttcaatgcagtcgtaccacaaaaacatctaagtgccttaacttaggttcctacaactaccttggctttgccgcggcagatgaatactgcacccctcgtgttattgagtcactgaagaaatactctgctagtacttgcagtgtccgagtcgatgggggtaggcacttatgttgctgctatagtttgttgccactgagttcttaaatgatttagtgtagtatataagcttacctgattcatacaatcttaggcaacactaagctgcatgtggaacttgaagagctggttgcaagatttgttggcaagcctgcagctattctttttggcatgggttatgtgacgaactctgcaatcattcctgccttggttgggaaggtccgtgatagagagactgccgtgttttctttctattcttttctacatcctggagctaatgtattattgattgcagggaggactcataattagtgactcattgaaccataactctatagtgaatggggctaggggttcaggagctactgttcgggtttttcaacataacagtaagctcactgataattgacagctactcttgcaagcgatgagctcaacaatggatcacaatacataatgcttccctttattttcttccagatcctgcacacttggaagaggtattgagagagcagattgcaggaggccagcctcgtacacacaggccgtggaagaagattattgtgattgttgagggaatatatagcatggagggggagctatgcaaactccctgaggttatagctgtctgcaagaaatataaggtttgagaatttcactcaccgacttatgctctttcttcagaccattcgtgtgggcatgtagacctatttactggcatataaaaacttcagctttcacctgctactaaaagagacagatgtttactgagtaattgagtattgactattgtacttaaccttctggataggcttacacatatttagacgaggcacacagtattggagctgttggtaaaaccgggagaggtgtttgtgagctactaggtgtggatccagctgatgtcgatattatgatgggaacatttactaaatcatttggatcatgcggaggttacattgcagcatcaaaagtatgaagaagattcacttgctatacttggctgagcactgtagttgataaatctgaccatggattatgctgtgtttatcaggagattattgatcatctgaagcacatatgccctgcccatatctatgcaacatccatgtcacctccagctgttcagcaggtcatttctgcaataaaagttatccttggtgaagatggatctaacagaggtatatcagaacttgttgatttcttatttcttctgtctttaggaaattcctaatgtaattattgttctaaataggggccaagaagcttgctcagattcgagagaacagcaatttcttccgttcagagcttcagaaaatgggttttgaagttcttggagacaatgactcgccggtcatgcctatcatgctttacaatcctgctaaaatacctgcgttctcaagagagtgcctgaggcaacacgtgagttttcaaaatatacctcacctaacgaataaatcatgctttagttttgaatccagtagcacacataatttcttcactgaaaattctgctgtttgactaatgtgacatgtttcataattctaggttgctgttgttactgttgcatttcctgctacaccactactgcttgccagagctaggatatgtatctcagcttcccactcaagggaagatcttattaaaggattggaggtaaagtccatcctcccgtcaatgctacgggcttcatggcttgttgcgacaagcttgatttagttgcaaaccacatacagttactaaatttcatgttgattgtttaggttatcagcaaagttggtgacctcgtgggaatcaaatacttcccagtggaacatgaaaagactgcatctgttgagaaactgaagaagcttcaatgaacacctacaaccagaagaaatatactgggtgatctaggcagtgtgccatgcctcggttcggctcatgtgcttcggacccttttgattttcctttgtttctgaagtggcttagatctgtacagcttgtattatcatccatcatagtccaaaacacaacacaatgatagacactgttttgtcgagttcagaggaagcaaaagtttcgctgttacagctctgaatcttgcgagtaaagtgtctgaaatcatgtagagactcttcctcttttgattttagcttcctttgtagatgcaacgtcagttgcatcgattgtgtgtgaagtaagcttcactcatagtgtgaggtctggttgctgtgatcaagtgattaagcgaaaaaatgttgttaaatctctgaagtgtttgattgatctggtggcatgggtatcaggtgcagctatctgtgcagtgtactgccagattcatacttaaactttataaactgcccatgaacttgcaaaagttattccaaagagcctgatggaagagtgaaaactcttgtcttcaagtaaaaaaaaaaacgcaagatgacgccagttctatacatgaacttgattattacaaaagatgcaacttcttgcgtgcataatattttctaaaccgaaggcaaaagctctatctgatttcattgataaagaagagacatcaacccaaaaaatgattcactccaaaaacaccgtcttacaagtgcctcaagatcattccctaaacctacactaaatacctgaagacacccaattatgcttgcataataagctgtatatataagtaaactctccattttgaaatctcgtacaaatgaaactagatactttaacttattgttctctgactttaagcgtctgacatatgagcccacatgtcagtgactcacgccagaaaagtctcttcgcgtacaaatacagtacatgtctgtgggctagtcctagctgacaaatccttggacagtacggagagagagagaaaaaaaatcaatccatgcgtacaccggattcaagtagttcaacaatggctgaattgactcaattgagtcgttatatatatggctgaatctctttgacttgaccagtgcattcatcgtccatccaatggtctccgaaagctgaaaatacccggcaaagatcaggtgacagatctgaactgaacgcatcctgaaacctgaactggagatgctttcgtttctcgtttaacatttgctctctttttcaatacaaacgtagattagattataagttaagcagatttatggtgttatatggatcaccactggacacttggatgagatggtctgaaatattctgtacatggtctccaaatttaacttaatttgctgataatgtcaattataatg

SEQ ID NO: 646 - DNA, 4829 bp, Oryza sativa
aactcggccttctatatcatgtgcggatatacacggctaacctacacagaatatatcattgatttaaatttcaacagaataaatacttttgtagtgaagagtccaacaacacggcatcatccccatcccaatgagggagaatatgcagtgaaaaacatatacatatacatacatacatacatacatacatatatattggaaatatgaaaaataccgtaggatgaaaaatggacatatgagatttatccacgtaagcacgagtaaaacttttactctcataaccatgagtaaaagtgtaacggggagtaaatattttcctaacaataacggagacaaatatgtaccagacgtctatttttacgtgctaaaatagttttcatatattttttttacactacatattttcttcgcgcaattaccatcaccatgtgcaggaagcatcagcggcacaggaacctcagaagatccgacaaaacgacgtgcaacccagggatctgatctccattgccatgccatgtcatgccaaatgcccgagtgcgccggttgcgacacgggcactcgcaaccatccatcgctccgcttctttctactgtgtgtctgtactcttgtgtgttccagtggtaaggcatcccacctaaaatttttcatcctgtcacatcaaacgtttgaacacctatataaaatattaaatataggctaaaaatatataattacatagattgcgaataatttacgagacgaatcttttaagcctaatatctccatgatttgataattaatataatgctacagtaaacatttgctaatgagggattaattaggtttaataaattcatctcgtagtttactgatggattgtgtaattagttttttattagtgcctgaaccctatacaacatataatataatagccgatgtaacacgttaaaactttaggccactggatttaaagcccgtgcagcgtcccaaagctaaagacaaagcttaagctcagtgtcagtgtcacagtgtcagacacgacgagacgacacgacgacgccccacgtgcaaaccgcagtgcttggcaccatcattaacacgccatacttaacgctgattgcacttattaattctgtagccacgagatgatgatggcaagttcaaacggagctggaggcagagctagagtgagactgtgagagtgaacaagagataagctaagctagtacagcaaccagcaagaacaaagaagagtggccggagtgggcgggggagatgagctcggcggcggcggcgacgaggttcatcaagtgcgtcaccgtgggggacggcgcggtggggaagacgtgcatgctcatctgctacacctgcaacaagttccccaccgttgagtgccgcgccgccgctaatcccttcctctccgttcttgctccggcccgccgtgctggcctatcttctcttcggctcgatttggtttggtttggtttgatttgattcggtttggtttgggcaggattacatccccaccgtgttcgacaacttcagcgccaatgtctccgtggacgggagcgtcgtcaacctcggcctctgggacactgcaggtggggaaagctagctcaagctcaccctcaatctcaatctcaagctggggcttgcaaatcttgttctcctctttgattttattttctcaagtgttgctgctcacttgtgctcagctcagagaaagatctgatttagtgattttgattctcgttttggttggggactgttggttgcaggtcaggaggattacagcaggttgaggcctctgagctacaggggagccgatgtgttcatcctgtccttctccctgataagcagggcgagctatgagaatgttcagaagaaggtgaactgcttagaaaccccttgtcattctgatgcaattttttacttggttggatatgttactttccttcgcattgcgctagtagaatcgctatggtttcctgatgcattgcattggcaagattgtagatatgtagttcagaaatacgcactgtttcaggtattcaggtgggcattatgctgaggaggtatcatgtcaaacaaacatggaagaatattaaaagcattgaacaatttgtcgtgtgtaataataacgctttctaaaagcgtgattcgtacaattgctttcctcgaaaagaacaaggccagttgagccgtggagacttagactttgctcgtcacgcttttcttttgcagctgtttgtgcattatatgcaaggttataatataaagccgaagatgaaattgcgagcaaaggagataatttctgttaatgccgaattaattaccagttgacaaaattgttaggagttgtggctcacttttgatttacttcgataatggtaaaacgcctccggttgtttgctctataatagcttcctaatgtaaataagatatcaacacgaagcttactacctagagacaagaaagcccatttacatgtacaccacattgcatcatgctttgtctcattacctttagaatctctaaagtgtgtactaatgacctgacttcatctggacagtggatgccagagcttcgccggtttgcgcctggtgttcctgtagttcttgttggaaccaagttgggtatgctatgctattcattaattcaccctttaccttctgaaatttcttaattttttgaacgccattcaaccccacgaagatatttgatacagtaaccacagcccagtgacattctttgctgatgctgcattaccgatttcctgtctgttcagatctccgtgaagatagggcctatcttgctgatcatccagcttcttccataataacaacggagcaggttggtgttttgactgtgacaagagaatgacacatttttgccacatttaggttagccaggtttcacatttttaggtcacagtttggttcatgccaaagttgtggctcaacacactttctgagcaccttgtcacacttgtcacacacaatttttccaaatacttgtggcacttgatttgttagccatgctttgtgtgtgttgcccacactttcggaagaaaactgtggcaagatgtggcacacatcctcaacaatgagactttcctgactctttctacatgttagggagaagaactgaggaagctaataggagcggtcgcctacatcgaatgcagctccaagacacagagagtatgcttctgttataccctatgcaggaaaactttggaattttgagctccttcatatttaatcatttactcacatcctaatctaaagaaatgttctttttcttggttacttgtagaacattaaagctgttttcgacactgccatcaaagtggtgcttcaacctccaagacataaggatgtaaccagaaagaaactccaatcaagctccaatcggccagtaaggtacctttgaagtttacactgtctgctcacacttcatcagtcatcacttcatcagtggtgcatcatcttttccagttcagcattttgatttccaatgaggcctttgacacttgatcatgattctgtaggcggtacttttgcggaagcgcttgtttcgcgtagtcaataaccaagaagaaaaaaatgtggtttttgttccatcaccatgatgttcagatggccccatggatctactcagaatgggatagaagatcatggttgaatcaacattgcttgcagctaggaggaacttctagttctctttttttctgcagtggagctccttttgtttctcctttctctttttttcttatgttgtaaaagctccagaaagttttacccttggtaataagatgtgctcttctggatggctacctttacccgtatctcctttcactttgcgaaatgttggaaactactggacctaacagacctaacagacaaacaaaaaagaagccacatgcttcaaccttttcttatatactttggattgaatacataggaagttaattacatcatggtatcaccaatttatcatccatgttaccattaggccaagcaattgaagcaatgaaacaacacgtggctgaaaaaggagaatgcaagtctcctatacatgaatggattacaagaaacaatcaaaacaaagaaacaagaagcatatatacccagcttcttcagatcacacagacatccagaaaaatggcacggcaaaaaagtactgtaaattctccggtgttgacttcaagagtaaggtaacacatcaatctagaagtttacaacacattgataacgagagctagtcgtttcaaccttaacaccgacaaaaccatttctcgccgtcagtcacacacagctcacaacactataaacctccttatggtaattacaaaatgggggagacattttttcaacaaggttacacatttctccttgtacaaacaagcgcactagtatgagtacaactacaaagtaacaggaggacgtttcttggactggcaaaacaaaaaccggatgctgcaccttgcaaagcccttgttcactgtctggcaggttcccatccagaaaatggggcatccacaacttacaagaagcctgcaagaaccatccttgctaacataagtaatcattcttttttcttaaactgataaacttgcaagaagaaaaagttcaacttaccttacagcagatccagcaaagccctcctcttacagtatgactatttggcgccataaagatgaaatgtatgattgtaaatgttcaggaattatgcacaccactttctgcttcagcggtaatccatatactcgttatcgttactgattgtagtaaaatcagctgggttcttgttagttatacagatatcctgtctcacaaaccgatcca

SEQ ID NO: 647 - DNA, 16796 bp, Oryza sativa
gagggcagcagcgcgcggggtcgccgagccgtctccgtcacagggtcatcgccggtcgtcgtcgccaactctgtctcctcccagcgaaacccgaaagcaagatttaggacctgcactggagttaagcagacctcccaggccagtgtgtgtttttttatcaacacatgggcctctcagcgaagaggccaagggtggaaggagaaaaatcaggtgcgggagccgtgtcctcaagccacgacgtcgcccaacgtgtcccctagctccgtggctcgacgaaaagcgactgaggagcggaggaagacgcgcccctctgctagggacggcaaactgatggactggcgacggctgtgagcagggacacacttgagagtacgcattggtgatggcctaaggaacccaaatcctagaaaacaaaccagcattgaacttttttattgaaagagcaatgcacatggaattgtcgagattttattacctgcaatgagggggtgtttgaatccagggactagactttaaactttagtccctgtcacattagatgtttggacactaatttagagtattaaacacagactacgtacagaactaattacataaatgagagctaattcacgtgacaattttttaagcctaattaatccacaattagcacattgttactatagcatcacataggctaatcaatgattaattagattcaaaagattcatctcgcgaattaatccagagttataaaatgtgttttatcaatagtctacgtttaattattttaattcgtatcaaatatccgatgtgacatgtgacatgacatctaaaaaatatttaatccattgcaaaagccaaaacccaaaaggacgtcaccgccccccgaccttccacatacccccagtaccccacctgtgattccctcccctccatctgacgccaaacggccgcgcccattcccccgcggtcccggtcgcctctcctcgggtcctcgtcaactcaaaaggcgcactcgaacgaaccggcgggggcgaatccttcgccccgaagcctcccactaccaattggtcccatccctcctcctcccgcttcccccccataagatcatttatctctcgtcattgttcgagcccaacacacgcgcgcgcgactcgtaggaattcggttcggattcgtgcgtgcaccgaaggaggcggaggcggaggcggcccaagcgtcggcgccacctcactctcccacccccatcccgccgcctcccccgattcctcccccaaacccctcctcctcctccgccgccgccgccgtcgccatgggtggccccctcaccgccgccggaggtcgaggagatgggggcgccaaggcggtggaaccgctccggcctccgccgccgcccgacccgaagacaatggccagatggtgaggcccggggggtgtccagtgcgcgcctgacggatcgcgattcgccgtcctcccctcccctttggatgctaatggtggtggtgggggtttgtgattgcgcgtggcgtgcaggtaccagctggaggcgctggagcgggcggtgcgggggaacaccctggcgttcctggagaccgggagcgggaagacgctcatcgcggtgatgctgctccgggcgtacgcgcaccgcgtgcggaggccggactcgcgccgcttcgccgtcttcctcgtccccaccgtcgtcctcgtgggccagcaggcgcgcgtcgtcgagcagcacaccgacctcgtcgtcaagcagttctgcggcgagatgggggtcgacttctgggacgccgccacctggcgatcccaactggaggacggcgaggtgctcgtcatgacgccgcagatcctgctcgacaacctccgccacagcttcttccgcctccaggacatcgcgctgctcatcttcgacgagtgtcaccacgccaggggcaatacgccgtacgcctgcattttcaaggtacaaaagtttacacccgccgccgtattgcgccctttcgtattttcccttcacatttattgatcgggtggggttagtagtggagtagctctcattttccattttcgtctcatcaacataggaacacctatgctctaacttacatactagtgccaatataattggaacatgcagcgttggttttgccacatttactatttcagtcagaatctttgatgtctcccttcccctgctgatctgtatcaccaatttagacaaatcattcgacgcttgcaggaattttatcacccccagttgaattctagtgcgtcagaccctctgccaaggatatttgggatgtctgcttcgctcatttattcaaaaggtaagggcgaaacgatcatcccttatgttttatgcacaggctctctgatcatctaatctgtcacactgttccttctatagatttgaatccgcacaattattcaaagcaaatttctgagattgagaatctcatgaattccaaggtcaggccatgtaattttcagttaattacgtgatccctgcagttacgataatcattcttcctaatttagttacctgtatgtgtctttgggaaataagcattgatgcatttgttgttcaaggtgtacactgttgatagtgaatcagctttgtcggagtacataccatttgcttctacaaaaatagtggactttgacgattccaacatttcatctgagctgcatgccaatattctcagttgtttgaatagattgaataaaaaggtactatcattcttctacattttgtttgcccttttggtaaacagtgctttctattgttcagttacatgttgcttgccgacaagttgcttactgtactgcatgaagttgagtggtaagactaggcatggcggccaatttggggtaagatacaagggagaggttggcactttcggcatgcctacagaagggaacagagattgagttggggagaagtgttagaaacttagaataaatgtgaaatgagaggaagcctagtaagggtctattctggagagctcccaactcctatgttgttgcagaatatagttttgtaggctaaaacaaagtggtttaagtacctacttttagtccaaaatgtaaagaagatgactcacctaaacactcctgtctacctacttttaggttccagcttcaagaattttgaagcataatatgctgagctggattgagctccaactcttgtatttttgtaaatatggagttcttaggctaaaataaattggtctatgctgaaatgtaaacaggatggcgcaccaacaccccagtctaccgctagcttgacctctaacaattttatagccaggatgctctgaagctctgccaaacaggcccagatagccaaatgatatcccctgcatgccaaaacgtgggacctatcaatggcatctttcagaatataaatgaagaataaaaaagttagggtttattacagtagcacagccagtgttctacagaagtatgtgaattctaaaatgcggtttaggtcaaaaagacagtttttagtgatgatttatcagtctcagagactgttaagcctgttgttagacttctttttttagttagagcatgtgccagacctttagtattgcatgccatggacctgttattcatggcttcttgtgcttgggctgaatatgacattcaatattttaagcaggaggtttttttttattgagatgcattgacattctttttgtaatgctttaagtaacttcttttaacaaatcctgtgtatatatgttaccagataccaatgcaattttgtttcattctcttagcatatagaagctctggacagaaaactacatggttcatctctggaaaacgctaagcaaaggatatcaaaattgcatcatacatttgtatattgtttatataatctaggagtatggctggcagcaaaggtatgaataaagatttcactgcacatttatagtactttctggaatcccaatttatctttaacattgtattttcaggctgctgaggtacaatcatacgaggaaaacagcctatccttctggggtgaaacattggataaaaatgttgagggcttcattagaaactacagcgaagaagtacatagagaactttcatgtttcttgaagaatggtacatactacacagctctggcttttacaaacataccttctctagcatgttgcgctttttatgttcttttcttggttacctgcatgacagcatttgctttctggaattctcaattaccaaataaaatgttgtctagtctgttgtctgcatgaattgctatctggatactagaaaaatgtttataatttcacttatgaatactatgatatttttaacataatttcacttatgatacatgcgatactaactgaatattaaaccatagatggcatccacttgccgaaattccaatttataggtcataccatgtttatttcattctttgcttttttttttcaggtcatattggtgaaaaatttccagctgattctcaagatgggatattgacacccaaagttcattgccttattcgaactcttctgcagtacaggtgctaaaatactcttctgatattttcttttgataatatttcacagccacatcctttgagattgcattcatttggctattcttatagtagtattggtaatatttctcattctctccctttgagactgcatcgactaaatggtaccaaaggttctgtatagggtggacgatagtggtgtattctttcattcttttttaatcaacttttgaattttgtctgctgtgagttaatatcaagtgatatgcatggttttacataatcagaaaataggaaaaatcatggatgaccagtacagagaaagagccattagcttctacaatatgcatgtgccttttgtacatgccccatggattacatttgaaaatctgaataaaaaaataaagaagagttcccaagaaaaaaaagtttattttttctgggagaactagcatatttgcccatctcttgtaacaaatctcagataaacacgcataagttggcttactcaaatgccaaaaaaaaatccccacatttaaaatatttaacttggatcaactgacaaccacatacatatgaacataattaaatcatctatatattggttcaatagaagtacaaatgagtaaaatgacacacgtctatgctgattgtttcaccaaaggttgattgaaggattgggggtgtagagcacaacccatcaccaccaactcatataagtagtacagaaatgatacattccagtaccactattattttcctgctgcatacagttttttcttgaatttcaccttctacttccattccctattactggcttttataggttagttcttagatggatattgaagtgtaagtaagttccatggaatagataatcacataccagccagtgtgaaaaatgtgttctaaagttttttttttagataatggaagctttattaatctcagtaaattctatcaagtgatacaattattctgagagcacctctggcttctgcacccaaagagtgcacacagccaacaagaaagaaacaaaagataaactcatcatccaaaatagcagggacaaaaagaacttcaggagccctctaaccgtagcctagaacgccacccatgcgccggggtagaaaactccatggccactagctccaagtgttgacaagccgcaatgatagtaccccgcaaattgaccttctgaaggatagcccatgagcagagccaatgtgtaataaaaaagataacctgcaaaggggaagatatgtttttcctttcaaaaaccacatcatttctgcaaagccaaatagaccaaatagtggtagttgcccctaataagaccaaagatctcaaattgtgtggttgtcttcttatccaatgcccaaacatatgagttgtactattaggtaaactaatattcgaagcaaactggattaaagaccaaaccgcgcgggcaaaacgacattcaataagtaacttggtgattgtaagagatgcttatgcttctactttcttgtactaaaactttttgttcttttgatcattcaataagtaacacctctctttctctctctctctctctctctctctctctctctcaggcatatgcaagacttaagatgcattgtgtttgttgagagagttatcacaagcatagtattagagcacctactttcatctattcatcaaatgtctgggtggaatgttaagcacatggcaggaagccgtcctggtttgctatctcagagcaggaaaaatcatacagaaattgttgaatcttttcgaaaaggaaaggttcgatattggtacttgtattttatgctataggcattctgttaagtatgctataggcattctgttaagtcatagtatgatagttctctgatgagagaatgatggttatgcaggtacatataattattgccacacaaattttggaggagggtttagatgtgccaagttgtaacttggtaattcgctttgatccatcagcaacagtatgcagctttatacagtcccgtggtcgagctaggatggaaaactctgactatcttttacttgtcggaaggcacgttttcaattttgttgctttgtttgttctctgtgcaaatttgttaactgttccatctttagtgaattgtttgtgtcttccatggactctgttcactgttttcacatttcatcaaaagagttgcatgcactggataaaaaaaagaatccctggttagtgccaggaaattgttagtggttacctatattagtgattgcttttcccatttcatcagttggtttttgtagtgaatcaaatcatccatagtggcactaaatattaacgttgactcttaaatccaagctggattatactagggagtaatagcagtttataaagcttttttttattataaaattgacttatggttcctgatggtattttccagaaccagaggtaactggtgtatcatcctggtaataagtttcaactgaaataattgtttgaatttttagtatggaactgccaaaattctcttggatggtggacctggtcagatcctatgactattgtaggcacttgctgtggatttatccgtcatctttctgattttagatgacacgataacctccttttgttgtcatcgttacttgacctattttgcattttattactgtgcattatacacgtttctgcatcaggggggatgtggaagctcaaactaatgcagagaagtttctcgcaagtgggcaaataatgcgggaggaatctctgagattgggatcaatttcttgtcaaccacttgagaacaccttgtgcgaggatacctattaccgtgtcgagtcaactagagcaattgtgacactaaactccagcgttccattaattcattttttctgctcaaagcttccatcggatgagttagttttctgtttcacacttaatagtttcgtttactttatattgcgcagaattatctgccacaattgcttcaagtttatgatgggggtcaaattttgacttgctagatattttaatcctctaccaagattcgatatagacaaggcatctggcacatgcactctgcatcttcctaagagcagtcctgtgcagacagttaatgtagaaggagaaggttctattctcaaggagacagtttgtcttaaggcctgccaagaactacatgccattggtgcactcacagattctcttttaccagaattagatgttccatgtgatgaagaacctgacatcggtatggttattcagctaagcagtttaattcaatttgttccagttgttgcaatttatatattttattccaattgattattcagggagcagtttattgtgcgagttatgataatgcagtaacacataagtaaaagtattttacacgtgctatcaaaattttaaactcaatttacactttgcaagtaattatttaccatgtgttttaaggaaaacttgatgcatggtgggtaaggttatatctgaaggtacaataggaaatgtgtttcgtgcattactgatttatacttgatagttttcatggacttgataatttactggtctagtggatacatacatgtcatgatgcctgtcccaaaacgaacgtagtttgttcaaatttacctattttgtttgctaaatttgatatcttcactaatcttgaaagtaaaagatctgtcgtaatttttgaagttggcttttaagtgtgatatatattggggctttgcactaatgttgccttaatgtttctcatatagttgttgagaacaaaattgagcagccttcttactttccagaagaatttgtggataattggcgctccttttctcgtcttggcatatattattgctataagatctcattggaaggatgtcccaaaacagcttctccaactgacatactgttagctttgaagtgtgatttgggatctgactttacttctagctcatttaaattgccaggtgggcaagacaatgctagtgttaccatgaaatatgttggcatcatccatctcaatcaagaacaggtaaattgtcaatttatgttctctaattctttgataactaggctattgttgtttagaccatttcattgagaatatataacttttgtttgtccaggtaattattgctagaagatttcagacaactattctttcgtttcttattggtgatgaccatttggaggttagcaatggtattaaatacttccatgagatgcaagtgcctattggagtagtctatctacttctgcctttagtttctggcagaattgattggtgcagtatgaagttctcatcctcaccaatatatgaagctaacaacaaacatatgacacattgccattcttgtaaagatattgatttactgcagacaaaagatggtcctttctgcaggtgcatccttaaaaattccattgtgtgtacccctcataataacatcttttatgttattagtgggtttcttgacttagatgcaaattcctgtttgcctcaacatgatgggactgttgttacctacaaagattattttaagactaggtatatgttttccctttcggtattacttcatgtttatgtatcatacatgctcctgtaagctatgaacgcacacatctacttgtttcctgtgtttctcaggcatggtcttactttgacttttgaaaatcagccgctcttggctggcagtaaacatgtgaaagtgcggaacttcctccacaactgctactctaaaaaagaaaaaggttttttttttctctggttgcagtaatattacataatgttttctccagctatcctccgttttgactacatgtgttgactcaattatctgtaataaaaccctcgaagttactaagttggaaattatgcagaacatttataaacatgattagataatgaattttaatatttgttgatgacaaaatttttaggtgttttagtttctacgagttacagacccttctgaactttctgtacatctaattgaattcttaaatatgtagcccaaaatgtaaactcttgcttgacattgaatttaaaattttccaatatttgaatgtaaagttttccaaatttaatatcctcagctgaatatggtatatgttttagcgctacttttatgaaatttagatttcattctactgtgagtacttactatgagagtgtacatcataccaataagctcttttgatataaatattggcactgcagattgttttaattgtagacatattttttgctactattaaattttcctttttctagtttaataaccttttggagtactatgccttttttaaatatattttgcttctctatcatcttttccttaatccttctttatttggccagacactatattcgttttcaggagcagtaaatgtacttttcatattactatcaaaattgtagtatattagcacagaatgatgggttgcttgtagcttagcttctataaaattaggcagtgaggtatttgggacttggaagattacatttgacataccctgagttcatgttcaatcggacagttaaatcccacacatattgctgggcttgatcatacatgtgtattttgcatcgctatcaatgaggcatgttacagtgggttatagctgaactcttagacaatggtccaactaatgtactgcctgtactatctttacagagctacatatgcataaatcactgatttggtcatcttttttccttgtttcagaacctggtgatagatatagtgttgagttgccacctgaactctgcagaattatcatgtcaccagtgtccgccaataatttgcacatcttctcatatgttccttccataatgttccgcatccagtgcatgcttctttctgtgaaattaaaggtccaattaggcccaacagtgcagcagtttgacgtaccggttttgaaggttgattttctcatcaatagtttcctatttatgaattattgaagtacctagatcaactagatgtcgtcatataagaaaactcatatttcccttattttttgaagaatttaaaataaaaatggatataagtgcattcttgggcacaccagtaggtgttgtaggaagagtgatgacatttgacagtgaaaactaaaggttctgatttttttagttgtttaatgcagcaacagtgccttagtaagaatatgtccagcacttcgaagtgactatctattaatgaggcaaacataagttttggttccttctacttgcaaacatgacaggtcttaagtcatgtataatgcaagatatttcggggacacttagcaaagaaataattccttttgttgccatgtagaagttggttatttttgtagcaattgatgaggcagtggtacttaataacttcttatgcatataaataccttcaattaatgcgtaatgtaactatataagcacatacaaaaagctgtctgcattattcattaacactccaatggaggtgcttgatggtgtgttgtactctatagaaccatgtatggattgatggtcctatattgtaaaaataagatataagaatatttgaatccgtggagtattttatggttctaattaatattttggatgccccactgttaacaatgtacatgtcaatctgaattttcttacctgttacctgaataaattacttcccctatgcatatttcttacatgtgtatttctctgcatttttttcatgagttgcagatcctggaagcattaacaacaaagaaatgccaagaagaattttcacaggaatcattagaaacacttggggattctttcctcaaatatgttacaactcggcacctttttagtgaatacaggcttcaacatgaaggcatattaacaaaaatgaagaaaaacttgatctccaatgcagctctgtgccagctggcctgcagcagtaatcttgtggtactctagatcctgttgctaactgtatttttcttattgagctaggcatgtagaaattttttttatcgaacacgcaggacagctgcatatcattgcgttaaagaagggtaaaaggaccttagaaacacacacctacacactacagaactgattacatgcacatccttgctaattttatgcaatattaatagtcctacatctcccagtatctttcataccatgtcagcctatttcaattcttttgtgcaactgctatatcacaattaggcaatgttccacatatttcctttttaggaaaatgggaactctattgttgcattgaattgtttgccaagttgccaatatagactattgtaggtgaccaaaaccttgtggtgctgaccctaagttaatacaaggctgtggctcagaccatattactccttgttgggccaacacctagccctcaggtcacatggcacctgtagtcagatctgaggttggcttgacgtggtctgctttcatgaccgttgaagcagcggtactttgcctggcaagcaagaatggcgggaagaatggtagcatctgcctatccttgaaacggattctatcttcggcgtgtgcagtgagatagtaaatagctttctttaatccgctcaaccgacttgtaatcctttcagccaatcaattttaaaggtctaatttttgtttctggtgctatgtggctagggctatgtcatgaaataaaataatgctttgcatacaaatttgttcatcacaaaatgaattgtgttatttttcaagtaccagaaaatatttctattcaccttttcatgtttcaaagaagacttatctgtcttttatcactggtactagatgatactcttgccctttatgtttggttggcagggttacattcatgctgaggagtttaatccaagagattggatcatcccttgcttggactatgatgagcgtgataacaaaaaaatttcctttctggcacccaatggtatgtacagccaaaggaaaatgtctattaaaagtaagaggattgcggattcagttgaggccttaattggggcttacctcagtactgctggggaaaaggcagcatttcttttgatgaaatcattagggatgaatatagaatttcacactgaaattccagttgaaaggaaaatttcaatgaaagctgaagagttcattaatgtgaggagcttagagggaatgcttggttacaagttcaatgattctttattattgctcgaagcattgacacatggctcatatcagacttctggccctacttcatgctatcaggttgatataaaagcatctatcatctctatttagtatgtgtcacggctttattatgccttttgatctttactcaacaaagtgcaaatgattaaacagtattgcaacaacattttttttctatgttagcaatcctctatatgtttcatttccttttgagtttaacttgctgtagaattatctgaaacctgaaaactgaaggactagcctcgctccttcagcgactcgggcggcgcttccagccgccggccctaccccacctccttccttcccaccccttgccgccgctggagctggctgccggaaaccgtgtggcggcgggcctcctttccttgggctctcgcacggacgatggatggcagctagatctaagcgtgacgttggttgctacggcagcggtgggacggctttggatggtagccaaagccggcagcgctaggagaggctgcaacagtggctggcaccggttaggcaggatgcggggcttctgggttggatccgccggaacgctgtggtgattgctcgagtgcagtcggcggagcggctgcatgggcgtttggcggtcgtcctagtcgcaaaagtgggccgcgtgggcggtggttgaggctgtgttcctggctattcaagttggcatcaacggcgaccgcagccctgccgtggtgagcgactggatctggtgcgtcctcgctaggggtagggatccgagccacggggcgtgctagcatccgagcagcgagaggactcctcccaaccgcttggacgttttggagctccttgtggtgcatggatggtggcaacagggtggaggtgcgaggtacgacaacgaccaaagctgggcatctgcgatgatcaagaagcagctgggtagtggtgacggcgtgtcttccgtttttgccggccaagcatcttcctcttcttggagctcctccccttctatggctggagactgtagttttggtcatggggagctttgattggagggtggaagttgtggctatcatcaggagatgtcgatggagtggccggaaacagggtagtcctatgagcatgcctgagctgtcgggctatggcatgggcatggttgctagagggatggtgtggtgatccggcgactgccgttgtgctgcggattggttgtgtgggctggatggagaatcaactggtgaaaaccttgtcgagccattggctggttgaatgacagcgtcacctttgggcactgttcccctccttggaggcgccgttatggtgtagttccacctagcccatactgatctccaggtgaaaaccttgcttcagcttacgccgagtggtggtggcgtttacacgtcacatcctccatgggtgcgctgctgctttggagaaccttcgtcatactgcggtgaccgttgatggcctcatgcatcggcttgaagctctgaaggcttaggatttttgatgaggcctttgcctttttgtctagcttcttttttatctgaatcaaacttctcaagtagctgttgttagtttgggatcttttttgagttgaatgacaagtttgtgtcccttgcagaggctcgagtttcttggagatgctattttggatcatcttttcactgaatattactacagcaaataccctgactgtactccagaattgttgacagatcttagatctgcctctgtgaacaacaattgttacgcgcatgcagctgttaaatcaggattaaacaagcatatccttcactcatcatcagaactgcataggaagatgagctactaccttgaggaatttgggcagtcatttacaggtccatcttatggctgggaagcgggcattggtctaccaaaggtgtgtattctctacggtgtaattggtgtaggtggctatattgcatatattctgaaagtctgatagcagagtttgtttctccttttctgcaaaagaaaatgcacctagctggtatggtaaaatttgatcagttaatttgtttgtcttttattttaaatcttattagtcattactcagtattcctaggtctaccattacctcggatacattatagtctatgccatatagtgatgacatcaaaatttaaccaggcatcagatccattatttctagtttggattaaagagttgctagagaatttataaaaagaactaaagatagtcttaactaggttccgatgcatagtgcatcacagcatgacgaccacaaaatgtctttagtctgactgtaaactggaataggagaattatatgtttggactaacctatttttgtgcacttctgtaatattttccatcgaatagcttaagctggatctattgctttacttgcaaacaaacaggttctcggggatgtgattgaatcaatagctggtgccatttatctcgacagcaagtgtgacaaggaggttgtttggagaagcatgaagcggctattggaacctcttgccacccccgaaaccatcgagcctgacccggtgaaagggctgcaagaattttgtgatcgtagatcattcaaaataacctacgaaaaaaaccatgttgatggagtctcatcggtcattgctcgggtgaaggctggagagactacatactccgcaacaaaatcaggtccctgcaagttggtggcgaaaaagttggcatcaaaggctgtgcttaaagatctgattgctggtcacaaagatacagaggctgctgcagtatagtgatacttaactatttaagcgtgcaacagtagctaacaattgatatagatagttgcgcacaatagaaaagttttggttggattcatacatgtaatttggaaatgctcctttttgtgtgctcgcaaacgatgcgtgtgaacggcctcatgaattctggtaggttttcatgcttcaaacttacaagtatcgcaattttgtaaattacaaatacgggcatagcacacctgcccatgccatgcagtagttttttttttcctcgaaatagtagcattagttgtatattactcatagcatcagattgtacagaaagcatgccagcaaaaacgaaaaaatgtacagacagcattttgttcgcatcaagggaaaacttgttttaagatgttctgtctgatgatgagcaagctgtttgtttgctagcgtctatagaatactgtgtaaattgtaaccaccccaaaatattgtataggttttgctccttgcttgcgttgtcgatcatataaggttcaatgcaagacggttgatttcactgaaaaggggtttcaaagatcaaaagaatagctaccaaaattgcatagctcataatctcgtcaacagttgatccagtgcaaggtaatttcgttctgattgcctttggcagttgctacacatcttatatgtttaatttatctttgcaaaaaggttacacctgcagagctgcagctacaaattgtacaatatatacaagcccaaaatgatgaaggtaaagggcagcttggctggctataccgttcgctatattgaattgtcctgtagaagaggcaatgaattttgggtgttagaacgaacgataacatgtctgacagaatgaatttttaattaaactgttccatacattggaagcatttgatgtggatgcgtcctcggagttccttgcttcagatttctcgttggagtaactgccaaacaagaaatgaagaactcttgttataagaaatgaagaactctttttatctttcgcgatttaatcaggctgccgtagtaataaagtgaaattgacatgtttgggcttacgttgacagtattgtaacccagattaactccacgcagtcaacccacagaagtctttgttcaacaggaactaggccatatgtaaccaagtgtgcaaaaggccacaacttccagccggcctataataataattgaaacccagcataaggtctctgttagcagtaaaacactgtaaaaaccgttttgaaattaagaaataattcagtgattatagaaagattatggatggaattattagaagggaaaattgaataattatttgaacattaaaaagttcaaaatttgaatgacttctcatagctttgttgtaattgtatactagtttaattcaataata

SEQ ID NO: 648 - DNA, 16536 bp, Oryza sativa
caagatttaggacctgcactggagttaagcagacctcctaggccagtgtgtgttttttgtatcaacacatgggcctcccagcgaagaggccaagggtggaaggagaaaaatcaggtgcgggagccgtgtcctcaagccacgacgtcgcccaacgcgtcccctagctccgtggctcgacgaaaagcgactgaggagcggaggaagacacgcccctctgctagggacggcaaactgatgggctggcgacggctgtgagcagggacacactcgagagtacgcattggtgatggcctaaggagcccaaatcctagaaaacaaaccaccattgaacttttttattgaaagagcaatgcacatggaattgtcgagattttattacctgcaatgagggggtgtttgaatccagggactagactttaaactttagtctctgtcacattggatgtttggacactaatttagagtattaaacacagactacgtacagaactaattacataaatgagagctaattcacgtgacaattttttaagcctaattaatccataattagcacattgttactatagcatcacataggctaatcaatgattaattatattcaaaagattcatctcgcgaattaatacagagttataaaatgtgttttatcaatagtctacgtttaattattttaatttgtatcaaacatccgatgtgacatgtgacatgatatctaaaaattatttaatccattgcaaaagccaaaacccaaaaggacgtcaccgccccccgaccttccacatacccccagtaccccacctgtgattccctcccctccatctgacgccaaacggccgcgcccattcccccgcggtcccggtcgcctctcctcgggtcctcgtcaactcaaaaggcgcactcgaacgaaccggcgggggcgaatccttcgccccgaagcctctcctcgggtcctcgtcaactcaaaaggcgcactcgaacgaaccggcgggggcgaatccttcgccccgaagcctcccactaccaattggtcccatccctcctcctcccgcttcccccccataagatcatttatctctcgtcattgttcgagcccaacacgcgcgcgcgcgactcgtaggaattcggttcggattcgtgcgtgcaccgaaggaggcggaggcggaggcggcccaagcgtcggcgccacctcactctcccacccccatcccgccgcctcccccgattcctcccccaaacccctcctcctcctccgccgccgctgccgtcgccatgggtggccccctcaccgccgccggaggtcgaggagatgggggcgccaaggcggtggaaccgctccggcctccgccgccgcccgacccgaagacaatggccagatggtgaggcccggggggtgtccagtgcgcgcctgacggatcgcgattcgccgtcctcccctcccctttggatgctaatggtggtggtgggggtttgtgattgcgcgtggcgtgcaggtaccagctggaggcgctggagcgggcggtgcgggggaacaccctggcgttcctggagaccgggagcgggaagacgctcatcgcggtgatgctgctccgggcgtacgcgcaccgcgtgcggaggccggactcgcgccgcttcgccgtcttcctcgtccccaccgtcgtcctcgtgggccagcaggcgcgcgtcgtcgagcagcacaccgacctcgtcgtcaagcagttctgcggcgagatgggggtcgacttctgggacgccgccacctggcgatcccaactggaggacggcgaggtgctcgtcatgacgccgcagatcctgctcgacaacctccgccacagcttcttccgcctccaggacatcgcgctgctcatcttcgacgagtgtcaccacgccaggggcaatacaccgtacgcctgcattttcaaggtacaaaagtttacacccgccgccgtattgcgccctttcgtattttcccttcacatttattgatcgggtggggttagtagtggagtagctctcattttctattttcgtctcatcaacataggaacacctatgctctaacttacatactagtgccaatataattggaacatgcagcgttggttttgccacatttactatttcagtcagaatctttgatgtctcccttcccctgctgatctgtatcaccaatttagacaaatcattcgacgcttgcaggaattttatcacccccagttgaattctagtgcgtcagaccctctgccaaggatatttgggatgtctgcttcgctcatttattcaaaaggtaagggcgaaacgatcatcccttatgttttatgcacaggctctctgatcatctaatctgtcacactgttccttctatagatttgaatcagcacaattattcaaagcaaatttctgagattgagaatctcatgaattccaaggtcaggccatgtaattttcagttaattacgtgatccctgcagttacgataatcattcttcctaatttagttacctgtatgtgtctttgggaaataagcattgatgcatttgttgttcaaggtgtacactgttgatagtgaatcagctttgtcggagtacataccatttgcttctacaaaaatagtgcactttgacgattccaacatttcatctgagctgcatgccaatattctcagttgtttgaatagattgacaaaaaaggtactatcattcttctacattttgtttgcccttttggtaaacagtgctttctattgttcagttacatgttgcttgccgacaagttgcttactgtactgcatgaagttgagtggtaagactaggcatggcggccaatttggggtaagatacaagggagaggttggcactttcggcatgcctacagaagggaacagagattgagttggggagaagtgttagaaacttagaataaatgtgaaatgagaggaagcctagtaagggtctattctggagagctcccaactcctatgttgttgcagaatatagttttgtaggctaaaacaaagtggtttaagtacctacttttagtccaaaatgtaaagaagatgactcacctaaacactcctgtctacctacttttaggttccagcttcaagaattttgaagcataatatgctgagctggattgagctccaactcttgtatttttgtaaatatggagttcttaggctaaaataaattggtctatgctgaaatgtaaactagatggcgcaccaacaccccagtctaccgctagcttgacctctaacaattttatagccaggatgctctgaagctctgccaaacaggcccagatagccaaatgatatcccctgcatgccaaaacgtgggacctatcaatggcatctttcagaatataaatgaagaataaaaaagttagggtttattacagtagcacagccagtgttctacagaagtatgtgaactctaaaatgcggtttaggtcaaaaagacagtttttagtgatgatttatcagtctcagagactgttaagcctgttgttagacttctttttttagttagagcatgtgccagacctttagtattgcatgccatggacctgttattcatggcttcttgtgcttgggctgaatatgacattcaatattttaagcaggaggtttttttttattgagatgcattgacattctttttgtaatgctttaagtaacttcttttaacaaatcctgtgtatatatgttaccagataccaatgcaattttgtttcattctcttagcatatagaagctctggacagaaaactacatggttcatctctggaaaacgctaagcaaaggatatcaaaattgcatcgtacatttgtatattgtttatataatctaggagtatggctggcagcaaaggtatgaataaagatttcactgcacatttatagtactttctggaatcccaatttatctttaacattgtattttcaggctgctgaggtacaatcatacgaggaaaacagcctatccttctggggtgaaacattggataaaaatgttgagggcttcattagaaactacagcgaagaagtacatagagaactttcatgtttcttgaagaatggtacatactacacagctctggcttttacaaacataccttctctagcatgttgcgctttttatgttcttttcttggttacctgcatgacagcatttgctttctggaattctcaattaccaaataaaatgttgtctagtctgttgtctgcatgaattgctatctggatactagaaaaatgtttataatttcacttatgaatactatgatatttttaacataatttcacttatgatacatgccatactaactgaatattaaaccatagatggcatccacttgccgaaattccaatttataggtcataccatgtttatttgattctttgcttttttttttcaggtcatattggtgaaaaatttccagctgattcgcaagatgggatattgacacccaaagttcattgccttattcgaactcttctgcagtacaggtgctaaaatactcttctgatattttcttttgataatatttcacagccacatcctttgagattgcattcatttggctattcttatagtagtattggtaatatttctcattctctccctttgagactgcatcgactaaatggtaccaaaggttctgtatagggtggacgatagtggtgtattctttcattcttttttaatcaacttttgaattttgtctgctgtgagttaatatcaagtgatatgcatggttttacataatcagaaaataggaaaaatcatggatgaccagtacagagaaagagccattagcttctacaatatgcatgtgccttttgtacatgccccatggattacatttgaaaatctgaataaaaaaataaagaagagttcccaagaaaaaaagtttattttttctgggagaactagcatatttgcccatctcttgtaacaaatctcagataaacacgcataagttggcttactcaaatgccaaaaaaaaatcctcacatttaaaatatttaacttggatcaactgacaaccacatacatatgaacagaattaaatcatctatttattggttcaatagaagtacaaatgagtaaaatgacacacgtctatgctgattgtttcaccaaaggttgattgaaggattgggggtgtagagcacaacccatcaccaccaactcatataagtagtacagaaatgatacattccagtaccactattattttcctgctgcatacagttttttcttgaatttcaccttctacttccattccctattactggcttttataggttagttcttagatggatattgaagtgtaagtaagttccatggaatagataatcacataccagccagtgtgaaaaatgtgttctaaagttttttttttagataatggaagctttattaatctcagtaaattctatcaagtgatacaattattctgagagcacctctggcttctgcacccaaagagtgcacacagccaacaagaaagaaacaaaacataaactcatcatccaaaatagcagggacaaaaagaacttcaggagccctctaaccgtagcctagaacgccacccatgcgccggggtagaaaactccatggccactagctccaagtgttgacaagccgcaatgatagtaccccgcaaattgaccttctgaaggatagcccatgagcagagccaatgtgtaataaaaaagataacctgcaaaggggaagatatgtttttcctttcaaaaaccacatcatttctgcaaagccaaatagaccaaatagtggtagttgcccctaataagaccaaagatctcaaattgtgtggttgtcttcttatccaatgcccaaacatatgagttgtactattaggtaaactaatattcgaagcaaactggattaaagaccaaaccgcgcgggcaaaacgacattcaataagtaacttggtgattgtaagagatgcttatgcttctactttcttgtactaaaactttttgttcttttgatcattcaataagtaacacctctctctctctctctctctctcaggcatatgcaagacttaagatgcattgtgtttgttcagagagttatcacaagcatagtattagagcccctactttcatctattcatcaaatgtctgggtggaatgttaagcacatggcaggaagccgtcctggtttgctatctcagagcaggaaaaatcatacagaaattgttgaatcttttcgaaaaggaaaggttcgatattggtacttgtattttatgctataggcattctgttaagtatgctataggcattctgttaagtcatagtatgatagttctctgatgagagaatgatggttatgcaggtacatataattattgccacacaaattttggaggagggtttagatgtgccaagttgtaacttggtaattcgctttgatccatcagcaacagtatgcagctttatacagtcccgtggtcgagctaggatggaaaactctgactatcttttacttgtcggaaggcacgttttcaattttgttgctttgtttgttctctgtgcaaatttgttaactgttccatctttagtgaattgtttgtgtcttccatggactctgttcactgttttcacatttcatcaaaagagttgcatgcactggataaaaaaaaaaatccctggttagtgccaggaaattgttagtggttacctatattagtgattgcttttcccatttcatcagttggtttttgtagtgaatcaaatcatccatagtggcactaaatattaacgttgactcttaaatccaagctggattatactagggagtaatagcagtttataaagcttttttttattataaaattgacttatggttcctgatggtattttccagaaccagaggtaactggtgtatcatcctggtaataagtttcaactgaaataattgtttgaatttttagtatggaactgccaaaattctcttggatggtggacctggtcagatcctatgactattgtaggcacttgctgtggatttatccgtcatctttctgattttagatgacacgataacctccttttgttgtcatcgttacttgacctattttgcattttattactgtgcattatacacgtttctgcatcaggggggatgtggaagctcatactaatgcaaagaagtttctcgcaagtgggcaaataatgcgggaggaatctctgagattgggatcaatttcttgtcaaccacttgagaacaccttgtgcgaggatacctattaccgtgtcgagtcaactccagcgttcgatatagacaaggcatctggcacatgcactctgcatcttcctaagagcagtcctgtgcagacagttaatgtagaaggagaaggttctattctcaaggagacagtttgtcttaaggcctgccaagaactacatgccattggtgcactcacagattctcttttaccagaattagatgttccatgtgatgaagaacctgacatcggtatggttattcagctaagcagtttaattcaatttgttccagttgttgcaatttatatattttattccaattgattattcagggagcagtttattgtgcgagttatgataatgcagtaacacataagtaaaagtattttacacgtgctatcaaaattttaaactcaatttacactttgcaagtaattatttaccatgtgttttaaggaaaacttgatgcatggtgggtaaggttatatctgaaggtacaataggaaatgtgtttcgtgcattactgatttatacttgatagttttcatggacttgataatttactggtctagtggatacatacatgtcatgatgcctgtcccaaaacgaacgtagtttgttcaaatttacctattttgtttgctaaatttgatatcttcactaatcttgaaagtaaaagatctgtcgtaatttttgaagttggcttttaagtgtgatatatattggggctttgcactaatgttgccttaatgtttctcatatagttgttgagaacaaaattgagcagccttcttactttccagaagaatttgtggataattggcgctccttttctcgtcttggcatatattattgctataagatctcattggaaggatgtcccaaaacagcttctccaactgacatactgttagctttgaagtgtgatttgggatctgactttacttctagctcatttaaattgccaggtgggcaagacaatgctagtgttaccatgaaatatgttggcatcatccatctcaatcaagaacaggtaaattgtcaatttatgttctctaattctttgataactaggctattgttgtttagaccatttcattgagaatatataacttttgtttgtccaggtaattattgctagaagatttcagacaactattctttcgtttcttattggtgatgaccatttggaggttagcaatggtattaaatacttccatgagatgcaagtgcctattggagtagtctatctacttctgcctttagtttctggcagaattgattggtgcagtatgaagttctcatcctcaccaatatatgaagctaacaacaaacatatgacacattgccattcttgtagagatattgatttactgcagacaaaagatggtcctttctgcaggtgcatccttaaaaattccattgtgtgtacccctcataataacatcttttatgttattagtgggtttcttgacttagatgcaaattcccgtttgcctcaacatgatgggactgttgttacctacaaagattattttaagactaggtatatgttttccctttcggtattacttcatgtttatgtatcatacatgctcctgtaagctatgaatgcacacatctacttgtttcctgtgtttctcaggcatggtcttactttgacttttgaaaatcagccgctcttggctggcagtaaacatgtgaaagtgcggaacttcctccacaactactactataaaaaagaaaaaggtttttttttctctggttgcagtaatattacataatgttttctccagctatcctccgttttgactacatgtgttgactcaattatctgtaataaaaccctcgaagttactaagttggaaattatgcagaacatttataaacatgattagataatgaattttaatatttgttgatgacaaaatttttaggtgttttagtttctacgagttacagacccttctgaactttctgtacatctaattgaattcttaaatatgtagcccaaaatgtaaactcttgcttgacattgaatttaaaattttccaatatttgaatgtaaagttttccaaatttaatatcctcagctgaatatggtatatgttttagcgctacttttatgaaatttagatttcattctactgtgagtacttactatgagagtgtacatcataccaataagctcttctgatataaatattggcactgcagattgttttaattgtagacatattttttgctactattaaattttcctttttctagtttaataaccttttggagtactttttaaatatattttgcttctctatcatcttttccttaatccttctttatttggccagacactatattcgttttcaggagcagtaaatttacttttcatattactatcaaaattgtagtatattagcacagaatgatgggttgcttgtagcttagcttctataaaattaggcagtgaggtatttgggacttggaagattacatttgacataccctgaggtcatgttcaatcggacagttaaatcccacacatattgctgggcttgatcatacatgtgtattttgcatcgctatcaatgaggcatgttacagtgggttatagctgaactcttagacaatggtccaactaatgtactgcctgtactatctttacagagctacatatgcataaatcactgatttggtcatcttttttccttgtttcagaacctggtgatagatatagtgttgagttgccacctgaactctgcagaattatcatgtcaccagtgtccgccaataatttgcacatcttctcatatgttccttccataatgttccgcatccagtgcatgcttctttctgtgaaattaaaggtccaattaggcccaacagtgcagcagtttgacgtaccggttttgaaggttgattttctcatcaatagtttcctatttatgaattattgaagtacctagatcaactagatgtcgtcatataagaaaactcatatttcccttattttttgaagaatttaaaataaaaatggatataagtgcattcttgggcacaccagtaggtgttgtaggaagagtgatgacatttgacagtgaaaactaaaggttctgatttttttagttgtttaatgcagcaacagtgccttagtaagaatatgttcagcacttcgaagtgactatctattaatgaggcaaacataagttttggttccttctacttgcaaacatgacaggtcttaagtcatgtataatgcaagatatttcggggacacttagcaaagaaataattccttttgttgccatgtagaagttggttatttttgtagcaattgatgaggcagtggtacttaataacttcttatgcatataaataccttcaattaatgcgtaatgtaactatataagcacatacaaaaagctgtctgcattattcattaacactccaatggaggtgcttgatggtgtgttgtactctatagaaccatgtatggattgatggtcctatattgtaaaaataagatataagaatatttgaatccgtggagtattttatggttctaattaatattttggatgccccactgttaacaatgtacatgtcaatctgaattttcttacttgttacctgaataaattacttcccctatgcatatttcttacatgtgtatttctctgcatttttttcatgagttgcagatcctggaagcattaacaacaaagaaatgccaagaagaattttcacaggaatcattagaaacacttggggattctttcctcaaatatgttacaactcggcacctttttagtgaatacaggcttcaacatgaaggcatattaacaaaaatgaagaaaaacttgatctccaatgcagctctgtgccagctggcctgcagcagtaatcttgtggtactctagatcctgttgctaactgtatttttcttattgagctaggcatgtagaaattttttttatcgaacacgcaggacagctgcatatcattgcgttaaagaagggtaaaaggaccttagaaacacacacctacacactacagaactgattacatgcacatccttgctaattttatgcaatattaatagtcctacatctcccagtatctttcataccatgtcagcctatttcaattcttttgtgcaactgctatatcacaattaggcaatgttccacatatttcctttttaggaaaatgggaactctattgttgcattgaattgtttgccaagttgccaatatagactattgtaggtgaccaaaaccttgtggtgctgaccctaagttaatacaaggctgtggctcagaccatattactccttgttgggccaacacctagccctcaggtcacatggcacctgtagtcagatctgaggttggcttgacgtggtctgctttcatgaccgttgaagcagcggtactttgcctggcaagcaagaatggcgggaagaatggtagcatctgcctatccttgaaacggattctatcttcggcgtgtgcagtgagatagtaaatagctttctttaatccgctcaaccgacttgtaatcctttcagccaatcaattttaaaggtctaatttttgtttctggtgctatgtggctagggctatgtcatgaaataaaataatgctttgcatacaaatttgttcatcacaaaatgaattgtgttatttttcaagtaccataaaatatttctattcaccttttcatgtttcaaagaagacttatctgtcttttatcactggtactagatgatactcttgccctttatgtttggttggcagggttacattcatgctgaggagtttaatccaagagattggatcatcccttgcttggactatgatgagcgtggtaacaaaaaaatttcctttctggcacccaatggtatgtacagccaaaggaaaatgtctattaaaagtaagaggattgcggattcagttgaggccttaattggggcttacctcagtactgctggggaaaaggcagcatttcttttgatgaaatcattagggatgaatatagaatttcacactgaaattccagttgaaaggaaaatttcaatgaaagctgaagagttcattgatgtgaggagcttagagggaatgcttggttacaagttcaatgattctttattattgctcgaagcattgacacatggctcatatcagacttctggccctacttcatgctatcaggttgatataaaagcatctatcatctctatttagtatgtgtcacggctttattatgccttttgatctttactcaacaaagtgcaaatgattaaacagtattgcaacaacattttttttctatgttagcaatcctctatatgtttcatttccttttgagtttaacttgctgtagaattatctgaaacctgaaaactgaaggactagcctcgctccttcagcgactcgggcggcgcttccagccgccggccctaccccacctccttccttcccaccccttgccgccgctggagctggctgccggaaaccgtgtggcggcgggcctcctttccttgggctctcgcacggacgatggatggcagctagatctaagcgtgacgttggttgctacggcagcggtgggacggctttggatggtagccaaagccggcagcgctaggagaggctgcaacagtggctggcaccggttaggcaggatgcggggcttctgggttggatccgccggaacgctgtggtgattgctcgagtgcagtcggcagagcagctgcatgggcgtttggcggtcgtcctagtcgcaaaagtgggccgcgtgggcggtggttgaggctgtgttcctggctattcaagttggcatcaacggcgaccgcagccctgccgcggtgagcgactggatctggtgcgtcctcgctaggggtagggatccgagccacggggcgtgctagcatccgagcagcgagaggactcctcccaaccgcttggacgttttggagctccttgtggtgcatggatggtggcaacagggtggaggtgcgaggtacgacaacgaccaaagctgggcatctgcgatgatcaagaagcagctgggtagtggtgacggcgtgtcttccatttttgccggccaagcatcttcctcttcttggagctcctccccttctatggctggagactgtagttttggtcatggggagctttgattggagggtggaagttgtggctatcatcaggagatgtcgatggcgtggccggaaacggggtagtcctatgagcatgcctgagctgtcgggctatggcatgggcatggttgctagagggatggtgtggtgatccggcgactgccattgtgctgcggattggttgtgtgggctggatggagaatcaactggtgaaaaccttgttgagccattggctggttgaatgacagcgtcgcctttgggcactgttcccctccttggaggcgccgttatggtgtagttccacctagcccatactgatctccaggtgaaaaccttgcttcagcttacgccgagtggtggtggcgtttacacgtcacatcctccatgggtgcgctgctgctttggagaaccttcctcatactgcggtgaccgttgatggcctcatgcatcggcttgaagctctgaaggcttaggatttttgatgaggcctttgcctttttgtctagcttcttttttatctgaatcaaacttctcaagtagctgttgttagtttgggatcttttttgagttgaatgacaagtttgtgtcccttgcagaggctcgagtttcttggagatgctattttggatcatcttttcactgaatattactacagcaaataccctgactgtactccagaattgttgacagatcttagatctgcctctgtgaacaacaattgttacgcgcatgcagctgttaaatcaggattaaacaagcatatccttcactcatcatcagaactgcataggaagatgagctactaccttgggcagtcatttacaggtccatcttatggctgggaagcgggcattggtctaccaaaggtgtgtattctctacggtgtaattggtgtaggtggctatattgcatatattctgaaagtctgatagcagagtttgtttctctttttctgcaaaagaaaatgcacctagctggtatggtaaaatttgatcagttaatttgtttgtcttttattttaaatcttattagtcattactcagtattcctaggtctctaccattacctcggatacattatagtctatgccatatagtgatgacatcaaaatttaaccaggcatcagatccattatttctagtttggattaaagagttgctagagaatttataaaaagaactaaagatagtcttaactaggttccgatgcatagtgcatcacagcatgacgaccacaaaatgtctttagtctgactgtaaactggaataggagaattatatgtttggactaacctatttttgtgcacttctgtaatattttccatcgaatagcttaagctggatctattgctttacttgcaaacaaacaggttctcggggatgtgattgaatcaatagctggtgcaatttatctcgacagcaagtgtgacaaggaggttgtttggagaagcatgaagcggctattggaacctcttgccacccccgaaaccatcgagcctgacccggtgaaagggctgcaagaattttgtgatcgtagatcattcaaaataacctacgaaaaaaaccatgttgatggagtctcatcggtcattgctcgggtgaaggctggagagactacatactccgcaacaaaatcaggtccctgcaagttggcgaaaaagttggcatcaaaggctgtgcttaaagatctgattgctggtcacaaagatacagaggctgctgcagtatagtgatgcttaactatttaagcgtgcaacagtagctaacaattgatatagatagttgcgcacaatagaaaagttttggttggattcatacatgtaatttggaaatgctcctttttgtgtgctcgcaaacgatgcgtgtgaacggcctcatgaattctggtaggttttcatgcttcaaacttacaagtatcgcaattttgtaaattacaaatacgggcatagcacacctgcccatgccatgcagtagtttttttttcctcgaaatagtagcattagttgtatattactcatagcatcagattgtacagaaagcatgccagcaaaaacgaaaaaatgtacagacagcattttgttcgcatcaagggaaaacttgttttaagatgttctgtctgatgatgagcaagctgtttgtttgctagcgtctatagaatactgtgtaaattgtaaccaccccaaaatattgtataggttttgctccttgcttgcgttgtcgatcatataaggttcaatgcaagacggttgatttcactgaaaaggggtttcaaagatcaaaagaatagctaccaaaattgcatagctcataatctcgtcaacagttgatccagtgcaaggtaatttcgttctgattgcctttggcagttgctacacatcttatatgtttaatatatctttgcaaaaaggttacacctgcagagctgcagctacaaattgtacaatatatacaagcccaaaatgatgaaggtaaagggcagcttggctggctataccgttcgctatattgaattgtcctgtagaagaggcaatgaattttgggtgttagaacgaacgataacatgtctgacagaatgaatttttaattaaactgttccatacattggaagcatttgatgtggatgcgtcctcggagttccttgcttcagatttctcgttggagtaactgccaaacaagaaatgaagaactcttgttataagaaatgaagaactctttttatctttcgcgatttaatcaggctgccgtagtaataaagtgaaattgacatgtttgggcttacgttgacagtattgtaacccagattaactccacgcagtcaacccacagaagtctttgttcaacaggaactaggccatatgtaaccaagtgtgcaaaaggccacaacttccagccggcctataataataattgaaacccagcataaggtctctgttagcagtaaaacactgtaaaaaccgttttgaaattaagaaataattcagtgattatagaaagattatggatggaattattagaagggaaaattgaataattatttgaacattaaaaagttcaaaatttgaatgacttctcatagctttgttgtaattttatactagtttaattcaa

SEQ ID NO: 649 - DNA, 5015 bp, Oryza sativa
tttctctagcctactgttacttgctctcatagcagccatgttagcttcattctcagctgccacaagcctcaattgtgccacttcattcattgctacccctaattctaggcaccgctcttctacctttggcctcagttcttcaacacaacgttgcagctcattcttctcccttcttagcgataacacggcttcacgaagatcgttcaacagctccctcaaaaaactgcttgttgcgggctcataccagtcaaaaaaatcgcagccggcgccctgaaaacattacatcccaaatcacccaaccatactgccagctcaaacaaaaaaacaagcaagcaaacgaaatctgaatcactcacccgattgcggcatcggtagtaccgtcgaccagggttgtccacgctctaggaaatccaccgcaccgccttcgcaccacaccggcacatcaccgccagctgataatcatagggcccaactcgcgccgggatgggagcacgactgctgggatgcgacgaccccgacgaccggtcactgcaataactcgccatcacctagcctcacctcctcttgtcgcccccgccgccaccgccgcttccgccgccctaagctagggtttcagctcgagaagaggaaaatgtcgcgccaacgcctggaaacggcgaggacagagcctttaaccccgtctattaactccccaacggcggactgaccagtgggtcccacagcgcgacacgtcagcaaaaccgggcaaaaactgagtcaatactgccggtattctagtttagtgaccttaaaaaatctcggtgtcaatttgagggacctccggtgaacttattccgttcggtcggtcccaccaaaccgcctcacagtcacaacgtctaattccggcccaaaccgttcacgttcacactcacgacgtcgcttcgcctcctcctccttccgtttccgttccgttccatttcccgttcacaccctccgtttttccattacaaaggcgacacgaggctttcttcccccaaatctcacgcggcgctttctctctctcccgcgagatggacgccgcggcggcgtcctcctcctcctcctcgtcggcgacgatggcggcggcggcggcgtcggccgcggaggcgtcgttgtccggctcgcctgcttcttcgaggaacgctcgccatcggcagcgtaagggggtccggctccggatgctgcgacggcgggggcggcagcctgtggaggccgagcgcgccccgggcgatgggggcggtggcgccgtgcaggaggatctcgcgctgcctctcggaatgtccttcgccgccgtcctcgcgcaggtgcgtcatggcgggtggatttccttataggcaaaccctgaagaaagtagtagtactagtacttttttcttccttggcgctgttcgtgatcctctctgcgatgttcgtgccatcaaatgtactagcatattgcgtgtagattctgttgctagcgtctcacgaacacggtaatctgagaggttgcgtgctctggatggtagcttagaatgggaaatggaacgttagacgcggcagcttggggccgaggaaattctttgtgctatacttccctcaatggaaatgtcattgagccaaaataaaaaaaagtcattttagttcacagctatatgctcagatttttcacaaataaggggaaaaactaggatgcaaaatgatgagaacaaggaatgattatgaataagacagcagagaaattgggcttgacaatgttgtggctttatgggttatgcaagccttgtacttttgtcaaataagtagtgtggcatttaccgtcttattgcaaaattcaacttcattgctactattattcttcatttccatacttatagtggacatgaaattaaatagtcatttcgataatactaccccgtcatcctgtcattggacattaaattagtcacagttcagcatctcttcatccgaaagcttgcactatagcagcattttgaacacagatgcatatgcatgtgcaaagtctatctaatattcacctgcgtacatctggacatttgcattagtaattataaataaacatgtttgtacaccggtttagccctatgcccttattgttcaggtaacaaggagctgctttcgttgaccgcaggttataaatacaaagaatatttcaggacaaagattacatcctgatttcctctccaaggtacgtgctttctaatttgatttatgaactctgttatccataaacccacaaattgatggtctgaaattgggtttgagtgtagatctgtacatcagcagtcaaggaatctctgacaaatgtaagcccggctaccactattattcagttctcattgtctcttagtattcattgtaatatcctttaattatcgtttctgtagatatatggtgacagttccaacagtttcatcaaaaatttcgaaaaatctttcagcagcacttttaggacgcttcatcttgttaatgaaatacctgtgaatgagagaagtcatattcctgaatgttcttttaaacatgatgattctgtggctgtggacagcttgagctcatctgatttgcaaaatcagacaaacagaatagagcatgaccttgtgaacacagtggaaagtcaactagttctctttgccagtgacaatcagcagttaacgcatcttcggcatagcagatcctctcctgaagctgataatcgcattcttaatgccattgatcgctcgaacgaactcaaggaatttgaaatagggcttaccatgagaaagttgcaactcaaacagtcacagttagctcttagttcccattcacacatgttagagaagattaagctatctttcggatttcagaaagcttccttcaaaggagagaaattcaagactcgcatgcaggagacaagagacgcagaaatccttaggacgctaatagattttcttgttagtgctgtgatagttatgtcagcgtgctttggatatggaacttatatttattcgtatcaaaggataacggatgttacgtcagcttgttctgccacatcaaaggtatgtttatgtagtacatctgttatcactgagtagttttcacttatcgtgtctctttagtaatcggaagctgtttttttcccaccctgtctctttcagggatctaagtcatggtggatgccaaattcagtgtcgaacttcagttctgggtttctttttctcaggtgtcatgtaattgccgtaacacgtatgtgctttggcatactaatgatcctggcaattgcttggttagcatttcagcgttcctcaactactgggtcaaatatgcctataacattcaatctcattttgctgggaattatctgcggctttgctggaaggttttgtaccaatacactaggtggcgatggaaacacttggctcatgtactgggaggttctttgttctatccacttacttggaaatctttttccatctcttttataccacgttctacatggacctatttcagtatctcacagagagcaagttgtctggttaccatactgggttcgccggtgcttgttttatgctgcggtggggcttattcttccagccttgactggcttgctcccgtttgcctctctttctgactggaaggatcattttgtggaagagataaaatccattgttatcggtgacaagattgaagcatgaaatttcttggatgtaaggtggcgcaatacttgtcctgttgtatcttttgaagaagtgaagtttgttcagtttgagattagcctcagagtttagcttggtattgtatgaactccaaaggagattatgctcaagttggttgcacgtagactgacctgttagctgccagcctgccactttgttgtagttggagtgttattttaaacttttttctagttttattcttactttgttgtaaatactcaatagcaagagatgctgtttatctttgttgattgattgttccacctggacatgaggacaatgagtgcagtacaagaccctccaaacggattgagatccagtgcagttgttactattacttcaactttagcagatggatcaaaaaccagcggctcaggtcatcagaaaaatactgttcacgaattactgtacgaagtagcaaatttctcctgtagcgtttactgttcacgaattactgtacgaagtagcaaatttctcctgcagcgtctagtgtgcggtagggtgggagagcaaatccaagctggtggctgcattgatccaacggttataatgtgctctcactgctaaagttaccgtcgttattatgactgcattggatctcaattccctccaaacgtccatgcccagtggcggatccatgtataatttgtagggttggctgattccacggctttttaaaaaacaaccctataaaacttgattttcatgtataaataaaaataataaagaaaggggtttgttggaaccatgccactctatatttgtaaaatttgagatatgccactcgtatctcaatgacatgtaagacccacatgagtcaatgacatgtgggtcagggtgacatatcacaaattttacaaaatttgtgtgacatggttcaaattgtcccataaagaagaaatgaccccacttaaatacaaatcactccccataaagaaataaccccacttaaatacaaataactagtaattgatctcataggtttatatttctggctccaccattgtccatgccagtgatatcacgcacccaaggctcaacccttgagcaaccttgagctcagatacattgttagaaaaatttgcggtcggtacatatacgaacacgagaacaaccgcaaattctatgctgcaattcagcagtttctctatcttggattgaatgaactatgcacagatatgctaaaaacaaatgagagtaatttgtcctagtgccataaactgccaaattaaccattgacaatttctggaactatggtgatggaagtatgatttacaacattctaaaaccagggtctacttttctcaca

SEQ ID NO: 650 - DNA, 3892 bp, Oryza sativa
aaaagtaaaggagaaaccgtacataatttgaaagaaagagaaagtcagaaaaccacataattatgcatggctctcgctgcaacttggtccgtgacccacacgagtcctattaaaaaaaaatcaaaacagcagtagttgagcttatttaaaaggggagattttcttttccttttcatttcgagtccacatacgtttggaggcacagaaaaaggaaaaaaaagaaaagaaaaacaaaaagtcagaacatctgcacttgatttcttattcacgcaactccattaaagtctaaccattgacttttttcccctgcccgctcttacacggcacgtctcattcaaatatgaactctcgcacagtgaggaatcccaaattgagaaggaaaaaaaatgaaaacaaatttctttttcctctgacttgtagctctacaactacgcgtcgttttctttattatttattcgtgtataaaaacttttcctttcttaattcttgccaaaaaaaaaaaactggtcacgaataatcgtctcctaaaaaaaaaaagtctctagtctcagcgcgataattctcccgcgaactgcgcactgaccccgcgtgaccaattgacatgtcggccacccaacaagtgggcccacctgtcagtgactgtgggatcagggagcgtctggttcgctcggtacgcgtagcgcgatgcggtcgcttgtctcgtagttggaaccaactagcccccgtgaccccacaacgcgtcggattctgattgggcgagacccacctcgtggccactgttgcatggtcaactttcccacccatccgagccgtccatcccatccaacggcgcgtacggatccaccgcctgacgccggtggcgccggtcgacgatccatcccgaccgtccgatcgggctcgcgcgttgactataaccggtccacgccgtgaccgccaccggctgctcccggtgaccgcgtcgcgtcgttttataaccccgactacgttagcctcctcccacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggtaaaaatcttcacgactccctccatttcccccacctcgaattgaactcatcggaattaattttccaggaagcatcgggtgaagaggacgatccgcgtgccggcgataagctcgaaggtggcggacatccccgccgacgacttctcgtggcggaagtacgggcagaagcccatcaagggctcccccttcccacggtgagcaccgcactgccccgccgtctctcctcactccgtcgacattaacactcaaaactaatcgtaatcccctcatttttgcagaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattatttttttcgtttttctctctttttttttcttttttttactgcatcattgtagaactagcgtgtaaaacaattttaggagactttgagactgagcttttactgaagaaaaaataaagcagaacaaaaaaaaaagagaagaaggcgatcgagactatcagtagagtagagagtagaaaaaggcgtgccggaattgaagattttgaccgcgcatgcgaatttgtttatcaactcgggttcaatcccgcggattggggtccggtggaggtcaaaaggaggtggggcccggggtgttgaacgttgccccccgcccacggtcctcgtgcggggcccacgcgacagtgacggggagggtccctcgtgtgtgtaagtgtggacgacgcggtcaaagaacgcggcgtggggtggggcccaccacggccttggcctccggcgtccgcctcgcccgcgctgccaacgttgactcgtgtcagccaggctggaatcggattcgctacgcctctctgtctcactctctctctctgtgtttcgtatcatttcgaatgggacattcgagttcgatatcttgatgcgctgtttggagaaagttttataatagaggaaattatcaactttaattaagtatgataatacaaactgatattataatatggagtataaacgcatacgttcacaatgtctcacatctatgattactcacgcacaccctacccttacatatccagaagactttggtgatatattttatattgatgaaatcatcgtagacgtctgatcgtcaaccggtgcattgctaacataaaaactaattaccataaatatgaatacctataataagtgtagaaattgaaattaggtggactggttccatcacaagaaaatctaaccagttgacccatgctataagaaaatatgtatataaagttcttttaaaaaatacatttggatggtttaggaagtgttctcaccataaacaaccgagttaggaagatttaaacgtaattacactacaattattttatatttatatttgataaattttatgaagaaaaattgtcatcaaatgtattgaaaatttgatggggattatgtattggggtgttgctgtttgtttatacctgtaggaccatgatgtgttacatgaaggattgtcaatatcccgatcctgactatcttggttacatccctactacgtttaatgaatggagtagatcggatcggaaaaaaaaacctcaatcattgtctagggaagtagggattatattattagtatactactcccttcattccaaattgatctatatatagtttttttaaggttatttttaaatgatctacgacatatttatgttcatttattaagtctattcgttatttgtgcattggagtaaatggacattaatgcatgcatccatgcatataagtatttataacccacatgcaatatcttgatttgctattggttaggaaatagtatggatggtgtatgcattgagtttgttgctaaagtaaatatagtataagggcacctacaatggttatctatagactctctacaagagatccatgtcagcatattttcctactggaaagagattaaatgaagagagagagcaa

SEQ ID NO: 651 - DNA, 8944 bp, Oryza sativa
aaacattttaaagaattacaataatgacttatgattttatcaaaaggccggttgcaaattgggctcatcgtgtacgggtaaaattactgttttttttccttttaataaagccatttgctactgttgtagttatgtgaaataccaaacaagttgtagtgaagcaatagtttcgatcaaataactactctcccatcttcattcatgtctccaataagtttattttcgactaatcattgtaccgaagtttatgaaattagaagataatccctccgtactcataaaaaaagtcgtttaggacaatatttaaatcaaaccttgggaatataaatcatgaataactctcaagttgttgagtttgaaaatgtaaaaattatataaatagatttgtcttgaaaaatactttcatactttcataaaagcatatacatatatcacttttcaataaatatttttatataaacaaagaagccaaaattgtgtttttgagaccgtgtcgctgtccaaaacgatttcctttacgagtgcggagtgagtaactgttttcaaaagtagctaaagagatgaataattacattaggatttttataaagtgagaatattaatatttttaccaacatgtgtgaaattggtgaaaaatatttttaacagaagggacagagtttatgaaatttacgcgatgaacatttatgtgagactggtgaagcgggcccacactgtcaggattgcctccccggtgcatgcacacatcctcccactctgccgccaacttaccccacagggggagggagggagggaggtgggccaccccacgatcgacggctgcccgtcctcccactcacgtcacgtcccaatctccgcgcccccgccgcgtaatcccgcgtccctccctcccgcttctgctacgctaaacccacccgagtggcttccttcggtaattaacccccaactccacgcccccattaacaactaaccccccacccccgcgcgtacgttttgcagtctaacccctcggaaacttcctttcctttccttcctcccacgcttcttcttcttcttcttcttccctttccccaacctcgccgtccttcgcttgctcacgcggccttctccgatcgcggcggcggcggcggaggaggaggagtacggggaggggcgtagcgaggatcgagcggagacgtggttgacgagatgaagaatctgttcaagagtaagatcaagtggcagcaccggtcgaacgaccccgcgtcgtcgcaggggcaggggcaggggctgccgcagcagacgccgccgtcgccatcgccggcgagctccccgtcgggggggccgcctgcgctatccgtgtcgacggtatcgtcgtcgtccccttccgccgccgcgacgccgacgggggctgctgcggcgggggcgggaggtgggggtgggggaacgggtggggaggattacatgttgtcggaggaggagttccagatgcagctggcgatggcgctgtcggcgtccaacagcgagtgcgtgggcgacctggacggggagcagatcaggaaggccaagctgataagcctcggcaggggcgaccgcttcgccgccgtccgggacgacgagcaaaccgcggatgcgctctcccgccgctaccgggtgagtcgccatgaccaaggattcgattcgagatggattatatatgctaaactatgcaaccgtgtgactagtgagattttagtttgcattgccatacaacagtagacttattgcgggggaaggattgttttacatgttatgattaccagttactactataatccatgctaccattgttctcgtcgaattcaaattcaaccaatggattggatagtagcttccgtggctatgtctagaccatgtaaatgtgaatcttcaccttggaatggaaaatcacacatagaatagggaagggctcctatctagcatctacatgtattcattcctgtggactggaattacctcctttggtctcttccaggttcccggtgatcaacccattaaaacaattgtattaataaaatacttctacaatatacgttgccatgtttttgctggtgcattgcgatagaatcctacagatcagagtcttgcattggatattgcccaggaataaaggactattgtttctgtggacggcggggaagtagatgatattacaaggcagcgagattttctagactggaggttcttttgcgggcaattgtagctttgtagcttgttggttacatcaatctatgtcttttacatgttgggttgattccattctgttacttagtgagtgatatttcatatttgtagatattttgcttggtagatcacttttttccttccatgatgtgtcaattaagctcaaacatggggatgataagtatatttgcttgctggattgtctgacattctatcactgtgcttctattctgactttcaggactacaactttcttgattaccatgagaaagttattgatggcttctatgacatttttggcccctctatggaatcatcaaagcaagggaagatgccatcactagcagatcttcaaacgggcataggcgacctgggttttgaagtcatcgtaatcaatcgtgccattgataccaccttacaggagatggaacaagttgcacaatgtatcctgcttgactttcctgttgcaaatattgcagccttagttcaaagaatagccgagcttgttacagatcacatgggtggacctgtgaaagatgcaaatgacatgctcactagatggctagagaaaagcactgagctaagaacctcactacacacaagtttgttgcctattggctgcatcaagataggtctgtctcgtcaccgtgccctacttttcaaggtcagttctctctcagaaaatcctcaatatattgaatgttatgaattgtctagggtaagggttcaaagactaggggatatggcactcgccttctaataacggtggcagggcttctccctgctgagctaaaagaggatttgaggcttagggctaactttagagattcattgattgattgataatagagtacgtgggggtccctttatagggaggacatactagacacataaggaactaaatctctagtattatataaaccaatccaatctctatctctaactttctaataaacttcatctctttcctaactagataatctcctatatttatatgatttattcctaatttatcatgcccaaactgctgcatgggcctatgctcatacattgaatgtaagcactagatttcttcatttgtccaacatatatagatgtccgcttatggctactgtatatcttcgtgcagattctcgctgatagtgttggcattccttgcaagcttgtcaaagggagtaattatactggtgatgatgatgatgctatcaacataataaagatgaatgaaaggtattgatgtatttgatcattgctgtttctctgggggaaaactatagtaaaaaaacccggaccggtgggtgacctggccgaccttctggttcaccggtctgaccggtggctcggatggttgaaccacggttcacatgtgtacatgtatattgttattccctcctactcacatatggtgcaatagcataagggttaggccatccttccgtgagcacactgcccagggttcgattcccaccaaatgcgccactccttgccaattttgcggaaaaaaaggggacagccacagcaagcattgatgaaatgggcctcaggcagcccatttatggcccatttgcaggttgacctgtccaaccagtatcggtttaatgtccggttcgcctaagaaccggccggttcagccggttcaaagcggtttgaatgcatgtccggtctttgaagcaaaccgaaccgtgctaaggtctggttcccatttttttccggtcgaaccgccggtccggtctggttttttctactatggggaaaacaatccaaatacattatttatttattcgtctgctacctttgtttcaaatatatttttaaataatttggtattgctgccttacattttctaagtgggtttatgtgctgtttttgcagggagtttttggttgatctcatggctgctcccggtactcttattccatcagatgtcttaagttggaagggcaactcattaaattctaatgcaagactcacccagaatccattggctgggtcatcaagtacaactgattctaatctcagtgccaatgcattaccacccggacataaaggtggccaactgcctttatttagcagtggcgattggatatcggccagtcaatctggatatgaaaaagatggagccaccacatcttcacaggcctcttcaagtggcacaacatctgttgctgctggaagcgcttttgatagttcttggacattagtttctcatggacaatcagatgatccatcaacctctgctggtatgtcagcacagcagaaagttatacttccaggtggagaacatccatggaatgagaatataaatgcgcgaaatgagaatataaaacttgtttcagatttacaagggaattcagagtccatcaacttatttgccgaccttaatccttttgggggtagggagcccaaaaggacttcagtgccattaaatgggccagataatagaaataatgagttgcaaagacgcagagagaatgtagtccctagcacacgaagaccccagcagcgattagttatgaaaaactggtctccttacaatgatgtttccaacaacaagcagtacaattatgttgaggattcatttgcacgtagaaatattggtgataatgctgcatcatcatctcaggtgccacggccatctgcaaaaaatactaatcttaatgttgtagtgcgcactgatacaccatacatggcagctcataattatgataatagtatggctggttcctctgcaatgaagatgacttctacagctgggattgggaaggttcctgataaggttctgtacggtgatttggacaagggccttactaattctagactgggggatcaaccaccgatagaaagacataaatggggcaattctgtagaaggaaggattccaacaggcacagttcacaatcaagcaaaagaacacaaggagaacttcgatggaaagcaagacaataagaagttacatcctgatccaaagaaatccccacttgacagattcatggacacatcaatgccatcaaggaaccctgaatccgtttcaccatcctttgctaggtcacacaagctagacaccatgttcgacgatgtgtctgaatgtgaaattcattgggaagatcttgtgattggtgaaaggattggcttaggtatttttcctcaactaagattttgacatgatccttgcttctctatacattaacaagttgaaccgacaaatctttaacaatttgtcaaactatattattatagctcagccatgtgtaaactcattgcactatctgatgccaatttgttgcacaaacttgaaccaacttcttcctcctcccaacaggttcatatggagaggtgtaccgtgctgattggaatggaacagtaagaaactgtttgcttttatttccatattgtgccatagaaacattcttcccagaggttaaattctttattgttttgcttctgtcaaaaaacatttttgtttatttgcaggaagtagctgtcaagaaattcttggatcaagatttctatggtgatgctttggatgaattccggagtgaagtaggtgaaactatatatattttatatatcttagagctttactggctatagcgtggattcatttatttgtcatttttaattgatttttgctgcaatgttttgatttgccatatactttctttttacaaggtgcggattatgcgtcgactgcgtcatccaaatattgttctcttcatgggtgctgttactcgtcctccaaacttatctattgtatctgagtatcttccaaggtataacaattttctactgttgtttgcttgtgaagatcttttggtgtttatgataaagtatcatggtgtagataaacatagaaaacattctatctggaaggaccacaaagaaaagctctctcaacaacttagctttagaatggaacataacactggaggttcaacatgctgtagttgaaatacctgtctttaatgatttacttgtgcatgggaggtggcatactggcatctatctatagtagttatattatagtgcaactcatgctctatagttattgtactggtcatgttcgacgaattgatggctcacccttgactactctcctgtccttggcaggggaagcttatataagatccttcaccgtcctaattgccaaattgacgagaagcgtagaattaaaatggcccttgatgtggtaagtattttctatattttcttggcatgtttgtttatttttgtatctgcttgagaaaatggttgctttctcttaaaggccaaaggaatgaattgcctccatattagtgtaccaacaattgttcatcgggatcttaaatcaccaaacttgctggttgacaacaactggaatgtgaaggtactgtgctctttttacctttacattcattcagtcataagtatttatgagcgtgctgatcgattggctcaccaatgatgtgaaataggtttgtgattttggactttcacgcttgaagcacagtacattcttatcatccaaatccactgctggaactgtaagtactaaaccggaccatagtaggatgagttctctccttctttgatcatcactaaacatttactatttctgttttcgatatctcaccagccggagtggatggcacctgaggtcttgcggaatgaacaatcaaatgaaaagtaagttattcctcgatggcttttgtttcaataactattagcttttgccctagcttgttcaatttattttttcattctgggcataccattcaaagttgttcagcattacagaagaaattatgtttatcttccagtctctactcgtagaaatggaacacccatctccctcacaaacctttcagctttccttgtttgattggtgtggcagtaatctcactcagacatcacctgaaatttctgcaggtgtgatgtttacagctttggtgtcatcttgtgggaattagcaacacttaggatgccatggagtggaatgaatccaatgcaagttgttggggcagtcggcttccaggacaagcggctcgatattcccaaggaaattgatcctctagttgcaaggatcatatgggaatgctggcagaagtgagtgtttagaaacaaacctattttatgttgcatcaataaagtactctcttccaactatcaattgtgttgctagatccgagctaatatttggtttttaaacctcagggatccaaatttgcggccctcgtttgcacagttaaccagtgctttgaagactgtccaaaggctagtaaccccttctcaccaggagtcccagagccctcctgtgcctcaagaaatatgggtgaattcttccaccccttgatgttgaggggcattccactctcaaaattgtgagtaattattgatgattgttgctgttaagtttgttcaagtctgcaaatgtgggcgcactgtagattctagcggccctaatggtagacatccctgctgccgcgacaaaagaacccagcagtagagtatgtatagagactatagtcatcgaccaaaacgatgacccgaagaagaaatccagtctgtggcatctcatttttcatgttcccagtttgcctttgtaaaaccttttggattcgagccctctggaaagcagtgagagctcgtggcgttggattaagaaggatctgtgtctgactgtgtttacaagtggattggataattgttgctgcagaacatgacatcttggaagttaaaaatgttgtaatatgcaatttttttaaacttgcaattcgaatgcagtatatgaacatgatggtaacagtactccagcagaccagcacattcatttcgttaattatagctgtaacactcgataaaaacaacttatcggtaattttttttctgttattagcgactaaaagctaatacaggaaaataaactattatgaaaaaccttaaaatcaactttaaaaccaagtttattttttttctacgcttgaatgtcatcgaacggctaggatcgatttgagggttgatcggacggagcaggtaggaccgtgagcttagctcatcaaaccaaaaaaaaatcaaaccattgccgtacctgacctgacggtaagacctgttgattgttgtagttcacggcccagtggcatcccccgaaattattcgcaactcccgagcccactcttcccacttccctagtactatcacacacaccaaccaaccccaccacgcgtcctgcataatcaccgtccgttcccgccggccgcccagatccaacggctcacatcccatcccccatacccaaaggcacgtgacgtggaccggacgcgtccggctctctcttaaacctggctttgcgccgtcccgtttcaagtccgtagttgattagtactagttcgaccagtagtttcgccctttccccccttcttccaccatccactaacccccatctcaacgcaaaccaccctctccgccgcgcgcgcgaggcagatctcgacggggagcgcagccgccgccgccagatcccgccccgatcgcccccgcctcgtccccacggtcccgtggatacctctctctctctctctctctctctctctctctctcggatcggtgcgattgcctttctttttgcgcggcggggatcggtgagtttgggagctgtgtgtttcgaggtttctgatttgaggcgggttttttttttttgatattggatggcggcgcgattcgtggatgcagggtgtgttttggggacggtgaaggagaggagtgaagtgtg

SEQ ID NO: 652 - DNA, 4955 bp, Oryza sativa
caaaccgtttaacattttagaacaagaaagttaaacgttagtagtatgcattccaacccaaaccgaaccacagaccacatacgatgctctgttcttctctttccggaatattaggtgattctccgcgctttattgcgaaaattactaacttttaataattttttaacaatcgagttaaaagtaaaaaaaatattagttatcaataacaaataaaactgatttgtcaaactatgttaagagagaaataaatttagtagactctatgagattgtagatgaaatatgatatcccactttgattatatggatgaatatatgttaacaagtattataaaaatgatggatatatatatatatatatgtttaaaatatcgtgaaaaataatgtgaaggaagattattggacgttgatttgtataattcaataaattatagatgatgttgcatgcttacataagttttgtatgtaattattgctagtggatgatgatgtatcatatctgtatgttgagttttagaataagtgggttaactttaccgtattccctccgtttcaagttataagacgttttgattttagtcaaagtcaaactattctaagtttgactaattatgtagaaaaaaacagtaatatttacaacaccaatataattttattaaatctataattaaataaatttttataatatatttgtcttaggttaaaaatatttctatttttttctataaaattagttaaatttaaagtaatttgactttgaaagtcaaaacttgtaacctgaaacggacagagagaataggataggatagccatcggctgcggcgaggtaacttggtaaacggaaattaaaagcggccaacatcacggccacgaggtcgccccgttcttccatgttccaaaaatccaaaccacgtcgcgctcgtgcctagcctccagtctccctttcatggaagcttctctcggccatgcatgcgccaaaaactcaagctggttgttctgacctccaactttaccatggtttataaataccgatggccacctcgttctattatctcccaaacaagccagctcaatcaatcatcgagctagctgagctagctaagtgccatattgcacgtactcgttgtctgtccgatcatccttttttttttcttgtgggggtctgtccgatcatccttgcgtggctaggcaggtagagtagctacctgctcggctgctcgcgttccagccagggtccgggcttcggatatcctcggagtccgacaccaaatcaatggcgtaccagggcatcgaccttctctcgacgaaagccgcaggcgatgaccacggcgagaattcatcgtacttcgacgggtggaaggcctacgacacgaacccgttcgacctgcggcacaatcgcgggggtgtcatccagatgggtctcgccgagaaccaggtacgcgcacagacctgtgtatactcatttctgaattaaggatcgttctcgacaaagtgctaatccgtctttgttgccctgtaaatgtcacagctttctctggacctgatcgaggaatggagcaagaaccaccccgaggcatccatttgcacaccggagggcgtctcgcagttcaagaggatcgccaatttccaggattaccacggcctcccggagttcagaaaggtaaggccaatcaatcgctgacatcacatcagcatattagacaagctatataacatcatagaaaattcgataaaaatattgagaaccagatagatgacaaagctgctgcttgcgaccgtgaaagcaacgcagcaactagcgttcgggaggtcatattgttaacaactgaatgtgattgtgatgttgcaggcgatggcccagtttatggggcaggtgaggggaggcaaggcaacgtttgaccccgaccgtgtcgtcatgagcggcggcgccaccggcgcccaggagacgctcgccttctgcctcgccaaccccggcgaggccttcctcgtgcccacgccatactacccagcgtatgtcccgtcaaccttaactatcacaactgaaactgaatttgttctcttccgctcgtagaagtcttctgtttcctctgaatatctagtagttcgtcaaacgaggaaaagatatccgagtgtcaactaagaaaatcagataacattctctccgagatttgagttacgttttaaaattggcttggagagaaaagatggattaattttcccgtgattgaatcaaactgcgacctaattatggatgccgttgaagtcaaatgactaaatctagtcatgcaagcaaacgcatgcacgatgttcgcacacggtcgtagtcaatgcaattttaactctgatgcatgtttacaatgtaacatagctgaggtagctaagcctaaggcctgacgacatgtgcttccgttgacagtttcgaccgcgactgttgctggaggtcaggaataaagctgctgccgatcgagtgccacagcttcaacgacttcaggctcaccaaggaggccctcgtgtcggcgtacgacggcgcacggaggcagggcatctccgtcaaggggatcctcatcaccaacccgtccaacccgctcggcaccatcaccgaccgcgacacgctggccatgctcgccaccttcgccaccgagcaccgcgtccacctcgtctgcgacgagatctacgcggggtcggtgttcgccacgccggagtacgtgagcatcgccgaggtcatcgagcgcgacgtgccgtggtgcaacagggacctgatccacgtcgtgtacagcctctccaaggacttcggcctccccggcttccgcgtcggcatcatctactcgtacaacgacgccgtcgtggcggccgcgcgcaggatgtccagcttcgggctcgtctcgtcgcagacgcagtacttcctcgccaggatgctctcggacgaggagttcatcggccgcttcctccaggagagcaagtgtcggctggtggcgcggcacgagcggttcacctctggcctccgcgaggtcgggatcggctgcctgcgcggcaacgccgggctgttctcgtggatggacctgcgccgcatgctccgggagaagacggccgaggcggagctggagctgtggcgggtgatcgtacaccaggtgaagctgaacgtgtcgcccggcacgtcgttccactgccgcgagcccgggtggttccgcgtctgccacgccaacatggacgacgagaccatggaggtcgcgctcggccggatccacgacttcgtgcgccagcaccagcagcgcagggtcaaggccgagcgctgggccgccaataggcagctccgcctcagcctgccgcaccaccaccacctcagcccagcccatctctccagtccattggcgctcctgtcgccgcagtccccgatggttcgcgccaccagctgattaagccagcagtgcacttgctctgctaatgctgcgccttactacgtcgactacattttcataaccatttttttctcgatcgcatcgtcgcacggcggcacggggccgtatggtgttctttccgatgcaggtacgtgtgatcgtttgtggaaactaggctacacgtgcacggcaccgtacatgtagcttggcttttttgtagagacgtgcgttagtgcgtacaggcgtcgccgcgtcgggtgtacataggtaattttagtagcgtgtgtaacaggggtatcggagattcggagtcctcgattcttttgtgtatggtttggttaattcagatggcaaggaataatgatcggattaaggcgttaagccccccgatcggctcttgtaaactgtaaagtgtaaacacgttacacttacaataaggcttaggattgaatcgatccggatatattgaatctgtatagcaggtcttcaacgtgcatcttgcatgtggacttgttcatacgaatttgagtgctttaatttccccttgcagatttttaataacagaatttcttgtaaatatacaacagttttttttctctctcgcaacttccaaatttataaccgttggatcacttcaagaattgtgcagagcagaaaaatataaattcccaagacttttaaatttataatcgtcggatcacaagaccaacgaaagagtgggaatcaaacccatagcctgagaaatatcatcttgtggtgttagccatctaattgagcccatgtttcgaataaaattatacatgttacatataagttatataagttatatgcatcccaattatattatagttataagttatatgcatcccaattatattatagttatgtttaaaagttcgcttttaaaaaatattgaatggtgtatagttactccccattaataatttgtgacttttagatttaatccagcagataatatatgaaaagaggaatacaatattatgttctattaaaggggcaattgtttatttgaccctattttgaactctaactaccaatttgaccctactttttggagtttgcttatttagccctccctttcaaaaacgaagctcctctctgaccctattccgtttagttgagttcacggtgttaacttaggggtaaatagtccattttgcccttgattatttgaccccattatatcttgattgtttgaccctattatgtcataccgtgtatatattcaaatactttgacatatttgtaataagtttcacattgaagacaagtttgatagatttgttataaatttaacaaatttgaatcattttgtcaaatttgacttaaattgacagaattttgacaaaaaaaaattaaacaaaatttgacacagttatgacagatttagcataaattgaacaaatttgaattattttgacaaattcgacttaaatttgacaggattttttaaaaataaacaaccacaccttggaatctagtttgaaccacatgtgtccaataatatcaatcaatcgaagcacatagataaaagcaaaaa

SEQ ID NO: 653 - DNA, 4218 bp, Oryza sativa
cgtgcccgccatcgtctcctcaatgcggcgcggccagatccggggacgacgacgaccctgcgctagtgatggcaacaaccggcgacgaccccgtgatggcgacgggcggagggagagcggtggcggcgcgacacactagatccggccttcgcgcgccgctcgccgtcggccaccccgcgccccgctcgctgtccgccaccgcgagagaaccaacgacgggagagaaaggacgtaggagagcggatccagcgccgatgaggaggacgacgacgagtggcgggggaaagagggagagattgacgacgggacagagaggcgccgtgcgaagggagatagagggagagaacggtgacgagagtgagggaggattgctgcggtgggaaaaagagaagggtagtatagaaaaataccgaccgtgggctttttggttgggacacccactgtgagcttgagttccttcatccagatgcctaagattttaaagagcctacctagattattctccattgggagataagtgtccctacgagtaccctcagttaggctttgttgtagatgcccttttagggcccctttgatttgtaggaaaaatgtaggaattttggaggattttaatcctatggaaaaaaaatcctatgaatgcctttgaaacaaagaattgaatcatatccaatcctttaaaattcctatggaatgggtaatcatatgcacattttggaggaaagttagcaagaggtataacctcttggaacatttcctctaagtctatctctctcatctgatttctacgtttttcctgtggtccaatatcaaacagccattcctgtgttttgcaattctctgttttacaattgtattcctgtcagaatcctgtgcttttcctattcctttattttttcattcctactattcggaggagccctaagacaccggccagcggagcggtcttcggcaggtcaaccagtaaggtggtgattgggctcaccaccttttacgcccagtgcgtgcgtgctacacgctccggagtctgcacccatcttccccacgtgcgcgcccatcgccgggccaccggaaagccaccgccggccatcccgccgccgcgcgatccatcacccggaccagcttcacacccgcgtaaaataataaacaatcaaagccccacgttttcccactcgccccacgttgaatagaccaggctcacctgctagctgctagtactccggctgcgtgactgtgtctgcgtcgcgtctcctccacttttaaaacccccaacgacgctcgatccgagattaattgtgctcatactgttcgacgaattgacaccatctgcacacctgcacctgcacctgcacggccgtggctgtggacttgcagttggagctagtagctagctcggggagtagtagctaggtgtagttcatcggatcaagggggggatggccacggcggcggcttgcatctcgttcgcgtcgccgtcgccggcgcgcgtcgtgatcaggcggcagacgcgggcgtcggcgtcggcgtcggcgacggaccggcaggaggtggtgtcgccgaagcggcggctgccgctgcggaaggtgccgggggactacggcccgccggtggtgggcgcgatccgggacaggtacgagtacttctacggcccgggcggccgcgacggcttcttcgcggcgcgcgtccgcgcgcaccgctccacggtggtgcgcctcaacatgccgcccgggccgttcgtggcgcgcgacccgcgggtggtggcgctgctcgacgccgcctccttccccgtcctgttcgacacgtcgctcgtcgacaagaccgacctcttcaccggcaccttcatgccgtccaccgacctcaccggcgggtaccgcgtcctctcctaccttgacccctccgagcccaaccacgcgccgctcaagaccctcctcttctacctcctctcccaccggcggcagcaggtgatccccaagttccgcgaggtgtacggcgacctgttcggcctcatggagaacgacctcgcccgcgtcggcaaggccgacttcggcgtccacaacgacgccgccgcgttcggcttcctctgccaggggctcctcggccgcgacccggccaagtcggcgctggggcgcgacgggcccaagctgatcaccaagtgggtgctgttccagctcagcccgctgctcagcctcggcctccccaccctcgtcgaggacacgctcctccactcgctccgcctcccgccggcgctggtgaagaaggactacgaccgcctcgccgacttcttccgggacgcggccaaggccgtcgtcgacgagggggagcgcctcggcattgcacgggaggaggccgtgcacaacatcctcttcgcgctctgcttcaactcgttcggcgggatgaagatcctgttcccgacgctggtgaagtggctgggccgcgccggggcgcgtgtgcacgggcggctcgccaccgaggtgcgcggcgccgtgcgggacaacggcggggaggtgacgatgaaggcgctggcggagatgccgctggtgaagtcggcggtgtacgaggcgctgcggatcgagccgccggtggcgatgcagtacgggagggcgaagcgggacatggtggtggagagccacgactacgggtacgaggtgagggaaggggagatgctgttcgggtaccagcccatggcgaccaaggacccgcgggtgttcgcgcggccggaggagtacgtgccggacaggttcctcggcgaggacggcgcgcggctgctccgccacgtcgtgtggtccaacgggcccgagacggcggcgcccaccctgcacgacaagcagtgcgccggcaaggacttcgtcgtgctcgtcgcgcgcctcctcctcgtcgagctcttcctccgatacgactccttcgacgtcgaggtcggcacctccacgctcggctcatctgtcaccgtcacctcgctcaagaaggccaccttctgaccaccgccggtcaaagtctccggcgcccggtcatcttattttccgtcctcttcttcttcactaaatattttagtagtattagtaattttttcactctgtatggtgtgatcaatcagcttgtacggatacggagttgcactggtagtgattttctttgctgagataatactagtagaagatattttttttcacaattactttaaaaaatcatattaatatatttttcaaatttattttaactaatacttgattaattatgacataaacgctgctttgttttgcgtgttaatgagtgaggttcactcccgaacacaccctagctatcctggtaagaacaaggaagctccagtgctaatgaagcaagcggatatttagattagcgccataaagttggattaagattccagggagtcggcgatggtgatggctattatcttgttcattgtcaccctgttctgttatcacttattagccatatggagcaggtgtgcaaattatttgtgactaatgctgagaatcaaacttgatgcataaatactgcatacaattgtagatagccaacaaactttgttcgcggtggcggctatcttagcacttgtgtgaggtcgcattactatgcattaatggctattgtttagagatgaaagtggatggagaaaccgaaagtgatcggtgtgatggtgcccaagcgagactaagtattgttttattttctcaatgttgaacggtcgccttgtccactatcaaaatcccgattgtgcgtgttgaactagcccgtgtgttgtgtgcatgctggcatgctgccacactcaaatagtcataggactggagatggacacttcaacgtactaacaggttacaaggggtgtgtttagttcacgtcaaaattgaaagttaagttaaaattagaacgatgtgataaaaaagttgaaagtttatgtgtagaaaagttttgatgcgatgaaaaagttaaaagtttgaagaaaaaatttagaactaaactcggcgaaggataaccaaagttgtcgcgccagcatttgtacggtcctgaggaccaccaccattcctgtgcgtaagtaaattatactacgtagtactgaataccgatccattatgtaaaagcaggtttaatagtatagctaactactagctccaaatcatctataatcaatgtaatagctaattcatacaatagttgcttactatactattaatacctggtcctgcctgtcatacacacatt

SEQ ID NO: 654 - DNA, 8102 bp, Oryza sativa
gatttgatgatcttgcatatctctgcgttagctggcgtagcatcgtagagcaaagcgtccagcgtgctgccatttattgcgcttttgtagtctggtggtgcattgcatactgacagatatggaatttagcaagagcaaatctatctcccccccatccatttattattagcaccagatgggatttcggttctaccaccatcggttacaccatatttctgcaaaattgtcgagctaaactacggctgtgttcctgaaaaaagttgaaagtttgaagaaagttaggagtttgaaaaaaaagttaaaagtttacatgtgtagaaaaatttttaatatgatatgatgtgatggaaagttgtgaataggtggaaactaaacacagcctacaacagagtcgtaagttaactttagtgttattaacactgctataatataactctccggtatttagatatgattttgttaattatgcaaagcttgtaagattttggtgatgttcatttgtaccgaagatgaagataaagttaagacatagaaaaaacattaacatataattaattaagttttaattctcggaaaataaatttatctcaggacgagtcaagtctgagtgcacggattgatcacaacgcccttccatgaaacgatagacacggtgtactcgtaagagttttaaggcgtaccaaacgatagcaaactaatatttatacccattgctaaaaaaaacaaagttggtacactggagacttttttccccttgttctcatctacagaaaatagatctagtatcataattggcgtttagacttaggggcccccatctcaaatttttctaaggatgaactggaccgagcacaaattgtgcaagcgaataaaaaaaatatatactcaatatatattaataatacgcgttatcgtgaaggaagaagcaactggaagatgtggtggacaaacagccaagaaggccaaaatgcctccaaccggcggccacagctgatgagtaggtttaaaccccccaaaccccacccaataatcctcctccttaatgataaacacgaagaaaattaaatactccctcccacaatttttcctttttctttctttcttttggaggccctccacaattattttattttggttgttggtggtagtggatggtgtttcttttttattccatttgtttatttatttttggcaacaacaagaagaagaggagagagagaagtagaagaagagaggagagaagctcctctctctctctcttgccttttttttttcttctctttttcatattgttatcttgggatctgatttttgtccccatactgggagggaaagaggagaggagggattgattttctttctcctcctcttcttgttcttcttcttgttgttccactcttattgttcatcatcctcctcctcatagctgaccaaatctctgctgtgacagcaatctctgctgcttggttctgcctcccatgaggagcacaccatcaggtctcccttccatcttgctcgaattttttatcaccccatctgcatcatttggtctctgttggttgcagcagaagaaaaaatctatttttttttgtgtgcatattcctcccccgaggacacgtgatttgctcttcttcttgctttgctttgcttctggatttgtgttgtctgattttggtgggtgcaactaatcctttttgttattcccgcgaggggtggtgttgtcatgagctcaatcattgggttggtctctgtctctctgagagtctgaattatgtgtgcacgggacggggtttgctttgctttctttgatagcggtggagcttagcgtctctggatgaattgcgaggttttcttggtgtttctgcgtgtttaattgacttggggatctgtaattcttgaggctccgtctcaggaattttgtgtttctttgggttggttcatggatgaactgaaggtatggtgttttctgcagttttagttggtgtttcctttttacatcctcacctcaaaagttgttctctggtggtgtggatgcttggaggaactgagcttggtttgctggcttcagaatccatggcttgtgttcttgaattctgggtttttgtggcgttcttggtggctcaaccaccatttggtgttgggagaagagctctgagtttctagcagctgcttctccagctaccggtagagctggcttttttttgggagagatgacagaattgagcttgattacagtggagtcctactttgatttgtggcttgtgttcttgaatctttaatctctgtggatgcctgcatgaaagccatatgctcataaaaagccctgttcctttttctcttttctgttgtggaaatgattcttgtgttggattgctatctcatattcctcttgtaatcgaattcttagctctcttctcatcagaatttgggtgtgcctcgtattctgttgtgcgtggcaacaaagtttttgccttggtcatttctcctagtttccacctctttcatatcgttaaaaacaagtggaaaatttgagatgtaaacaagtaaaaaaaaagaagtaacttttattttctctttgctggtctctattctctagttagtcatctcaggtcattttatctcgtctttcagtgtgattacaaagcaaggaaccctcctaccgcgtcgctgagctgatgaaggagctctgacgactcggatgcattcttctgccatcaatcaattgatccaacaaggtattgaaatagtattccatttataagttctttctttttctcaagaaaaaaaaaccctacaattttatctgtggccttgcagttcttgtatgtggtatagaaccacttatctcattgggttcttgaaaggtcgcctaatcttgatgaaataggaagaatttatagccacattctcgccgtcttgattatcttgataaggaaggagcaaaaggccaataacctagctataaactcagatgaaggaccacctgaagttctgtacctttagccagcaaactggcatcttaccttgtcacttcatagtttatattctcttgtttcttgagcatataacctgtgttcttccctacaaatatagtaagaaagaaaagaacaaaacagaggtggtaactgctgccaaagctgtgggtctgagcctcactcactcgtgactggcctttgtgtgtatcttgtgtccttgcaatagtaacagaaccgtacttgctttcccaaaaaaaaaaaagaaagaaagatctggtgattatagtgtgttttgtttcttcttaactatttcattatgtggtgtagaatttgattgtctcatatataattcctaactgtacctttttgttgtcattgttttgttgaacctttttccttccccctttgacaggcaactcgatcggaatttgagtttggtgaactctgtaattgattccctgcaagtatccatgcctttgcagcaatcttgctaattgagttgtcaaagctgcatacatggctacttactactcgagccctggcaatgaaagggactcgcaagctatgtacccagcggattcaggcaattcatcatatcctgtgccatcagcaataggaaacatgttatatcctggcaatgggtcttctgggccatacacggaattcagtggcattatccagcatcagcagaatttcatggagctgcctggccatccaactgcgatctctcaagattcatcgtcacgggaacctaacatggtcgcgtcgtacatggatcagcgctcttttggacctgccaaagatatgagaaatgagatgttgatgcatctgatggatggagcacataatgctggtgctgatctcatccacaatgacactcatagcagcgcgcagattgagtttggcctattgaacaaccacaattcgatgagcgttgcaccagcaccaggccaaggattgtctctgagcctcaacacgcatatcctggcgccttcgtatccatactggtctgcgaaaacagagttgctaacaccacactcttaccatggtgatgacaacagaatgaagaatatgcaatctgaggcctcacaggcaatcagaaactcaaagtatctgaaagcagcacaagaattgcttgatgaggtcgtcagtgtttggaagagtataaagcagaaggctcagaaagaccaggctgaagcaggaaaatcagataacaaagaagccgaggggggttcgaaaggtgagggggtatcttccaacccacaggagtctactgccaatgctgcaccagagatttctgctgctgagaaacaagagctccagaataagatggcaaaacttatggccatgttggatgaggtgtgtgaatttgttgcccttctatttcttaaaacaaaaattatattgcccttccctatacctcgctatgaaatcgaagtgtcataatggtttgtttgtgcttggctaaattcataccaataatttgcacaaagattactaatatgagcaggcttaatccagatactccaaagtaaagctccagaaacaaatacttgtctagtagcagttgcagcttattctctcgtgtgccaaaagtcaattgcgttgtcctgccttccgttgtcttcctagaaaagtattggttggacactggaatctccaccaaatcagtgttagatatgaccttagtattcactattagcatagatgggtcatgatccacagttcagaactgttttgacttattgctaaaagaaatgttttggcttctaacaagaacttcataagttgggcttcttacagaagttagagagatgggtcaaagcctcgaaggtaactagtctaggtgggtttagaaagcttagctgcctatagtcttacatgggaaaagcctttatcttctaaatgctcaagtttttatcttaaggccctccaaacaagtttgagaaagtcacatgttctattgaagtgtccagtagctgcaggaactaaaaataaaaatctctttcgagaagtcaaactgatagcattatcaataagatgagtagtggttttactggcaagctaatgatatccttgctggtttgtaatcataccatttgttttaattttcaggtggaccgaaagtacaaacactattatcatcaaatgcaaattgtagtctcatcttttgatatggttgctgggtctggagctgccaagccttatactgcagtggcccttcagacaatctcaaaacatttcagatgtctgaaagatgctatcaacgatcagatcaatgttatccggaagaaacttggagaggaggagagttcatctggcaaagagggaaaattaacgcgcctccgttatattgaccagcaattaagacaacagcgcgctttccagcagtatggtttgttacagcaaaatgcttggaggccacagaggggactgcccgaaaactcagtttcaattcttcgtgcttggctttttgaacacttccttcacccgtaagtgactttctttatacactcattttcatttgcctgttttttcttttgttgtcatgacattttgttgctttcttaggtatccaaaagattcagaaaagctgatgctagcgagacaaactggcttaacaagaagtcaggtattttttttcctatcatacaaagacaacctgttatcttatcataataacataccccatccgtcccaaaaaaaagtccaatcctaactacgaacctggatacatgtgtgtccagatttgtagctagaatttgcttcttttttttgggacaaagtagtagttagcaatcattgggatgtgtttatctagttaaaatagatggccacgtgttggtattgctaatgcatccggatgtatacccatgtgctgcaaaatctctgccatgatactgggcaactgtttattatttgcatgcacatcggcctttttctcagaataggtctgaaatctattaaaccctgtttcatcagttctggaatcatactatgttgtaacgctggatgctaatacaattttggatttgaatgggtacaaatgtttgtaaattacctttctttttgcagaactttgcactctgcatcaattcattggatagaattagtttgctgaactcaccaatattcttctttgtcctagatttcaaattggttcataaatgcccgtgtccgcctgtggaaaccgatgatcgaagacatgtataaagaagagattggggaggcggatctcgactcgaactcctcctccgacaacgtaccaaggagcaaggacaaaatagcaacatctgaagataaggaagatctgaaaagctctatgagccagacttatcaaccaagccaattaggtgaatccaaagccaacatcgggatgatgagccttggtggggcaccagccggcttccacaacgaaggcaaccaggatgacagcttcatgaacctaatgctgaaggaccaaaggccgggcgaagccgaaggcagcctcctccatgatgccgtcgcccatcattccgatgagaacgctcggttcatggcttaccatttgtcggggctcggaagatacgggaacagcaatgtgtcattgacacttggcttacagcatcctgacaacaggctttcggtacagaacactcatcagccaggtttcgccggtgctggagaagaaatttacaactccaccgcttctctcggtgtcgctgcagcttcctcttcggactacgaatccacgaaccaaatagatcaaaggcaacggttcgaaccatcgcctctaatgcatgattttgtggcctaagatgctcaaaataccaaaaatatatggaggcaagatttgcctggggggagcatttgtaatttgtagtgccagaataacatgcctcagaaagcatggaaattgttagctgtagttgcatttggtacagaagaggggggtatagcatgaaatgtaatataattaagtttagcaggtgggggtttatagggggtaaagaatcctgtaaaaatggaatacatcatacatgtaaaagattatgattttcagaaccattctgtaaaaaaaaacacacctgtaatgactacttatcatccaggtatatgttgttcagcctattgacaaaataaaaaaagaaagaaagccagaaaagaaaagatcgaagatcaatggacagatcgctggggaatcttcagctttctgttctgcatctgcaagttgatgcttcaggctttatgttactggagttgagcaccagctgttgctctctcctcttttatctctgtggagatggtttaatttgtcggtccatgcactgtttgccatttcatctcatttcatttccattacaatttaaaattctaattggcagcccttgccggtgcaggagcagctgcaggattgaagctgcagtgtggctgccccaggcccagggactgggctcatgcattttttttgtacgagtaaatgcgccctgttgctgtcatgtgggcccgggaactatggcttctctgtgggttcgatgaccccaaacccaaaggcttttaacaaccaccacttgtcaattattgaggaaccggctgagctggctttgtgaattgttaaggcgacctcacctcctgcagttaggactttgatcattgtggtttgtttaaattgtatatatggttggttggtatggattgagaagtttttccgacttattagaaacagcccactctaattgtcataacgtctaagggtgtatttgagagaagagaaaagaagaagcttgagaaaatacacaaaacaaggtgagccattagcgcatgatcaattgagtactaattatttcaaacttgaaaaattgattaatacgatttttaaaagcaacttttccatattttttcataaaataaatcgtttagcagttggagaagtgtgcacgcgaaaaaagaaacaaatcttttccctttcatgcgttgccgaacgcataggaagtggaggccaaagtgaatcaaagggatcttgtattatctatatctatacttctttaaaaaagggtggtgatgagtttgccaccacctcaccattgactctccaaaattcaaacatgtgggaccagtgccctccaaacatacgattgaattcacgga

SEQ ID NO: 655 - DNA, 7018 bp, Oryza sativa
ttgtgaataaaatttttatatatgtattcttagcgatctaaaagcaaagactgaaaaatatacttcgatgaaaaaaaatcccaaaatcaactcaaaatttaacgttgaaaattcaaattctgactgataagcatatgaatatgctaaacgatggggaccgtagtattgtagtattgttcttacatggtgtttccagtcgttagcggtcagaatccggttaaccttaccaactggaaccaggatgtctctcctctgtgcagcgttgaccgcatgttaattgcagcatgttcctgtgcctggtgccagagaatttccgcagacaaattcaatccatacaggtaacggtctagaccaattcgcaagtactactagtagtagtatagttctagcaaattattttccattttagaattgagattattatacagtacaggaaaatacatagttgagaccaaatcgtacgtgcagggcagattcggccataactttcacacaattggagtacagtacagccgtgcatgcaaatgaagtaggagtaagtcttgtccacatcgtactaatactaaaaatctagctgtacttccactactgggatttccctgctgcttcctttgatggcaagatggaaaccggccggtgcaccgttttccttccagatttgcacgtaccaccacccacttgatcgtcttcataagacagtttttactaataaattaatttttatttcttaataaaccgttttagtattactagaaaatatgggtaatcgatgaggctataacctaatacaaaatgtcttaatacaaaatgtcttaatatttttagcattgcaatgtgttatattttatagattagttttctattattttttctgttttataatatatatatatatatatatatatatatatatatatatatatatatatatatatatatatatatgtaatgctagaaaatattataatatgaaatagggggagtacgcggcagacggggaggagaaaaaaaaatcggtcactaatcagaagtataagacgaggagatcctgctacttcttccccatcaccaccaccaccaccatcgctttcttcctcctcgccttctgcttctgcatccatccatccatccattactcgccgaagacttcgcgcggggagagaggaggcaagcttggtcgcgggaacgcgggaagaaaggtccgagcttggaaggagaagaagaagtagccaagaacgcgagagcttggaaggcgagctgcggtggtgtagctagccaatgccggcggggaactggtagggagggggatggggggagggggcacgctcgtcgacggattccgccgcctcttccaccgccgcacggcgtccggctccaaccagtcgtccaacgccggcgaggaggccgcctcctccgacctcgaggtcgccgacgacccggatctcgtcgccctccgctccatccgcatccgcgtgcccaagcgcaagatgcctctccccgtcgagagccacaagaaggtgaggaggtgcctagtgtgaagtgtgctttgctttgcttcgttttcttttcagtttgggggtgaaatgaaagtttcaggctttctcgtgatccttgattcgtggccacgaggggttcttagactagatcagatcttcgtggcacctgaattacttgcatactgtacaatatcattatttctttttttctatgatctgtgcaaagtgcaatacagctcaagtgcaggtaaagcttgcgtgttctatccaatctttcttctttcgatggttgcttgtagagcgatagttgcttgtaaactgccatccgattcgtcatcctggctgttgacctgtgttattccagtgatctatgaaacgatcgatctcgtaaaacttaagtttctttctttctttctctgtttgcttagttctgaaattacttgctcctgcatgctccatttcttagaggagtgcaattgcagcactactatgcaaaaagcttgtgccctcttttggagctgttctcaacaattggtcccatcatccttgtcatactgatccttaggagctcatatccaagttgtccacttgtggttttggatgatctcatcagaatcggctactaattagtactccaggtttgacttggtctggcctatgtatatctctggtacggactgtttctattgggaacaagtcgcgtcttgcacatggtatggagcaggtgttcctttcatttgcgaataaacctacatgtctatgtactgaaaatgtcaatttttgttaggttggtcatgatattcccagggacaagatcatggttttgtttatagggctattctactactgaagaagttttataaccagccactctgtatttttagttagcttaatattttcttgcaaaattgtgatcttgtagaacacagtggaaatggagttcttcactgagtatggagaagcaagccagtaccagatccaggaagtcattggcaaaggaagttatggagtagttgctgctgcagtagatacccgcacgggtgagcgggttgcaatcaagaagatcaatgatgtgtttgagcatgtatcagacgctacgcgcatattgcgtgagatcaagctccttcgtctgctccgtcacccagacatagttgagatcaaacacattatgcttcccccttctcgaagggagttccaagatatttatgttgtttttgagctcatggaatcagatctccatcaagtcatcagagcgaacgatgacctcaccccggagcactaccagtttttcctgtaccaacttctccgtgctctcaagtacatccatgcaggtaagcttaactactgataatccccaattccccaagaacctacttgaccaccattaaacacatagttctgttgatttatcaattaacatggaattctagcttattctctgataaatcatctatattggcacagctaatgtatttcatcgcgatctaaagcccaagaatatactggcaaactcagactgcaaattgaaaatatgtgatttcggacttgcccgagcatcattcaatgatgccccttcagcaatattttggacggtaaggtgcttatatgagattttacattcctctttaagtctttatgttattaattatgttctactttgtgaaggattatgttgcaacgaggtggtaccgagcacctgaattatgtggctcatttttctccaaagtaaggtcttcaacactagaattctttcaatcaagattaatgcttttgtggcaccatagatgaactggtctagttgtttttagcaatgctttcttttttttttcctttttctttatctatccaacttacagttgtgctaaatgaagtatagaaaattaagttatttttctttttgttgatattttagttgtttgtacatacaattttctatcaaagctgcgccacttgaaactggatgagtaacattcttgtagagaaacaatatactgtgaactcttttgtgcaatgctgatgctctagcgttccatgtgttttatgtgttctaacaatagccaatttgcatacagtacactcctgcaattgatatttggagtattgggtgcatatttgctgaacttctcactgggagaccactatttcctgggaagaatgttgtgcaccaattagatattataacagatcttcttggaactccatcatcagaaaccttatccagggtatgtttactttataccgattctcatatatccttgaacctcctattcagtaacattcaagaagatccaattctctaataagatgaaacaatcaccttactgttttctgcgtctctgcagattcgaaatgagaaggccaggagatacttgagcaccatgcggaaaaaacatgctgtccccttctctcagaagttccgcaatactgaccccttggctcttcgtctgctagagcgtttactggcatttgatcctaaagatcggtcttcagctgaagaagtaagctcaagagaaagcatagcatcctttccaaacctcaaaagtagtttttttttaaaaaaaaaaactttcagaaaacacacattttttatatgttatattctcttccaattttcaggctttggctgatccgtacttcgcaagtcttgctaatgtggaacgtgagccctcaagacatccaatctcaaaacttgagtttgaattcgagagacggaagctgacaaaagatgatgttagagaattaatttatcgagaggtacaaagcaatagctcaagtttcctgctttgtgttaataataaaattttcagcttttcaagattgataattatgaaatgcaaacagattttggagtatcacccacagatgctgcaagagtatatgaaaggtggagagcagattagcttcctctatccaaggtggagtcttgcattaatttttctttctttcatcagttttaaatttgacgtgacaaagatgaatatctggctttgttccagcaagttagcatggtgtacaatatacttctttgcaccaacaaaattgccttcgccaaatactcttgttggcaaagcaaatttactaagtatagtagtaatttgctttgcagtgctatcatgagttaatatctgatctattcttgttgctctcattttggtatatctttatttccaaggctcctttcacccgaaaattgcatggacattgttacaggaaacactagccatgtgtgcatctaatatatatttatcatgtccttgcatggttttctctcctttttttaccgtgaacatagctattctgttaatattgttatcttactgcagtggggttgatcgcttcaaacgacagtttgcacaccttgaggagaactacagcaaaggagaaagaggttctccactgcagaggaagcatgcttctttaccgaggtacataatgtggcaatatcagaaatcaaaagtgcagacctacttactttcatatcaattattgtactaacttctccattgattttgcatataacagggagagagtaggtgtatcaaaggatggttataaccaacaaaacaccaatgaccaagagaggagtgcagattccgttgcccgcactacagtaagccctccaatgtcacaagatgcacaacaacatggatctgctggccaaaatggtgtgacatccacagacttgagttcgaggagctatctgaagagtgcaagcattagtgcttccaagtgtgtcgctgtcaaggacaataaagaaccagaggtactgttactttgctgcctgaaatttgtctatgattcttataagtcggcaaagttgcatagctatgcacgatcgaacaaaagtataagaaatgatgcgtgaaaagaaaaggaattgactggtttgttgcataggtagtaactccatttccctttgcatttcccttttgtttttgctatcctttaggatgattacatctctgaagaaatggaagggtcggtcgatggattgtctgaacaagtctccaggatgcactcctagtgcacaacgatgacgatgatcagtgcaagattctgtgaggcgcaccagatgctgataatttccaagcagaatgctgcactgcaagtttggactttggacaatgcaagtatgcaacagccagcccgagatgattggcatcttcttatgctcatccatgttcacatattcttcttgccattgtgctgtctgtcactacaggacccctgcatggattaatgtattatccctctgatgtaacactagattagtccatctgtccatggaggaatgaatagcaagcagccagcttgtgcatcatgtgggcatgttcattttccagtgagatctagtcatatccatgctttttttgtaatggtatatgaaacagtttatcagtgagactctggtccattcctctttgaagaactgctgagacagtgatccattcctctttgaagaactgttcattttcagtacattaagcctagtaaagttcagatgtttgagttcggtgcttaataatcatgtcacacgaattttccaagatgaatgccaagtaggagtagtatgtatgagtgtacaattgcatcagaaattcaaatgaaattggcgaataccagacgtagcggaggagattcgttcgaagtcacaggttttggcggccgcgagtccgacgacccggaatgcagtttcgtacgttggagctggcagcacactgaagaaattcctgtagctgaatgccttggagagatgtggtatgtgatcacaagctcttacttaaaaaaaaaaggtaaactgcataaaccacatgttttgtgatcaaagttgtagaaaatcacacgtactttgatattcatgatgcgcgttagactactgatcgctagcattagcggtcatttctgagtgatcccatttccatttcatcttctgctactcaggatagtgaaaacatctgaagaaatggaagtctgaactctgaacaggtaaacccaggatgcattccttagtgcgacaatgacagatgacgatgatcggtgcaagatttctgccagacacaccagatggcaataatatggaagcaggacactgcacggcaagtttctttgaactttggacactgcaaacagtcgtccaaagatgttttgccacttcttatgagttatgcccacgcacaatgcacgttcatctactcttaccatcatgttactcaattcagatgcaaatcatgcaacattagatatttagattagatctggtccatggaggaatgaagactggccagcttttccaccatgtgagcatgttcattttccaaccaatggcatgtgaaggttatcatgtgctgttcctctgtaaaaagagctgtgctaatagatcaagaagcatcacctttcgcatgcaatgttttcttgtctaattgatcaataactgagccacacactcttttacaagacacacagacatcttcaagtgcgcagatgaaacgtcttccagaacacccctccattccagtactgcg

SEQ ID NO: 656 - DNA, 5187 bp, Oryza sativa
cactgtcatgaaaggcttgattgatgcaaactaattgagccgtcatcggctatctgtacattatccgtacagctgccaagtttgtattgatcggttttcctcgaggttaatttgtaacttgtatgtttttcttctagtaacttaagtaattatttttaaatctaaggtcaatatgcataacaacatattcagaaaaacttatgaacaagctgattgttcattggtaaaatatagatatgccgatgtcaataaaaaccgacgatgcctgaccgaaacaaatactacatgtctacatccatgctaaaattaaataagttcacttctatacatgaatttgactatattcatatttatgtaaaaaataaatttatttttgaatggaggaaataagtatatacggtgataattgaataccgctcaccaaagatccagctagtagcacacggataaatggctgcaagccaccaaccatttccggtggtccaatacctgaagaacagccagcccattgatgagtcagcaaaggatcagatcgtgagagatgagccaatgccatgtatttgagttactccaaaccaaaacacaccatcacatggaaaaagtaattaatctaacaaatgcctcaattaacattggttatgcagaaaataaagctgcagttaacggaatcagattaaagaaggaaacaactgctcattttctgtaagacagcatcacggccttcagatctataaataggattaggcaaggtgattagtgatacattatgtgctgtacctgtttcaagaacacaatgatgagctgtaccatcatcaattgtgaaataattaattaaattatcattaagccccaaaccgagccaagccaagccaaatgaatgattgctgtggtgaagggcgacgactagtcagggatgagtcggatggatatgctctttatgtgatgcggtgcccaggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggcatggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaagtctcagactttggactgagtgcgctttcagagtcgaagaggcaagatggcttactccataccacctgtggaacacctgcatatgtagctccagaggtgatcagcaagataggatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtacaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggccaaaaaaaagatttttttttaagaataaggatatccttgtatttgccaaatagccacagagagcgaagttattggtaaacaaaagaaaatataatacacatgttgaaaaatctgaacaaaagctatttaaacactagttgtgaggaaaataaattgtccctgtcactgaggatagatccaacatccaagagctcatttttcacggtactaattgatcacccaacatctttccaagatgttaataatactgctaatcagactgtccaaatgtcgactggatttggttaatctcaacaacccaatcgtagctgtgacaagttgtacatatgacaaagactacactcttcataatttcatattgcaacttgcgaatttcccacctagatgcttttgtcctttgtaagatttgagaatttttttttgctttgagaaataatactgagatatcattatatcaatgatagattcctgataagatcgctgtaaattagagagagggagaaaaaaaggttttaagataagtcatgttgtcatgcaaaattcagttctagtgttctactactatacatttatatatctttcagatgttgccagtttatatacattagtgtttgtcttgataggatatgttaaaaaaaagtctggccga

SEQ ID NO: 657 - DNA, 10868 bp, Oryza sativa
atatgactttctacaacaactttcgtatggattttttttttcaaaaaacacaccgtttaacaattcaggaagtgtgtatgcagaaaacgagggagtaggcgatgcgaaccatgactttcgaacacacccttattctcactaatggattgcctcatttttgaagtgccaaacaaagtagcaaaagaaaaataaacatatacgagtgatgcattgtctataaaaagcatgtgctacatttcactgaaatctaatttaaactatcatcagatgatgatatcgcttgtaatcaacgaaacatagcgagcctttgtttgtcacagctaccgaacaaatatagttgccctgtataattttggaagttaagtcaacaaacgaacgaaagccatgtatacgtaataaagccatatgatattataagagatatactacgtaaatattgtctaaggacaaaattatctgccacgctccactaaaatcaaatatgaactatgataagatgacgtttgtcaccaacaaaggaggcgctaccttctattcctcaccggctcaccgctatcctctctcccaccgatggactgctcggtgttctctcttgcgtcaatggcctgctcggtgctctctcttgcgtcgatggcctgctcggttttggaactagcaagtatgaactaaccagggatgcaaaatccatatctagatgaaggcacatctgtacccctggacctacccctatatatagcactcatgtttgagagtaaaaccattgcctatcaaacaacagagtgtttaagtatcctggcataagcacaagcaggtcaggaggtactttgcacactctgttcgctggtaagccgcgttagcgggcgttcggtagacagtttgtttctctaatcacttccacagcctgtttagcactctaatccccgccatttttgcttaaacccccctccctttccgcgtcttctccgtttccaccccatttcgcttcccgatcacatcaccgaacgagagagctaggaagaggaataagaggaaggggaggaaattttcgaaacgcgaaccctagggttcgcggtcgcggtcgcgggcgcgggcgatgaagatcccgttcgtgaccaagtggtcgcaccggtcgcacgagcccgccgcgccgtcgaatccggcggcgcagcagcagccgcccccgccgtccccggcgggggtgtcatcggccgcggcggctgcggtggtggaggaggcggagatggagacgggaggggatgacttcatcacgcaggaggaggagtaccagatacagctggcaatggcgctgtcggcgtcggcgtcggtgtcggcaccgagcggcggcgggggctcgggggacacggagggggagcagatcaggaaggcgaagctgatgagcctcgggaggggcgacctgagcgccgccgccgatcgtggcgtgggcgactccgcggaggcgctctcccgccgataccgggtgagctactgagcctaatgttaatttcgctgcattagtagctgggtttacagaatgcttgtggtccttaagattgttagggtggcctcaggccatttcgtgttgtaaatagcattttgtgggcacacttcgccactaggatatgcctatgatgcatgcacaacacaatggcttaatgcatggtcattaaggattttaaggtagggttcagctagttcaatgctttataaaaaagttttaacactttggttgataatctcaacaattggagtgaaaaattgagtagtgtggactgtggagtagtgatgatcttggcaaaatatggaaaataaggttgtagctgaaccacacactcatttgctcagatgctttcacagtgagttcatggatactctgttctaattttggcatgctgttggtttctaaataaggctgttctagccctgcaaaaggattcttaccttgtaaaggtagcaagactgacctttaaataaattaaaaggttaggccaatataactgtctgtttacacagatgattcagatttgcaaatctaggttctgacacatttataaccagttcctatattacttcaccatacatattttagcaatgaagaacagtttcatggttgaacttgcacaacaacatttaagaaatatgctagtggatacctgtccatattatataatgtaaagaggaccaaaacttcttaattaagagcattcattaggaaactattggtcggaataagtggaaacaatataatgcctgccagaagagatcaagaagtcaatcctgctggcctcctgatatccacattaggcttcatcaccatggaagcaacaattatttgaaagggaaagtcagaagtctgctatgtgaattcaagactatcagactatgttaaagtgtttctagttttgttattttattttgcgtcagtagctttttaataggaaaatctggtacttttcacatggtaggtttttagttggatttgatgatctttaatcaacaaaatctgaatcaaatggtaatagatttctcgatgttgttggcaaatatctaactagaaggcctggtctgtagttataggggaggatgtaatgttcatatgtatttgagtttcaattcataaaacctgtaaaaggctacttgcctataaccactcaaatgtggagtaatcactagaaaattgcataaatggacacatcgacacacaatatgcatgcaggggtttatttgtattcatgttatcagaagtgcgttgcaaaccactaggcagtaatatcctgacgattcattaaccgatacattcatacaagatatgaatattattggtatttgcaataactaccttctatttagggtttatggaacttatatgaaaagttatcggataattttctattctaattacatgttcatatacagtccaattcgctatcttttgaatcatcaagaccaaatttgtgtatagtaaaatatgcagccacgcacagaccatttactatgtcttcaattaattatttcaaaatttagataaataaatatgctactttctggaattagtagttttgaaatccaaaattgtagataaaaaaatccacctgatatattttatggttttttttgatcctataattctaaatttctggatatataccaagctgtacttggcattgagtattaattgaccgtttcattatttaataattccaaaattcggaattaataattatctattgacttcacttggagtctcatttttagtattctattggtttaataatttcgaaatttgggattaaatgtcgcagtcggtttggagtcttaattttaggacactattggtttacaatatctgcgagttgtatctgtcatgaactctttgtttaatctaaaacattatgatctggtcccacgattcttggatggacagatccctttgttgttctccaactaacgtgctaatttcttggggatgcttaattagggtacttttgaatggaggttgtccacctctgatttctttatgttttggcactagctattgcgatctatttagtcctatatctaatctgtattctaacttcctttaggactataactttcttgactacaatgagaaagttatagatgggttctatgacatatttggactttccggggagtcggccaggcagggaaagatgccatcgcttgcagaacttcagaccagcattggagatcttggctttgaagtgattgtggtcgaccataagtttgatagtgccttgcaggagatgatggaagtagcacaatgctgcatgttgggctgtcctgatactacagtattggtgcgacgaatagctgaagttgttgcaggacatatgggtggtcctgtgatagatgcaactgaaatgtttacgaaatggttgggcaaaagcattgagcagaggacatcacatcagacaagcctgctgcctataggccgcattgacataggcttgtctcggcatcgtgccttacttttcaaggtcaggtctctccctttccgcagatgtgtggagtggcaactaccaacttttcaattgatttattggttaacatgcctattccaccaaaaagaaaaatctaaaccatattttttgcattgatgatcggcaatttgctgaggatgtggaacactatcttatatacatatttttatcaacatattgcatcatcttatcagtatgtttggatcttgtaatctgtttactgtcttacctgctctcatgtgttggtgcatcttatgtattctgccatactgcccagtacagtggattagactgtgagactgtcccatcaatgcccaaaatgcagtatcagttcgtatgttataagtaaagtgcactgttgctctctaaacttacacatgaacttttgggtcttgaaactctaggattgcacatttatgccctgatactaaaggcattgatctttcttaagtgataaaccttttgatgtgatacctagcattgatcttggcagtacttggcataagtgggtcaataaaggttcagatccttcttaagtgataattatagatgatgtgatacctagcattgatcttggcagtacttttcaagcactatgtagacaggcttgtaaatatcttgatgtttaaagcaataattatttatcaatgcttagtatgatgtgtgaatgaaattaacattagatagccaaatctgacgagagaacatataatgcttttgcataattatgaaatcctttccacatgtcttcgcagttagcttacaatcataacatgctctctcagttcttatgcattttcatgcagattcttgctgacagtgttggtattccatgcaagctggttaaagggagccattacactggtgttgaagatgatgctattaacattgtaaagatgaataacgaaaggtatttccatgtctaggcattattagttgttcatggaatcacatttctactatctaataatctgtaaatttcttattcatccatttttactttaaatgttatacttcaatttgtttcttacccacttttttttttaaatcttttttctgtgttgtactgtagggaatttttggttgatgttatggctgccccaggaacactcattccagcagatgtctttatttcaaagggtactccattcaacttgactaaaccgttggtgcagaatcaggtggttgaattggcaagtaacattgaaaatgacccaagtgcagctcattctgagcatgtaggcaaccgattgcatatgtttggcaatggtaattcgttgtcagaaaatcaatcagggtgtgaaaaaaccatgatagctggaagtgaggttagtcaactctggacattggcacctcagatgcaatctgatcaacaatcaacttctgctggcgcacattcaatgcagaaagaggacttgaaattaactccagactctcaagaaaatgaagagtctaaaaagcaaatttcagagactgattctttcaggggtattgaactgggtaaaagttcattggcattcaagggattaaacaatagaaataatgaatatcaaaggcatagagagaatatagctccagcacctggaagatctcaacaaccattggtgatgaaaaactggtcagcttgtaatgacatttctaacaagcaatacaatattgctgagaggttagttcgtcggagaaacactagcgacaatgctgcatcgtcatctcagttggcctggtcaactgcaaagcattacaatcccaatggcagagagcgtaatgataggttatgtgcagcaccaggtcgtaattatgacaatagaaaagttggtgcctcaactacggcaacagcttctgccactggagaacgcctggatagaccaaacctggcacctgttcattactatgatgacaaaccgaatggtatttcttcagtgaatgcagcttctacatctggaatcgtgaaggttgcagaaaagggccctcatgatctggaaaaagttcccatctattctagatttgacagtcaaatctatagtagtatgcaagggtattctccagaagtgaaggagaacaaggaaaactatgataggcatgacaacatgaggttacatcctgatccaagaaggtcccctctagacagattcatggacacatcaaggcagaactcagaatctgtttctccaccccaagctgggtcaagcaccgttgacatggtgttgggcgaagtttctgaatgtgaaatcctctgggaggatcttctaattggtgaaaggattggcctaggtacacaactgttcttttgttttatctgtaatatactaattcactcattgagctgattgtaggttgcactatcccttgtcataaaatgtaagaaatattcactagcattactgcaaaaaataatttttaaaaaattgcactgttatcctatcataagcatgtgtttttggagtttcttttgtgcattaggagctcttgtgttgctatatctttaaatatatgacaattaaaagagtttccttgtaatttgtaggttcgtatggagaagtataccatgccgattggaatggaactgtaagtgcacctatgtcaaagaatggtctatgtctgtgatgtactctgggatccgctatcaaataattttgatggagccccttcctgatattaagaaagttcttttgatatcaactgatcattataattaaaatgtgacattttacttatttacaggaagtggctgtaaagaagtttttggatcaagagttctatggtgatgctttggctgaatttcgttgcgaggtatgtgaacattttatgattttgatttttcacaaacttaatgttatattattactgttatttccgcttgtagtccctgaatcatttgataattctcttttaataggtgaggattatgcgccggcttcgtcatccaaatattgtactctttatgggtgcagtaacacggcctccacacttgtccattgtatcagaataccttcctaggtatagcaagtttgtgttttcaaataaagtaggtcataacatgtgtagtcagtccaatatgacaccagctatagccgtacagaactacagaagtagtaatgcagtgttgcattcatgactaaaactaaatgaaaagatgctcattatgatacctgtattaaacacgagttgttattgctgactagctttaaaaaaatgggggctatactatatgaatgttcaaattttcacagacaaagtgctctgttaggttaggctagacctgttaacatgagtgttatggcatttttttttgtcagtattggatcaaatggttcgtgtttcagcaatgactttaatcaaattgttatttctttttaggggaagcttgtatacgattattcatcgccctgattgccaaattgatgagaagtgcaggattaaaatggcccttgatgtggtaatggttggattctgtattttcaattttatcatcatgtgcatgcccttattatgatttattcactctgcaggccagaggcatgaattgtcttcatactagtgtaccgacaattgttcatcgggatctaaaatcaccaaacttgctggttgacaataattggaccgttaaggtatctatctgctttcgagaaccaaagcctgaaagcttgttgttagctaacaaattacatttacaggtctgtgattttggactttcacgtttgaagcacggtacatttttgtcatccaaatccactgcagggactgtaagtaattggcattccgactagaatgattctttcctcttaaagttgtcgaaagcttcatgtaccctgtcttaaaatttatggcttccccctcttaacagcctgagtggatggcaccagaggtattaaggaatgagcagtcaaatgagaagtaagtgatttttaacaccattttcaattgtttttatttgctactacctccatcccaaaatataagaagttttggggttggacaccggtattaagaaaataggtgaaattaaataggggaatgttgcgattaattgaaaagaggaagtaggtggagaaattaaaagataaaatgttgttattggttgagaagtgaatctagatggagaagttatgttttatgacaaattttaaatgctagaagctgttatatttttggatggagggaatatttttctgcttaggatttactgtaacaaatttcctgtacttcatacatgtttagccgagcttaaatttcactctctacctaatgaggtttattctatagactaatgcaagcagttatttgacctatatggataagataccttgtccgagtagataagccatcacagaagttaggcttaattgaatataatctattctgcgatgtctctatgtggagcattttgtggttaattgataattgattatattttttttagcttcgtgtgacttatcctagcttctagaacccgtaccatctatgtcattcattttcattgaaattgaaataggatattggcaacctatacataatacaaactggatagaaatgtaatatggcaggctttgtggattatgcggagctgctaataagaatgacaacaatttgaatttttagtttaattacatctaccatggaatgttctgaaattcatttacttcatccctggtgcctgtcatgtcaatgccaaggagggtgatgaatttgaaatgtcatgcaacatgattgtgctccattttttcatactgactgaaccctctatccagatggctgagggtgccattgaatggtgtgactgcggcacatgattctattcctgctgcacatagtaaaaaccattactaaatatcaattacaaaacaccttatattgtcttgtagagatcacatctgtcctatgcattggcatcatctttttttagagaaaagactccattggcattatcttattctctctgaagaattcaagttgaatttctctccggcctttatttctgttggcacactagacaacacattgacaactgcagctaatcgtcgttgagagttttgcaggtgtgatgtttacagctttggtgtcatcttatgggaactagcaacactacaaatgccatggagtggcatgaaccccatgcaagttgtgggtgcagttggtttccaggatagacggcttgatatccccatggaggttgatcctctagttgcatctattatacaggactgctggcagaagtgagtttttattaaaaaaagacatgaaggcttatttaagtgttttggttaggagggatatgaagccttctattctttgttgttaactttacattgcagttgtactaatacatgatttatctctgttaccattttcactttcagggatccaaacttgcgcccttcttttagccagctaactagctatctgaatacattgcaaaggctagtaatcccttgtcatcaggagacagcgggctcctatgtaccgcaagaaatatcgttataccggtgaaactctacccatgaggtcgtcatacagcaactgtgaataaagagcaattgtgattttgccgttacatttgggctcaatagtctgcaaaggcatggcttggtttagagccccagttcctgtccagatagcagtcatcctgctgttgcaagataaaaaggcttggcagcggagtatgtgtacagtataggtcgatcagataaacagtcggagaagaaaatcaaatgtcacctgtttcctttttctttttcatgtgccccccatccccattgtgtcgtctgaactgtggagaatccccaaaaaaaaaaatgaaagaagaaaaatgtgtaactgtatggacgagtttatcttataaagaagttaatagtctggaatattgtgcatatcgcgtgcctgattggtggcggctatgtttgagaaatagatgttgctagtatatccttggagtaaattgaatcgtcggtacacgaacttgtcagatagtgcaatctagtatatgaacttgtaaaatgctcactttggtatatgaacttgtctagtgcgtgcggaggaaggcgaaaaggacactacatggctaatcttattgattcagaggccgattaggatactatgtaaatatatatctgagagaaggttgctattagatatacacctcttcaataaaatatggctaatcttattgatttagggctgattaggatattatgtaaacatatatctgagaagattgctattagacatacacctcttcaataaaaaatagagtaggatatagcgatagtagaaaaagattaaaaaaccaagcaatgatataagggttagaaatataccaaattcatcttttccatgatgaaagataaaactagagaccaaatttataaatattgcatgtcttatgcatatttactacacgtatgcacgtcatatcttaatcaacatcagcttcgtaaaattaacattgccaagttatttttatcttcgtttgcactaactagataagttcgttcgtgtactgaaacaagcattttacaagtttatgtactaaattacacccaactaacaagtttatgtaccaccaatacaatttactcatatcgttcatttacagcaggccgaaaagcgctcgtattttatcgccttctcagagtatagcatcatgctgcatgtccaagtttcagatgttcatgtttaatcaacaccttgccctcactgtcccatggtaatcacaggggcaatttcttgaacagttttatatcgacccatccagcatgaagcatttttcaaccaggaaaagaacaaaggtaaacacatgcttcagttgaactagaaggctgtaatgcgtaaatgcaccagcgcagaactgcagacgggcacattaggttt

SEQ ID NO: 658 - DNA, 10175 bp, Oryza sativa
gggccacctagtccaagcaaacgggtcgatgggccctaactcagaaaggccccaagtacggccccctagttctaccatgattacctttctctccttttttaattaccatcatcactcaggcccaggtctgtctccaactgcaataccgcaattctcgcctgcttccaccaaaattcaccggtcctaaaccccaactcgtttccaactccatctaaaagattgaatcctctccgtatcaaaacaccaatattagaaacacacttgctacagtgttttgcccccgcgcacgcttttcaaactactacacggtgtacttttttgtaaaaagtttctatacaaaagttgcttaaaaaatcaaattaatccatttttttaaaaaaattagctaatacttaattaatcacgtgttaatgaaccgttccgttttccgtgttactgtagcgcgctgggaaaacgtccaaacgaacacagccttagaaacacacaggaacagaagagaactcggctgacgcctgcgaatcctactcgttcgtaccgaacacgatcatcgcggttgctgccagatataaaacgcaacccacacccgttttgccgagtcgagtcgagtcgactagtctcccgtcccgagcgcacgcacgcacgcacacgcctcgcaaccaggcgagcgaagcgggcggccgcgcgagccaacgccagccatccaattccgcctgatctgtcctccttgaccgctcaaggttcgctcccctttttttcccctacttttttcccctaaatcccaaaaaactaacaccaataatataaaacaacaataatttagattcaatcgaattttagagataaaagatgagataaaaaataaaaaataattctgttattattcagtacagtagtagaaggacaagtcccagactatatctgtttttttctctctctctctttctttttcattgccctgtttggtttcgtatcgtatgcagctagactactactagaagcccccgacccctccctcttctctttcgcttcgcccccactcttcactcccctccccacccccacccatcaatttcttcgtccgtctcgtgttaagccgcccctccactggcgacaaccaaaccctaggccgccgccgccccgggaggccaccaggtaaagcgctcgttcgtccatcccctccggcgagggccgctctctttgcgcggcggcgggattagggttcggtttggtgttgtttttttgctttgtatgcggattggatttcggggcggcgatttatttgggtgtttggtgtttggtttggatcagggggaggaaaaaggaagaggaggagatcggaagtgggagagggatttatgtcccagcgaggggacaggggcgaggggcacgcgaggagacccggccggtccagcagcttcggcggcggccaccgcggaggcggaggagtcggcggcgcgggcaagggcggcgggggctcctccggccagcctcccctcgcaactaaccgcaggtaacgattgattgattgattgatggattggatgcccccccatgatttgatctggggacgagcgggctccgaggaaaagctagggttttttactggacttttggatccgattgcagcttcaggaagtccggcaatggccatggcgggcaccagagggctgtgagccaacccgacacgcacggcttccagcctgcacctgccccgaccgctctgcagacgccgccgctgcgcccgccggcacctcagaatgcgccggcgcatgtccctgttcccgcaccacgtcctcagcaccatggtgatttatcggcctgttcccttatgttggattacaaattagaacaatgtgaaaaaggcgtcttttgatgtattggttttggtgatcgcatgcatttcttgaatgagcagatccgtctggagcgcgagcacccaccctaccaccttccagcgagaacacggccaatgcgccaccactgaaaggtattcctcatgccgctccaagggcaccatcaaggatttcaagcacgtccacttcacaaggagcaccaaaaggtttggtcctcgtaggggggttgtttgcaccttgtaattgatatccatggtatactactttgttaactgcctgctgccactcttctttacaggtggagcatataatcttcagtttggcagtttcccaatgaatggtggaactggtggtagcacaatggtacgctcttcaaccctgttcttgcagcttgcagttcttatttcaatttggtctagtttctggttctttttttcaccttttttctaatttccaaatacttttgcatagcaattccctgccaggacaagctcagctcctcctaatttggatgagcaaaaacgcatgcaggtattttctccttcccttggcctttaccattattgtttctctgctttatgttagtttaatttggtggtattggctatgatttttagtgcgcttttgttagatatatcgataacagtatgttgtcaacaaatgcaccaaataatttatgctcctatgtataatatgctttcaggagatttgagcaagtcatgcctttttttgcttctattgttgatattgtattgataggtgttattaattttcaatattctaaaagaatgtattattgtgttatctttctttggtgtttaggccctccctgaaggtcataaggttgtaccttctgggcttgttccacaagctccaaaacatcagcagcaacagcagccgttgcagcagcagaagcaacagccgcagtcacagccaccactgcagcaaacaagaaaggatgttgttagttctaatcattcatcgaaacctatcaaccctcacattccttcccaagttaagagctctgtgcatgtctcaccatccgtgcccaatgttgcaccaccaagaccccctgttcagcagatacctgggatgcccatgtcaatgccatttcaccaccaggcacccttgcagtttggcggtcacaacccacaaattccaccacagggagttgtgcccagttcactacaaatgtctatgggattgcatggcgccaacgcaccccaggttgcacagcaaatgtacatccctaccattcagcaccatcatcaactgcaaccgccaacaatgatgcatcaagcagcaggtataccttatggtccagctgctcatcaactcactcagatgagtggtatgatgaatgtgggggtggcacctcagtttactccacaacagccaaataagtatgttacaggcccaactcggaagaccacagtcaaaattactcatccagatactcatgaagaattgaagctcgataagaggatggactcttctgggcaaaggggtttacctagtgtacaacaacaatcccagccggtcagtacttatggatctcctatgggcttctaccagcaaaattcgtataaccagtcaactatgttttaccccacaacctctggtgtcggtcaggttcccactgtatcacagggtcctaggtttgtatccacacaaacagtttcatacatcagcccatcgatgaacacaggtcctggcagtaacaaggacaacctagcagggtctacaacatctggacactcccaagtcacaggcaaaccacacccagctggtttgcacatggagaaatccggggtacaaacggtcacgataagtgcgccgcctggtaaatcagatgtgaacaagttaaaaccagctgaagatgttgtatcacatcgacaaaaggataatgaagctgtttctggggtccgtaaatcaggtgaaaatgagagcaaagcttcaccgatcacggagaagcatcccacaccagtgagccaacccttacaagctctagctgcaaatccagaaactacagcagctgcatcttttgttgtgaattctgttcctggagatgatggaaaaagcaaagaatctattcaaagaactggatcatttaaggatagcaataagaacgccactaaggacaccaggaatttatcacaagaaccacaggtagtcctgtaaaatattctatttttgcaattttctgttgttttgtacgttttgctcaacagcttatatattgtttcgttcagtcagcttcatctgctgaagatttaaaggtgcatacttctgtaaaggatgtatgttgtggtgttagtctcatggaatccaagggtgtgaataaagagtctgaacagaccaatgcagcttccgcttcaccgactgaaatgttaaaaggtatatgcattatgcactttgaaaatcaatgccaaaacagttgtattgtgttgctttgtttaacatgtttgctttggcagctgctgatgcttctagcattgataggagctctgcaagatcgacctctgagagcactgagaatgttcaagaagtaggaaaatctgatgttgctattggtgattctgagaaaagtggaataactaacaaagtttcaccagatcttacaaaggatgatatttcttctggttcaactgggaatgaatcacatgaagtttgcacgctagatttggcggagcaattacctgtgggagcttctaatcctgataatttagatactgcaacttctgtaactgaccagggacagcttctcaaagaacccagctcatcagtatctgatgagaatgttattatggacagatcgcatcagagtgctgaaaaaatgtcagatttggttgatgacactgttgcttctgttgccagttctgaaactttgccagaatctataattcaaaatgccaatgctaaaggtaacacaagtggtaatcaggaaacagggtctgctacatctagcaatattcttaatgtgttgccggtacctcattcagtggcatcagaggatccactgaaaccagaaagtatgttaaaggatcaatcgagtagtgcaccagcagcctctgctcgaccagtttcaagggaaaaacctagcgtggaaattaccagaacaaagtttacagctgtgaaaaagaagaaaagaagagaaatgctttcaaaagctgatgctgccgggagctcagatctttataatgcatacaagggacctgaggaaaaagtagatttcattggtgcctcagagagtcttgatagttcttcaattgctgatcatgagctaccagacgagtcctccgaaaaggaggttaatatgggtgaggacgagggaaagaaaaaggttgagcttgatgattgggaagacgctgcagaaatgtctactccaaagttggagaggtctgattccagcaatcaaacaaccgaagctaatgggaggaagagatattcacgcgattttttgctaactttagcacagagttgtactaatcttcctgttggtttccagatgattgagtacgccagcgttctgttccctaatttggccggaaagtcttatgttgttgatcacccaagtcctggaaggggagctgacaggccagcatctcgtggtgatcgccgtggtgttgtcattgaggatgatagatggggaaagtcgggccatctttttggttctggtcgtgatatgtccatggacaatggccctccaactatgaatcaccgtggtgctccaggagttatgaggaatccacgaggtgggcttattaatgtaggaccggttgcacctcaaatgtctcgaagtggctctgatgcagatagatggcagcagaagggtatattcccatctcctgttacacccatgcaagtaatgcacaaagcagagaaaaaatatgtcgttggcaaagtttctgacgaggaagaagctaagcagaggcaactgaaggcaatacttaacaaattgacgccacagaattttgaaaagctttttgaaaaagttaaagaggtgaacattgacaatgtggcaactcttactggggtcatttcacagatatttgacaaagctttgatggaaccaacattctgtgaaatgtacgctaatttttgtttccatttggctggtgcactgccagattttagtgaggataatgaaaaaattacattcaagagattgcttttgaacaaatgtcaggaggaatttgagaggggtgaaagagaagaagctgaagcagacaaaactgaggaggaaggtgagattaagcaaactaaagaggaaagggaagagaaaagaatccgtgctcgaaggcgcatgcttgggaacattaggttgattggggaattgtacaaaaagaggatgttgacagaacgcatcatgcatgaatgcattaaaaaattgctgggaaattatcagaaccctgatgaagagaacattgaagcactgtgcaaattgatgagcacaattggagagatgatagaccatgcaaaggctaaggagcatatggatgcgtactttgatataatgctgaagctttcaacaagtcagcaattatcttcccgtgttaggttcatgctgagagattcaattgatctcaggaaaaataaatggcagcaaaggcgtaaggtggaaggcccaaagaaaattgatgaggtgcacagggatgcagctcaggaacgacatgctcagtcgagtaggttagctcgtggctcagttgttggttctggtccaaggcgaggagctgcacctatggattatggtcctcgtggctcagcagcagcattggcttctccaagttctcagcaagttggccatagaggaatgccttcgcattcccgagggtttggtacccaagatatccggtttgaagaaaggagtcctttggaccatagaacaactgtccttcctccgcgtaaggatgaagccatcactcttgggccacaaggtggcctagcaaggggtatgtctataagagggcagccactgatatcaaatgctgagctttcttctgctgatagtcgcaggatggtatctggtcccaacgggtataattctgcttcaactgcaagagaggaacctggctcgagaattcctgatcgctctggaagaatagcaccaaatacacagtttgctggaccatcgaacaggcctgccagccaagagggccgttcagggaataaattatactctgaggatgatttaagagagaaatctatttccgccatccgggaatattacaggtaatattttgtagcctctgaattttcatacaaactatttcttcatttttttgccaataactattatgtttgttacaaattttgattataataatgacttactgtcttcttttggcaactgctagtttcttagggtgtgttctttaccaactcttcccaactagactctcattttctacgcgcacgctttctaaactgctaaacggtgtttttttttttttggaaaaaaaaactctacaggaaagttgttttaaaaaatcatattaatctatttttcgagtttattttagctaatgcttaattaattatgtgctaatggatcagtccgttttgcgtgcggggaggtgaagtttgcaatctccacctccgaacacaaccctgtttcgcaattattttaggcaactactagtgctttctagtttaaatttgtcacttctcattatgtggatttcaagtctgctgaggtacccttgtttctgacgttggagtactgggggtttatgaatgctggaattcaaacttaagacttaagggatagacaacattcttgtaacgttgagccagtcacaagattggagggcaattacaacttcttttccaattaattttaatcttgagatatctattactgtgtactttatttaggaagctagggtgttgttcttggatttcagtttttattgagtaacattttgttactattactaaaaaatttagaggaccacaagaacagtttattgtggtcctctaaattttttagtaatatatatgagtcctctgcattgtgtgctaacatatatacaactatttcggcagtgcaaaagatgagaaagaggttgctttgtgtattgaggagttgaatgctccaagtttctatccctctgtcgtatcactgtgggtaaatgattcttttgagaggaaagatatggaaagagagttgttgacaaagcttttcgttagtctttgcaacagtcgaaataatttattgagcaagtctcatctcactgcagggtaattgtttctcttcttttcactcctattgactctacttttgttttttacattttactgtatactgaacacatggttacttccagacttgcgactgtccttggttcattggaagatgctctaagtgatgctccaagagctgcagagtatcttggacggcttcttgcaaggtttgtggtagaaagcatattgtccttgcaggaggtgggtacattgattgaaaaaggtggagaagaacctggagagcttgtacatcatggcattggagctgatgtccttggtgcagttctagagtcgatcaaagtagaaaagggggattcattcttgaatgaggccaaggcaagctccaacctcaagttggaggattttagaccacagcatctcaagagatcgaagttggatgccttcatgaaagcataaagaagctttgttactaggtaagtcgggtgttctataatggctcatccatagtatgatttagatctatatgtcaatcagtgctttattgagattgtaaaatcctcaagttctaatatactgttttggctgaacagcttaccgattcatgggtgttggcaccatggagtttttggcatcagaccagccttttttttattgacaactggaaaggcccatcagatgctgcccctacttggcatgcacccattaattcttccaggagctcatgctgtgtgaattttcttcatcctgttcagagttggttctgatggtaaattatggaattgtcctcgatgtttgttgccaatagttagtcccatttcgagtcggccgtagcgagtatcagggttatttttttgtgatcacaggggggagaagtctttctaaccaatgtttgttgggagtagggagaattctaggttcacagcttgatgcctcccgtggcttctgaccaatatttcattgtgataagactttgtagttgcttataacttatcggcattttcctgatagccaaatgtttcacatgactcacctaccactgccttttgtttaaatcttgctgtacgtatttctgtcgctcttttacttggtatatatgtttgtgtgtatttcttggacctgacgtccatccgatcatcttgtctgacgtgtaaacgggcctcgtttgatttatgtggtgtagaattgttgctgtcccttggcaaattagaggtgatctctgtgtctcctttgcgtggatcgcactatttctgatgctccaacgcgaagggaacgggtgcttacacagtttgaggtattggtggaatcgtagattatttccgaaggatcgttgttgggtcatcttctcactctgtgtactcgtgaattggcatccttggaggtacttactccgttaacttattttgtgatgatgtatggctgagacttcatttctaaatccatgggggtatgataaggttttctgttttctccaattcttgtgatgttattatggtatgggtgtgtttagttcacgtcaaaattgaaagtttggttgaaattggaacgatgtgatagaaaagttggaagtttatgtgtgtaaagttttgatgtgatggaaaagttagaagtttgaagaaaaagtttgtatctaaacacggtctggtctatataaatacgactatataggtgcatcttgtagacttttatggttgctttagccccatgtaccgcctcgatcactctcccacctaataagacatggctaaatttaacacggtctaaaattaatatatgtgactttaaattttttatacactataatattgatataaagtcataatcatacaaaagaaatccaagtgttaatctaatgatgtactcccttcatctatttttgatagtaatatttctaaatctgaaaattttatttttgatagacatattttaatccaacaacttatcatcttaatgactttctcggatttaatgcgtgactcttcattctttcacataaaattggctacatgagcattgaggattataaatattaatgaatcgcttgtttacgagaaatgactagtagcatgtttaaatggatgataaatagacttacttatccttggtctgtgtgccaag

SEQ ID NO: 659 - DNA, 4596 bp, Oryza sativa
atagtctaaagactcggcatggtcagtctactctaacgtcattgcttagtatttttgcttaacattgttaacaaacacttgggaaaaggagctctgcccaacggaagggaaggtatccccatgtgcttgtgtcattggagtagcactgtgttaattattagtgtggacgctgatgatgatgtccgatgttgagacaattttcgatcatctagagactaccaactcttttttcttcttttccttcggtgctacgaaaacgaaatcaaagatgaatgtctccgtgacacatgggcccactctaccatccgcaagggttccaaaatccaaccgcaaaagtcatctggaatgttatgtaggccgacgcaacaaaaggaaaggcgcgtcacggcgtcagacgagacgacgacggggctcgctttcttcgaaaatctgcagcacccgacgacgcgcatccctctcacgaccacgaggaggaaactacggccgcgaatggctccgctatcagtaggccgtttctacttgccaaactggggtgtactatgggcatgtttggattaaagccaatttttgccctaccaattatttagtagttttgaatagtgcttgttagctatttggattgaggccaaatcttaccaattcaatagagttagaaacaacataacccaatcaaaattccaaaatttatccaatatttgacattaccaaaattttggtagggtttcaaaccaaaacaaccctatgtccctgtgctgtgacgggagaaatagggaacataggaggggagcgtgcgggatccagtcagcaccgccgccctcccgcccggttgcttctcccgtccaaaacaagcggacggcgacccgatcaaacaaaccttgtaccggtagcgcgtaagcaaggccaagtcgcacaaggccgggtttggattgtagtggagtggactgtgcagacctactcgactatactactactatataacaggaagaggaccgaacggagaggcgataaggagtaacgagtccactttctcaagcgctaatctaatctacttggggcagtggtaacagggggaggccaacgcgggggaaacagctgacgcgctccgctccgttccgctgccgccgttggccggccgggcggtcgctgttgctgacttgaccagagacgagcagcaagggggcagttggattggattagagggtgcttttatatagaggagcacgaggaggaggaggaggagggccatcaagcatatccatctccgattcacagattctttctggagatccatcatccagcgagagcgagagcgagagggagaggaagagggaaagccgccaccgccatgttggggcatctggttgggctggtgaaggtgcgggtggtgaggggcgtcaacctcgccgtccgcgacctccgctccagcgacccctacgtcatcgtccgcatgggcaagcaggtcgggacttgcacccgctctttcttcttcttccccttttcaccgctgtgttgtgttattttattttggtccagaggtttatcgtgttcaggcgatgtctgatttgtgaatttcattttttttattctttttggctggaaagaggtgaacaaaaagggatcttgttgaatttcaatctctctctctctctctctcgccatttttctttctaccctggttaattgttcatgtattgtgtaccttttgctgcttgtttttttttattgttcgcctgctaactatgatgatatttgctaacatttcgcagaagttgaagacacgagtcataaaaaagactaccaatccggagtggaacgatgaactcaccctctcgattgaagatccagcagttcctgttagactggtatatatcccctttccttttcacttcgcccttttctttcttgttgtgctacacaaacaaataaaaatgaaaacttcacgagtattttcttactatgccatttctcgggaaacaatggataataaacattttggtatttaaagtggattgtcagttggattgttatactgattggcaagcgtaatcaactagacggccacatcacttcaaatgctaaaaccaagtaggaggagttgtaatttttatagctagctctctatcagacgccattctaatcggactaaattatctgttctgcatacaagcaccaaatcttgtctaagtaatattcttacttcttatttgcttgagtaactgttaagcaagggactaaatctgatgttttcttgttggtgaattgaaatatagcaaacatttatttatatatatcttcttgagttgagtatactcctacctgcctccatggctgaatttagaatattaattttctgaataaagactaattagcactccatcagagtagtacaaggctcattaatatttaccagaacaagtagatactaaagaatattctgatctgttggagatatagtggctggtcagaggccgctaagtggctttaccaataccatggtcaggctaacgccgtcctctctaaggactgttttggattgctactgaaatgtgccctaccaatattttggtagcttgaataggagaatattagtatctataataattcatttaatttgaagccaactatttgataatatctatactaaatttggtagcaatctagaatattctccactatagtatcacaatttagctctacgtttggtagcaaaccaaacttggccaatataaacttaccctaccaaattattggtagtgccaaaacttgtctagattttggtgctaccaaagaattggtaggatagtgaaccaaataggcccaaataatatgatttgataaataattctttgaccaaagagtggttctgatatatagttatattttggtcctgaacaggaagtgtatgacaaagacacattcatcgatgatgcaatgggcaatgcggagctggacatccgcccattggtggaggttgtcaagatgaagattgagggtgttgctgacaacacggttgtgaagaaagtggtacccaatagacagaactgcctagctgaagagagcacgatatatatctctgaggggaaggtgaagcaagacgtggttctcagactaagggatgtggaatgcggggaaattgagctccagcttcagtgggtcgacatcccaggttctaagggtgtatgaactctgtactctgcctattgcttacagtcttgcatagctcgcaagtccaactctaagtttatcagtggacaatcaaataagcaacagcttatattgatgagattcttttactgtccttgaggaggcagatacctcccagtgcctcctcaatggctgtaaaatcattcttatgttgacacagcaagtgtctcgaagatcccccactaggtgtttgggcagagcaaagttgtacaatatgtctgcaaagtatagtttggtgttaccctgtctgtagaaaaataatcagtggcaggggttgtaactattgaaactttgtctgtctttcttcttgtacgccaaagaccaatgctatctgcgattaatcttcctagctttcatgcaaaatttgattgtggatggtcagccagtttacatgcaattttgccagcaatcatgtcatgttatgtggagaacatgttagtgctattggtctcagcattggaataactgcagtcaagatacactacaggacgaccattttactagtggtaaatttagagttttgaactaggaacatccgaacagacgagtataagacagtatgacacctaactactgcagacacccttcacaatatcaaacccgggtcaacacatgagacggcaggacaataaaatcagtggtaatacttagaaagttaccttctgtttcatacgtatcaaatcatacaaattttaagactggccaaattgtataaaaagttagtaaatatctataacaaacggtggcgctaattagcgcgttgggagctactagggccgtgacgcgcctcatctgtccctccggttttcttgttttttctcctctcaatcacatctcgctctctttctttccccccccccttccccctcccattttctgtttcatcgaacctacttttaaattttccctttttgtcaccttcgatgcacctcccacatacgggttaaaaatttaccaccaaatatccacgagtagaagagttattatcactctctcacaattacaaaattcccttctttgtacctcccacctatgggtaaaaaaaaaaaaccaccttctcatttcaataagtaaaagaattaccagcttatcacgagtagaaaattgtttcttccctttgatctagagtaaaagaattaccataaatgtcaagcaaacgtgtggttcagttcgtttcatatgcaacagtaattaatagtaatttatttactccatttttagctctatgtcagcacaatatttgcattagtaactcatattaccacgataacttctggatagtatcttttttaccctaattacatgtcaaacacagtactttttgaatctttgaattataaaaataaaaaataaaaaaatcggcagcaatatgaaagttaaatatgaaagcgt

SEQ ID NO: 660 - DNA, 6415 bp, Oryza sativa
cgtttcgactccccgattcggcgattcgctaccggggatccaaatccatatccacggcgtttgtgttcgtttaacctgcaacgtttggcaccgttcgaacgtgacaccgtcgatctgtcagttactctcggtgtcaccgtcaagaaactacggtgaagttggaatttttttccatttttaaattttttatttttaatatttatagaaatattgtaccggcgaaaatttttacaaaagtataccctgccgagggcggcagtgtgacatgagggacgaacaagataaaaaaaacctagaaaaatgcatctttggtagggcgaaaattgcatttgcccctttacagcccttgcagaggacggcaagggacctcagtgcaaaatgcgcacaccttgccgtccttcacttgggcgacagaggccatttctgtaaatattttggatggtataatatttttgtaaatattaaaaaataaaaattttaaaatgaaaaaaattcggtgaagttgatgtgacatcgatgggccgaagacgagacggttttctgagccaggcctactactgggcgaattctggagaacggcccactggagtactctctgtctctctcccactggacagaccgggctcaacgcagacacggaacggagccagccatggtgaggtcggggcaggcgtcatgtgcccctgacacctgggcccccccgcgacatcatcctccagtcacgtcgtcctcctccacctcgggtccccaaccttttcaaccacacccacccaacacgccatgatgagggcagcagacaagtgggtcccaccaaacagtgtcgacgggtagatgcggctagcagccgtaacaatccgggcccaccttatcaccaacgcggagtcacccgagcccacatcgcgtgacctcactgacatgtggggcccagacggttaactgccggtgggaccacggaaacagagagggcgggggagaggtggggccaaggctccacctgtgcgtggaaaccttttggactgctttggtgtgcccagctttttatgggggcaggagcgcgtccggaaatagaaacatctcgccgaatttgaactccacctgagcacaggagaagccgcagccactgaggtaaactgctcctcctcgccgatttcccccctcctttttctctaataccaaattactcgagaaattgtgttggttcggtccgcgggtagcgtgattcggccagatctggcgtctgtgtgtgtggagaattcgagggttttgtttgggtttgtggggggagtaaatccggacgaatctgtggtggtttgggggggaattcggtgtgtgtttgagttgatttgagttcgtggatgattccgttggatattgataggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgaggtattgattgtttgtacaaaaataaccattttattcttgaatattgcattttcacatgttaactaaggttcttaagttgatctgactgccatgtacaatatggagcccaacaaggggtagtgacacatatttctcaacttcagtatgcaataagtcagtcattttatatgtttttacatgtggagctgcggataatgtgacaaacttatgtaatcgtgaatgatcttttgatgtttctctgtttttctttcatgtagtttgatataggattcctttatctggcactattgaagttttgttgtaaataatgttattcttgcaaagattatcttaaatcaatcatttctggatctgaagaggtattgtaacaatctgaagctttgcacaaccaattgcaactaaacttttgtatttcttagggtgaggacttgaggttggtgtgatgggcatttagctaactgaaatttctctcaaacctcacagatttgaccttctgtttctaccagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtattacaatagttcctggcatagcagtctttaatttctatttctttatattgtcaagttcatgtgtttgaatgtatgtgtttgataggtacctcgcagagtttaagactggagctgagaggaaggatgctgctgagaacaccatggtggcatacaaagccgctcaggtggtttccttaacagtgaatttgttgttgcggcatcctgtttgtttgtttgtgccattttgcaattttgattcggggtattcagctaaagttatttgtgatgtgttctcctttggtctgttttgtttttctgaatattgttggtgataaaatctttcaggatattgccctggcagagttgcccccaactcatcctatcagacttgggctggccctcaacttctcggtgttttattacgagatcctcaactctcctgaccgtgcttgcaatcttgcaaagcaggtttaatttctactgcattctatttcattatttgtgaattggaggaccatatggagttgagaagatattttgaagtttataccattgttgtgaaatataatgtcttagtaattgggattgaacaaataacatgtatgaattagtaatacacctggaacaggttctacttagttctgttagcaaatagcaaagtgtaggctccttaatgcaagtaagctgaacgggttaggtgcattgtcatgatggattttcttcattaagaatacttgatagaaaatgatgaatcaaataagaggtgtaagaaattatagtttacagttacagatttgcccaccttgaatacttgagtgcttctaaataactgatgaagtccgagcatcactatggccattgtgacgtggaacaagcttgtctcaatatggccatcgttcattcatagaggcctaccagtttgttctgtaatttgttaataatagatatctgatgtatatagaatggtttactgcagacaagtttgctataagttcactgctttgtccatggatataattgatcttggacttggagcacacattatgtgccttactttatgaaacttgcttgtgctagtacttatatttgccatcataatagaatgtgacagtaacctactttatctcaggctttcgatgaggctatctcagagctggacactctgagtgaggaatcctacaaggacagcactttgatcatgcagcttctgcgtgataacctgacgctgtggacttccgatatctcggtattttcttcgccgctagcatatatatttgcacttgcatcatattgtctttggaatcatcttaaatgcgtaaattccatgtgtgcggcttcaggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtccacagtcctgccaagtgccctgcttgagtgtttttggtttcttcgatgtaaatcccgttgtgtgcacgatggttcttgattcaccacacattgttgtctacattgccaaaacgtatgcttcaagtgcccaaaaggccgaagcggtccgagaaacattattctgtcaggtatgtgtgataagcggtttcatatgcaacaatgctgtagggacccaaatgttcactggcatcatgtacagatacttgtagtaccaaaattagtttagcagatataagcaccagtggtgtggttatggccttatggattattacgcacacacgattatgccatcactagaaatttagtgactaagatttactaatgacttctgcgtccactcaacgtacaaatattgtagttttctagatgatttttttattttctataagactcatcaaaaaatattatatttgataggatcccttgaaatttttagttgtgtttttcatgagaatgagcaactaaacataactaagcataggggtgccttctgcttgaaaatttttatcattaaaaaaatggggttttcttcttcaagtttgaatatttaatttctttcttttttctacaacattttaaaagttggcactaaagaagacaattattatgcaaagaagataatacatctatttcaatcctaccagaatggaaagctctggaagctgttaaatctttttttccctttttttaccttgcttccagattgtggccccgacgatggtgtcaccttttctattttcttttacatttggagcttaagcatctctattgttttatttgagctccgattctagagacattcttagcatctagaaaatattttttattccaataatgtcattatttatttcatattttattatattttctttattttctttcctaatttttattttgcaatttttcagaaggtgatgtttattttagtagtagtattgttgaaggatctagatgttaccggtttaatttattgagaattagtatagaagtttctggagagactataagctgcaagaaagcttgagctctgtggcatcttttcttgctccatttgtgttttttttttcacaaaagagtctatcatttatcttggaagctagatgcgccaagtgaaccaatcagctggctggatctccaaccagctttagaagtatagctccgttacaggttataagac

SEQ ID NO: 661 - DNA, 4483 bp, Oryza sativa
agaaaaaaaatgtaaaatatgattaaaaatatataacctttttcttaattagagcatgtttgatgatgatttattcaaacttgatgaaaggtcttgaaaatcctacatatttgatgatgtatcgtggtgttaagtgaaaactaaatcattgaacctgttatagaatgaaagtatgtctaaatgtgtaaagcgaaacaaggtgcactttaccttgtgcaaagtacaattttgtcttaattttaacaatatgatatatgtttagttaaagtcataagtttgtttataaaataggattgttggtcaaactaaaacaatacggttgaaattgccaagtatcatgaaatggatgaaataaaatcatgtggtactagagggatgtgcatgcttgatttgaagacatagggttatcgaaataggtttctatacttctacattactactttagaaggacttcaataacagtggtagtgaatttgccatccaacctacttctattaaaagttttacaagttacacccttaacatcttaatagtactccaaatacatagccatatataaaattaatgtgataacatattctatggataatatgtttttatttatttttaaaaatattgtgttattttttcttttatctgtagtaaagaatgagcgtttagttagggtagcataaatgcgcagtaacaaaatcaatacagtagagtatgtagctatgtgtagcatgcatgttttacatctagtgtgattgtcttaatcttattacagagcccagtctcacgttttacatcttctccatctccacgtattgtgtgcaacaaaaagagaagttatgcttgctctaaagtcagcattaaatcagtagcatcaatacagagtggagtagcatcaatacagagtagggccatctgacaaccagtaaatgtactgtccaccgggccaaccccatcttcttgacctctatataatctcacacattcacacatctttcgctcacacaaaccaagctccataccgctgcctacatctctggttagtagccaccaaggtccaaggagtaacacgctccgtgagagaccgaaatccagggagcacaaattgcacatttgcaccaagcacactcgctgcagctgcagtgacatgccggaagcaccgaccgccaagacagcaccggcctacggctacgcccccggggcgcacgccgaggcgctcgagttcatcgagcacgtcacggcgaacgccgggcaggtgcagcggcgcgtgctcggcgagatcctggcgcagaacgcgccggccgagtacctgcgccggtacggaatccccgggtcccccgacgttgtcgacgccttccgccgcctcgtcccgctcgtcacatacgagggcctccagccagacatcctccgcatcgccaacggcgacacctcgccgatcttctccgggaagcctatctccgaattcctcacgaggtatagcacaatatataacgtgacatgttcatgcttccccgtgtgtgtacgcacgcacgctgctgcgtgcaaaacctagaaagacgtacgagttcatatctgtacagatcttcatgcaatggaatttcatcatgtccaccagctcgggcacgtcgggaggggagaggaagctcatgccgaccatcgccgacgagatgaacaggcggtcgctgctgtacagcctgctgatgccggtgatgagccagtcggtgtccgggctcgacaaaggcaaggcgatgtacctgctcttcgtgaaggcggagtcgcgcacgccgggcgggctcgcggcgcggccggtgctcacaagctactaccggagccggcagttcctcgaccgtccgcgcgacccctacacatcttacacgagccccgacgaggccatcctgtgcgtggactcctaccagagcatgtacgcgcagctgctctgcggcctcgtccaccgcgccgacgtgctgcgcgtgggcgccgtgttcgcctccggcttcctccgcgccatccatttcctcgagaagcactgggcgcgcctctgccacgacatccgcaccggcgagctcgacccggagatcaccgaccgcgtggtgcgcgacgccgtcgggcgggtgctccgcgccgacccggcgctcgccgacgcgatcgaggacgagtgcgctagggcgtcgtgggagggcatcatccggcgcctgtggccacgcaccaagtacatcgacgtgatcgtgaccggcaccatgtcgcagtacatcccgacgctcgagttctacggcggcggcctgccgctgacgtgcaccatgtacgcctcttcggagtgctacttcggcctcaacctgaatcccatgtgcaagcccagcgacgtcgcctacacgctcatccccaccatgtgctactacgagttcctccccgtcaattgcaacaatgccactgccgaggcgagccaccgcgacctcgtcgacctggtcgacgtaaagctcgggcacgagtacgagctcgtggtcaccacgtattccggtaaatctgccttacctcttcgacacataacgtggccgcgcgcgatggatgatatatattcttatatgcagtagtaatatatataattaacagttttgcgattgtgacagggttgtatcgttatcgcgtgggcgacgtgctgagggtggcggggttcaagaacaaggccccgatgttcagcttcgtgcggcggcagaacgtggcgctgagcgtcgactcggacaagacggacgagacggagctgcacgcggcggtgagcggcgcggtgcagcacctggcgccgttcggcgcgtcgctggtggagtacacgagctacgcggacgcggccaccatcccgggccactacgtgctgttctgggagctgcgcgccggcagcacggcggtgccggcgtccgtgttcgaggagtgctgcctgtccgtggaggaggcactgaacagcgtctaccggcagggccgcgcgtgcgacaggtccatcggcccgctcgagatacgcgtcgtggcggagggcaccttcgacaagctcatggactacgcgatcagccggggcgcgtccatcaaccagtacaaggcgccgcggtgcgtgcgccctggcccggtcgtcgagctgctcgacgcgagggtgcagggcaagtacttcagtcccaagtgccccaagtggagccccgggaacaagcaatggaacaaaagcaaggatctggtcggcaagggagacgcctaatattgaagctagagggtgatgatctgatcgagtatttgtgtgagctggtaattaattaacggtacatgcatatggtcattggtcgatatgtttctttagggatatgataattcatgtttgaattatctctgatgctgcgagaggatcgaatagttatgagatgacgacttagcctatatgatcatttgctttactctttctctgctgtaacgcagtatatgttatttcctccgtctcaaaatataagcatttttagtacattgataaattaaacatttttaaatttgactattaatagcaagaaaaataaaaaatcaatcatgtaaaattgatattcctagatttatcattaaaaacactatcataatatgcaactttttttatttaaaatattttatttttatatatattgttggttaaagtagcatcttggatatcgtgtcagggtttaaaatgattatattttaggacggagggagtaattagtagccgtattgaatagacttttctactcaaagatatgtctctcaaatttatgcacatcgcacggtgtgcatgcagtgccgagaatttattacttgtcaaaattgttggactactgctactgatgataaataacttgtcaaaatgataaactacatcaaatactactatagtagtatattataatcttcctttatactagtatatgctatctcatgatggttgacattaactttttcagttgctcatgcacatgaattgaactctgttgtacgcactagctagcactaccatattgtttgtttccggggaacatggctatcgaaatggcatgggttagtacaccggtgagtttcctattttaatcagactcatattgtaggcttagtttttacgcacttttgagtcaacagtccatcttttgagagtggcaatgtggcatgacaagtttgagtaattgagttagaaatatattgagattcgtgcagagctgtacaaacaagcaaaatatagttcgtttcctgttatccccatggttattttttttagttttattctagcaataaaataatttctttagaaaatataaataatggtgcagattacggctctcatcgtttgacttattcacggaataagccaaacggcatatttgcaaatgaaaaataatttgtgaatagaactttatatatgtgttcttagtgatctaaaagcaaaggctgaaaaacaaacctagatgaaaaaaccccaaagtcaactctaaacttaaggttaaaa

SEQ ID NO: 662 - DNA, 5667 bp, Oryza sativa
tatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccaggtgtgtatagtagtgctagctaacccaaacaatttcttttttcaattaatccggcctttcatttgccggctcggctccgccattgactccaactaattgtttgattagtttttggtcgttgcttggttgatcgttcttgcttactaattggcgtgcgtgtgcatccagctcggggacttcggcgggggagaggaagctaatgccgacgatagaagatgagctggacaggaggcagatgctctacagcctcctcatgcccgtcatgaacttgtgggtgatccatctctgaatctctggccattatcctactttagccatctaactgttttctttttctcaccatgcctttgattgggacgttttcttgactcccggcaacagttgaagctacctagctaagatacaagtagccgtattaatttctagcatgcaatttttaatcttcttttaataaaaaagaaagaaatgatttcttaatctagtgtcattgatcgatgcattagtttaaggcctaattaatctaatctacagagacaaacctaaacctaaccgttttccgtttaaactttaccatcgaccgatcaagaaacagtacgtttaatttttcatatgctaaatataatacttgggaaatgtaatgaccggggcgagcgagtcatgcgtttgtagccttggtgacctcacaagggtttggctaagaaacaccgcaacttgcgagaggtgtggctaattaatcattcacgttgagcctaaaatataatgtgtttgtgtcttagacgctagaggtgctgctgccttgggtgtctctctactttttaggcaccgagattccttttctaatttgtaagacatctaacgatagctagctagcttcctaaaataagattatgtagcagctcaaagtcgctcgcatacgtaaccaggaagttggagtgtaaccttacaaacaaagcgacaaatcggctaccggccttgttgcgctaaaataagctaagagaaagggagttttcagaaccattcaattagcttgaagcttgaataaacacacacgtaaattaatggtactaacgctcatgctcataaaattttatcagcattattacgtgccctgtgtcaatcccacattaatgtatcccagctgaaaggaatggtgcaaccaccggtgtatctctgttaattagccatcacaatgctaaatctttcgtacatctgatatcttatcataggttatgtcaacatcggcctgaatctttaattaatccggcatgcagaactcagcatcagtgggccatcaattacactgcatgatcattgttgatcccttcctgcttaacgattcaacgacataaccaaccagctgctagctgactgaatgactgtagtagtaaactagtattatagctagatagtactgtactagtgattaatatgtttatctcagattaaattaactaaaggtaattaaataaaaaaatgacaggtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgaccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgttcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctaccaactacttctgttgacccatatgtacttttttctgcttgtgcaaaaatgggagtgaactagtgacactgacaccccaggaattcaaccccactcatgttcctccatgagagtatgtctgttggtacagcgtcacccatgtctgctaggatacactacttatagtggagtatatgtttaaatcgctcttattattctattactacagcatgatcctttctgctaaagttttcaacacagacgtagctccctattttgtaatgcatgactctaaaataaacagtgtttttgggagggaaaaagttctgtaacttgctacactagtacactgcttacagcctagcccgggtttggtacaacatataattcccaacagacaaaagtatcaccttatgtttagatttgaacttttgatatagagaaatacgcaacacttcctgcataaattgaatcctacctgaactcatccaacttgcaacctctcacagaacattaatttaccagtttcaatcgttaaattattcatgaatattgtagtaggtacaagtgattctaattatggggctaaaactgctatagcttgcacataaaaggaaacatggcattgccactgccaatgacttgtgcaaaaacctatcgattccaatctaccacagctccactctcccatgtctgcttgtcacagaattcagtactaattaacagtcaaataagatatttttcttttttaaaaaaaaaactaaaagacgagctgcttgcactcatggcccgtttggttagggggagtttttaggagggattggaagtttagagggatgaggctattaaatgttttgtttggttaggagacatggaaattttggtgggatggggatggggaattgaggaatgaactccctccttttcaatacctgggtagggggtcctttacttcgcctaaacaaatctcagccatccgttttcattaatgacctaatctccaactaaactccctatcaatttct

SEQ ID NO: 663 - DNA, 4397 bp, Oryza sativa
tgcctcgctcgctcgctcgctctcgccgcccgccggccaggttagccgcgcacgcgcgccatcagcggctggcgcgcggccgttccgtgattccgtcgcgatcggttgggtgcgcgcgcccgtcgcgtcccaagggaaagtttggtatcgcctttcccgaatcagccgagctcgtggcccgcttacgtacgtgcgcctgtgacctgtctgcccgcgccgtgtgcgctgcatctatccatcggtcggctcgatccgtcctccgtttcgcgtggtagtatgcccgtggcgcacggaattccgtgtcgagctaaaagcggctcgacaaaggcttgcgcgcgagaaagtcggggataaggcctggctttcactcgctcgctcggccagtattagctggctgcctaagctcctccctctccccttgcaaacgaaacggacaggccatgttcgagaagaggcaggcaaagaggcgacagggattttgccttcgattcagcagttcgcagaggcgcgggctctgctaaattcgggcagcgtttctgccgtgctcgcctctgcctctctctctctcatcagagaatctatcgccgatagcaacgcgaaacagatcaagcccgatactagtaatttgttaatcgcgtccgttagtctacgcttccggccgaccttacaccaacccgacgaccaagttgcacgagacatacaccgtccacgcatctgtcaatgaactactactagtaactactaccgcgtggtgaagtgaaagggtgaaactgctcgggtcggcttggcttggcttcggccagctagccgccacgtctccgccggttttaagtgtgagatccgacgtggaggccccggccgcccccaccgtgccggccgttgtccacctcccgacgggacaccgggccccgccgttgccgcgccgtggaccgacagccactgacgtcaccccatgtccttcttctcggctagctcttctcctcctcgcccgtgaccagcagctcgcctcgccctctataaatacccggccattcgaaggcgttccgactcaggccacacaccaccaacacaaaacatttccttgtccctcgccttcctcgcctcgcctcggctctcacacgacgcctcttcctctcgctactactagctcaagctaagctagcaagagcattccttgggctttttttcttgttcggggttgagaggcaatggcggtgatgactgatgtgtcgaccaccgggacggcactccggaccccggcggcgggggcggtgaaggagggcgacgtcgagaagctccggttcatcgacgagatgaccaccaacgtcgacgccgtgcaggagcgcgtcctgggggagatcctcggccgcaacgccggcacggagtacctgaccaagtgcggcctcgacggcgccaccgaccgcgccgccttccgggccaaggttccggtggtgtcgtacgacgacctgcagccgtacatccagcgcattgcgaacggggaccgctcgccgatcctgtccacccaccccgtctccgagttcctcaccagctccggcacgtcggccggcgagcgcaagctgatgcccaccatcatggacgagctcgaccgccgtcagctgctctacagcctcctcatgccggtcatgaacttgtaagttgatactactcctatcattgtctcattctgatagcacacacacgtacaagaagcagatgatgattaatggccatgaatcattgcataggtatgtgcctgggcttgacaaggggaaggggctctacttcctgttcgtcaagtcggagacgaagacgccgggaggcctgacggcgaggcccgtgctgacgagctactacaagagcgaccacttcaagaaccggccgtacgacccgtaccacaactacacgagcccgacggcggccatcctctgcgccgacgcgttccagagcatgtacgcgcagatggtgtgcggcctgtgccagcgcaacgacgtgctgcgcctcggcgccgtgttcgcctccggcctcctccgggccatccgcttcctccagctcaactgggagcagctcgccgacgacatcgagtccggcgagctcacccctcgcgtcaccgacccgtcggtgcgcgaggctgtcgccgccatcctcctcccggaccccgagctcgccaagctcatccgcgccgagtgctccaagggcgactgggccggcatcatcacccgcgtgtggccgaacaccaagtacctcgacgtcatcgtcaccggcgcgatggcgcagtacatcccgaccctggagttctacagcggcgggcttcccatggcgtgcaccatgtacgcgtcatccgagtgctacttcggcctcaacctccgccccatgtgcgacccctccgaggtgtcctacaccatcatgcctaacatgggctacttcgagttcctccccgtggacgagaccggcgcggcttcgggcgacgccacccagctcgtggacctcgcccgcgtggaggtggggcgcgagtacgagctggtgatcaccacctacgccgggctgaaccggtaccgcgtcggcgacgtcctccgcgtgacggggttccacaacgcggcgccgcagttcaggttcgtgcgccgcaagaacgtgctcctctccatcgagtccgacaagaccgacgaggccgagctgcagcgcgccgtggagcgcgcgtcggcgctgctccgcccgcacggcgcgtccgtggtggagtacaccagccaagcgtgcaccaagcgcatcccgggccactacgtcatctactgggagctcctgaccaagggcgccggcgccacggtggtggacgcggacacgctgggcaggtgctgcctcgagatggaggaggcgctgaacacggtgtacaggcagagccgcgtcgcggacggctcgattgggccgctcgagatccgggtcgtccgcccgggcacattcgaggagctcatggactacgccatctcccgcggcgcgtccatcaaccagtacaaggtgccacgctgcgtcacgttcccgcccatcgtcgagctgctcgactcgcgcgtcgtgtccagccacttcagcccggcgctcccacactggactccggcgcgacggtccgaatagtcggtcaaatccccacctcgtcgttggaccgtgtccaagaatctgaagtagtagaagccggatgcctccacctaaaaacacttatctgttatttttggaattaattttgatggttgctgtcaactctgtcagttagtggcaagagggtacctctgatgtgagggagagaactgcagaacgaacggaagaaagtgttgatgtaagaggttaccactagtagtactgtttgtctgtatcaggaatgtgattataatttaacctgtcctccaaaaccgtacgagtcctgcgcaagatcttgttccaattattggccagacctggacagcttttaggctgtgttcggcacagcactttcagtgggcgctacagtgttttgcccccgcgcacgcttttcaaactactacacggtgtactttttttcaaaaagtttctatacaaaagttgcttaaaaaaatcaaattaatccatttttgaaaaaaaaattaactaatacttaattaatcatgtgttaatgaaccgttccgttttccgtgttactgtagcgcggtgggaaaacgtccaaacgaacgcagcctaagcgtagcgatcagttgcatttcctgattctcctgcctgtagcctttccatttttgctgaaccatttcattgaaggttttcatgggagtttgttgtagcttctatgttgggagattcaagcaaaggagggtaaatttgccgcattattagctcatgaccgtataaggatgagactggattgctttcggcttctcgccatctctcaacaactactgctttcaccttaaaaaattcttgaagtgcatttgattatagtcttttaaattattagcgcaagtgtcgagtagataatcttttctctgagatgttgacacttgattaaactaaccaggctagcttaaaaaaagtgaactgctgaataatgccagaccgaagcacgatcctgcacacggctcggtcgtcaggtctttgctgagtgctgcaaacggaccaacatactttcctgactgtaccatcatgcttttgcgtgtgttcttctttctcttgctttcctgttttccacaagtccaaaagcaaaacagtttcgcctctcttatgtcaaaagcgagggcgttattcgcaatgtagtttgcaagtcgtgtgcagtatcgcgtagaggcttcaaattctgctattggttcaaagtttgcggatgggtcatgaccgagaaaaatagacgcatcccattctttgtttgccatatcgccagcgtctaacttctt

SEQ ID NO: 664 - DNA, 3013 bp, Oryza sativa
ctagtttgtacataatttggaagagtttgatcacgtgacatacacatttcacatatatttaaatcttcacttaaatatttattttttactatttcttagctcctacttgcaaacaactatcaacataataatagtatgatatcactgtacagtaaactgttgatatgtaaatatattatattagttattcaaagtgacatgttttagctttcaaatatgcaaaaccatcatccaaaatcatcttaggggataatatgaatggtaatctaagtttacgacttttacagggacgtcccctgcatggaaattttgttgctggtacgaagaaattgatcgaacgccgggccattttcaccggataggtttggtctgttgtaaagtacagctagccgcgggtccctatccatgccatcgtaaaaatgcccatcttgtctgggctttcccaaataatgcagaaatcccagaccttttcttcatcatagcccgtcctcttcatggaccacggtgtacagcttgcttaaagcttgtccattgccggcctcctcccgctaaaccctagccatccgcatgcatgcacgtgaactactcgatccaccgccgcatgcaccaccagattcaaccccatgttgctacaaacatgtaagactaaattcaacttctacaggttagcaataaaaaacaaattaaactgaaaatagttatcgcacattcgcatatatatttgttatttttgttacaactggtagaagttgaatttaaatttttatatttgtggagtgatatatttcatattaatctatattactattttttaatttttttataattatttaggtctcatgcacaaaacaagaggatattacctcgaaggatgaaataactttccccgttacactgtccaatccgtttatttacacgagaacgtacgtacgcgcgctcgatctcgcgtctcctcccggcctatataaaccccagtggcgttgcactgagccctagctcaaacactgtgtactacgcaacacacacataggcacagttagtgcacgtacatcttgctgaatttgcttgagctcgtacgtgcgtagtgtggtagccatggccaaggcagtgatgatgctccccgtcctcctctccttcctcctgctgccattctcgtccatggcgctgacgcaggatttctgcgtcgccgacctgacctgcagcgacacgccggcggggtacccgtgcaaggccagcgtcggcgccggcgacttcgcctaccacggcctcgcggcggcgggcaacaccagcaacctcatcaaggccgccgtgacgccggccttcgtcggccagttccccggcgtgaacgggctcggtatctccgcggcgaggctggacatcgccgtcggcggcgtcgtgccgctccacacccacccggccgcctccgagctcctgttcgtcacccagggcaccgtcgccgccgggttcatcacctcctcctccaacaccgtctacaccaggacgctgtacgccggcgacatcatggtgttcccccagggcctcctgcactaccagtacaacgccggccagtcggcggcggtggcgctcgtcgccttcagcggccccaaccccggcctccagatcaccgactacgccctcttcgccaacaacctgccgtccgccatcgtcgagaaggtcaccttcttggacgacgcgcaggtgaagaagctcaagtccgtcctcggcggtagcggttaagttcgtcgtacgtctctctccggtcgagttggtcgccgccgccgccgtcgtcgtcgtcgtggtggtcactccgtgtgattgattaatttgcatgcatgcacttctgtcatgggaatgtgtctgatttcttttttcatgttatgcttaatttgttcatgtcaatttctttcagattaattaagtggtggttcaaataatctctaggtgtgtcactgtaatttgttggaacgaaagactaaactgtgcatcgatccaattggtcatttttttttgtcagttcaaagcttcgtttggcatgcagttgtgtcttgtgtgtactgcagtggattctctgtttttggccttctttgcaaacgggactgttgcattccaagtatggaatgcatagaggaatgttttccaccccaggaaacataagactaatgcatcaaattaactaacttaattcggtctgaattgaaatataggtatttcatctgttcttgttcctggtgtgttctaattggacgattgatagattacggacataagaaaattgctaatggatgaattaaatattataaagctgataaataacttagaaaaatattaggtaatgttaatgtacaaagttttttttaagaaattatacttttggagaagtggcacgatcgaataatataaaccttcgttacctatttcaatgccgcaacataattcaaaccatcttgagtttgacaaatatttttaaaaaatggaaagaacactaggcaatattttagccccaaaatatttttcccgaattaagtgcaaagataacacaacacagcctcagctaataagtgtggtgcaatttggattttcgtagtctaagaactgaatgtacaggcaagattagtagttcagtgcacatcctgcaattaatatgggatgggagaacagtggtagtactccagtagtccagtgggcacggaaccttggctcaagtgcaagtgctcaacaaggcagaagcaagcaacaggggagggcaaattgcagataggaacggcgccactgcaaaagctaactgcaacttatggccaggaaggccatatccgttttgttccttatccctgctcggctgctccagctaaacgagtccatcagacaacacaaccacgtaccgatagaagatatttgacgaggaaatgctatatcttgcattcttgctagctgctagctttgctcatgcatgcatgctccatctgaagtgtgattcagaattttcgattgatttcattacaggtcatagtgcttg

SEQ ID NO: 665 - DNA, 6761 bp, Oryza sativa
agtggagctggtctaaaaaaaagaagtgcaggcaaaaatatatataggagaccaataaatacctaatatgtaattaaagtggttcaagtaattatttggttcatgtaagaatttattaattaggtacaccaagaacactttttttctttttatatttgccagggaaagcaacaatttttacaattaattttgattatggtaagtcagctggttttttaaattaaatgctttaaaaggaaactagaagagaaagtactaagtcggatgactgatttctacgctttaggcagactatgacagtgcgtcaaaatatttttcgttccgtacatgactacacgatccattaaaaaaggacctatagaaaacaatgatgtcaatttcttcttaggtaagtcgtgtcggcttccgtatagcataaaccttgtcataaaaagaaccgacacgcgcgacgaatgttcttgagtaagacgtttaaattccttcgaagaccgaattacgtcggcaccaaagcgagagaaactaccgatcacggcgcgccgcatccttctctcgttgacctaaaaacttctctttcaccgaacatcacacgcgtgcggagatcatagtcatcatcatctaaatttaaacccatatttcttttttcaaaagttgtttggtgtggaactattattccctaacccccataccctcctctctctctctctctctctctatccatctctttctctctctcttacacaacaacctgtgtaccggataacttctggccaccagtcacaagccacgagaggagaggagacgggtgacgcatgcaacggccggccggctgccctagcaagaaagctggtcaattggaagtaggctaaatgaatgaatgttgctggggacgttgggccagccgcaagtggattggacaatttggacaagataacccttctctctctctctctgccttgtctcctctctactcctcagcatctatataagggccttgcaggcagtggctctcacaccaacgaaacaaggagagactcagagaggaggcgtgttggttagctcattggcagcagcacacacaaaccacatctcctatatatagctcatttttagcttttggaatttgagagaggttttgagagaaatggctagccaaggtgtagcctccatgttcgctctcgcattgctcctcggtgcctttgcctccattcctcaaagtgattacctttccctctctttccttttctttttctctctctatctctcttttgtgtttttttttttcgatttgttgcatgtttggaaaatcattaggtatatataagttttagtttagttcatgcactcgctcacgatgcagagtctggggtttaattttattctattaccaaaaaaaggttttgtttacgcacgtcatgcatggtgtgtggatagattgcaaaaagttaatgattaatttcttgggagacagagaaagatgaagagattataattggtagaaatgggctagctaaatagagatagctagctaacaaataatacacacagtggtcaagagtcacatagatatacatcaattttcatcaacaacgtcatgcggaaaagagagataacaactctcgttagcgagtcatctcgttaaacgcctccccctgcagtttcggtgcctgtcgctctcactgcgagtttaattattctcttctgctgcttaattgctgctgctgctgctgctgctgaaagaaggttaattaagctcgtctcgtgccgtctcattctgcccatcactcacacgcatcgtcgtcttcgtctatgggaccagtaaaaacctcgcatcaatcactttcgttaaaagatcaggaaacctcaattttgactgatcttctctgatgactcacctctctgaatttttgcttatcgagagtcgttctctcaaagatatatctatcctttttgagtggtggcacctcaccaaaacaaaagtgcatatatatatatgtctgaagaatatagtataattgactgcagtttaattaacaagaaaaattactgcgagtagtaattaatttctgcaagcaagcatatatagtatcttgggagcatgccgaaagggatgtttctagctagctagcagctagcttttagaggcacatttcgtacacaaattaactaacaatcttgcagatgaagtctttgcatgtttggtgcatgcatgcatgtcatctcacagttgcttgcatcttttggaactttagaatgtttcaacacataacctagctttatatctttctttctttctatctctcatcagtagtcatgttaggctaagaattcagctactggagatagcctttttgtttttgacattcatgaaagttaattcaatttatcaagtgctatctctctcacaaatataagcttttctatctctctcttgatccctaccgcttcgtttgttcccttattgattcggttgcaacaactgcttaaccaccccctaacccaacaccacaccatatctcattatctgtcgtctttagttttctctctctagatatatatatatctatcgcttgacatttttcaaatgatgcatgatattgtacctgcccagtccaatggtcctccaggttgacacaaactcccatatcttgtaccaacactgttccattctttaagtaagatatatgcatgttgtactagctagtaactaactcactcactcactaacaatatctaatgatggatatatactactaaatagtgtactacatattatagctattagtcttgttctaacacaaatattgacacatatagtgcaactaaactgtaaagagagtagtagtaaacacatggcacatccatgatcaccagtagtcagaaattaattagttaggacaggtgttgcttatgttgtcctaaagcatgttatgacctgacaaattggagcaattagtaagttgtaggggtgtgcttcatttaattggacatgtacgtttcttgagtagttgcatattactccactgcactcactgactattagcacacgggtggtctaaactaagcttcagctaaagcttattagatgctgctttgttagttagctagctagcttcccctttggccacatcgaccttacgtggactatccaacggtcatgctgctgacgttggaccaaaccattacatctccatctctctctctctctctctctctttcaatttctctatctcattttttctctctcaatttctctatgtttcttgggtagtatattccttgtccatctccgaaattagctgacaagtggcgtgcaagtacatgctatttgttgtaggataaacacttgatagctttccaaagtcaaaaaaaaaaattgcatcaagagctatagctagatgccgtgatcaggggagagttttcaactattagacctaattttcagggttaggtagtagagtgagattgctagctagtaagagattaatccacttagggtcaaaagcttatcccgttgtttaaggttatccttggtcacgagctagcttattagcatacttgttaaagttattacacactttagacacgtctttagtcacgagtgacaactaggtcaagctagagaagcaggaaacctgcagcattcaagcaactaagcaagaagcaaatatatattattcctcgtcagtgtgcgtgcacttgacaccaacttaatcagtataatatttttcagtaaaacaaagctaaaaacatcccatttttgtctgccagtagtagagtctagagaaagagagagaagcacaaaaaaaatatgcaaattaaatcaagctagtccaagcgcgcatacaaatttcagttaaatgtctttttcttgagattaagattaaaatttaaattattattcatcgaaaaaataataagtcaaaaaaaggatgtgtatgtatttgtacttcttcaatagtagtacatgcatcgcattctgtcacttttctacactactctccggccgccctttcttgctatgtgtacccatttcccgatttaaaacgagattaatattaaacagtaatacatgtacacccatgcactactgttcattaacagtaactaaacataaaaacataattatttacagctctataaattagttatttttttaataatagaatagaatcccagcctttactcaatgagctacaaccaattacggagtattatataagtccgtactagacaaacgcacataaacaagtcttaaaatgcacatcgaaaaaaataaagcaaccacaagcttagtaatagttaattaattgctgtaaataattaaagtaataaaaaattttactaacgtgatatgatggtgatgcagaggcggaggcgatcggggtgtgctacggcatgagcgcgaacaacctgccgccggcgagctcggtggtggggatgtaccgctccaacggcatcacgtcgatgcggctgtacgcgccggaccaggcggcgctgcagtcggtgggcggcacggggatcagcgtcgtcgtcggcgcgcccaacgacgtgctctccaacctcgccgccagccccgccgcggcggcgtcgtgggtgcggaacaacatccaggcctacccgtcggtgtcgttccggtacgtcgccgtcgggaacgaggtcgccggcggcgccacgtccagcctggtcccggccatggagaacgtccgcggcgcgctggtgtcggcggggctgggccacatcaaggtgacgacgtcggtgtcgcaggcgctcctcgccgtgtacagcccgccgtccgccgcggagttcaccggcgagtcgcaggcgttcatggcgcccgtcctgagcttcctcgcccgcaccggcgcgccgctgctcgccaacatctacccctacttctcctacacctacagccagggcagcgtcgacgtctcctacgcgctcttcaccgccgccggcaccgtcgtccaggacggcgcctacgggtaccagaacctgttcgacaccaccgtcgacgcgttctacgccgccatggccaagcacggcggctccggcgtctccctcgtcgtctccgagacaggctggccctccgccggcggcatgtccgcctcgccggccaacgcccggatctacaaccagaacctcatcaaccacgtcggccgcggcacgccgcgccaccccggcgccatcgagacctacgtcttctccatgttcaacgagaaccagaaggacgccggcgtcgagcagaattggggcctcttctaccccaacatgcagcacgtctaccccatcagcttctgatgcattccgtacacatatacgcatacgtatgcgtatacgtgaccgcaggtagtgtagtatacacgtacacgtacctgtacattacagtattgtacagagggcttggcttgcgaccgctgagaggacacgtacaccaagtgtacgtctgtcagatgcgtacgcgatagtatatatattgggtatattatatatataccgtattattacggtatgtatagaagggaagctacaggtacaaaatacggtacgctgtggtaggcgaattagcccccattttcccttcctagattactattactatatagagagggttgcaatatatatacatgtatatgtacgtacttaggaggtgtattttgtacgtacacagattgtaatactgtacatttgtacgccgtacgtcgaggtattttgcctcacgtaggcgtttgagaaaaaaaaagaaaaaatttaaaagattttactgctgcgtcaactgtgcctcgctaacgttgcatgcatggcccccatgtgcgtgtgtttctcgatgacgtggacagatgtgggccgtacacgtgtccccgccgggtggcccggatcggctgcggagaggcgcggccccgagagtgacgtgcgctggaaagcgccattttcttggaggccgcagacgatcctgtccacacgtattttgctcgagattttggggggttattttagattttaaaatttatttggccactaaattcggatggggccttatctctgtactacgtattcggcatcatccatccacttgaggatatggtccatccaaatcaaaatgctggatcttctacaccaagaattttttttaattaaagttctcttatatgatttacgaaagcataggtgagaatctgatgcccgaaaattaacctaaggtttttattaatttaattaccaattcacggagagtcagaacgtaattaatatatcaggcagaaagacagtatatagtcgatggacaaggcgtgcaaacgagggttctttgatttgccaatacattgctatcatgttgttcgatctttctggattagttttaattgagtgaattggttgctggagcaactcaatcagacaagttcaattgattggggatattatcttacaggtaactactactacctagctactaattataccagcttttaatccgaatgcatgcattgcatgggatcgatcctaattaattttgatgaaactttgtatatatggggctgctctaacaatacaattaagctaatgatgatttgatagacgtatagtatatggttttaaatggctactggaaccggtggtctggtctctcccatgatgtcttaggcttacctaaaagtactaatgttagctgctcaataaagtggcttggattctctcttgcttctgcacatatagcatgaatgaatcggttgtgatgagaaaattggtgcctgactgctatgttt

SEQ ID NO: 666 - DNA, 8386 bp, Oryza sativa
ggtaaggtgacgcatgctaatgagtttgtgccgattcttcgttagtttactcaagtagatatggtaaacaaccaaacaatagactgaaacatgcataaattgcatacaagatattgagttttacttttccatggagttgaatgccttggaaggagcaggcattttatacaagttcgtaaaatattcaaaattcgcaagaagccaaagcaccgtgtccacagcgcgcctaatgaggtaatgccaggtttgatgcatcggatatttgtaagaatgaattaaccagctgacgggacactgacgttgtacgaacccagcaaaattcaacattctgaatagtacccgaattcaattcctttccgggttcaaattctcttttgaactttgcgatgcatttatccttatccatcacacgcacacacggcacacgggtgtttatgctggtgtgcggcgaaacaccccgagtatttccctcgttttgatcattcgatcattccatggtttggttccaccatttggacagtcaacccggcaattgttggcatcaagcgcggcggatggcagcgaccgccgaccggtacaccgcccatgtgccacagcccgcccgcccgcgcgcgccagcggccagcctctcgcgaatcgatcccaaaaacacaacgtttacaaaaactattatgaactagagtggattttaataggagatatttataattgtttacacacttaaataattaaaaaacaatggtaaaattaaaattttgagaagatatattaacatatgatatatcaaattttaagttataccatttaaaaaaggtaaattaaacaataattaatgcatatttatagttaatttttttataatatgttgaagttaaatttaaatttgaatgtctgtgaagcgatttatattaatctatcttttcataaaaagtttaatattttttttgcgaggaaaagtttaataattatttaagtgtgcataccaacaacaagggatgtcggtaggatggtactatccaatagtttccctgttacgaactcctccgctttggtgactcgcgacggcgatgcgcgggcaccacaaagccgccgcggctggtggccgtggccgcgtcgctataaaatcccaccgcggcttcgtctctctctccatcagcccgtctcgctcttgctccgcgttccgcttggctttccggctttagcagagtagtgagagagagagagagagagagagagagagagaggaggaggaggaggaggaggaggggattgtgacttgtgatctgcgaggatgcaggtgcaggggttctttgacaggttgacggggaggaacaaggaggcgtggaaggaagggaggatccgtgggacggcggtgctggtgaagaaggacgtgctcggcctcggcgacttccacgcctccctcctcgacggcgtccacaacatcctcggccacaaggagggcgtcgccttccgcctcgtcagcgccaccgcccgcgacccaagtaagcaccgccgccgccgccgccgctcgccggccaaagcaaaacgctcatcgtgcgtgcgtttcgtttcgtgtttttttttttttggtgtgtgcgtgtttccgctccaaagcttttgcctcggcgtgattggttggttggttgattcgtttcctgaacaggagaaacagccgcgttttctctggctggggtttccgtttaattgctctcgctaatagcttaattacaaaccggtatttgcagtcttcaagcgttgtttgcaagcttttcctcggaaaaaaagcgtatagtagtagtacaaatttgaagtgtgcggtttggttgttgtcacgcattcaatgctacttccgtagagaagaaaggaagggaacattaattagtggagtgatgggaggaggcagcattgacggtcaacgtcaacacacgtcccttaacccctcaacaatctacaatcaaatgtgattaaatgtgattaaatcaaatcaagaaaaggacacccaattccattgatcgtcctgtcgatttgtcccccacttcatcgatggatctgttttttcaaaattttctttctatctctttccaattttttgtctaatttttgtggatggacaggcaatggagggagggggaagctggggaagccggcgcacctggaggagctggtggtgacgatgaagtcgacggcggcgggggagtcggtgttccgggtggcgttcgagtgggacgagtcgcaggggatccccggcgccgtcgtcgtcaccaactccaaccggtccgagttcttcctcaagacgctcaccctcgacggcgtccccggcaagggcaccgtcgtcttcgtcgccaactcgtggatctaccccgccgacaactaccagtacgagcgcgtcttcttcgccaacgatgtgagtccactcctagtcctcctcttggtcaacggtcatcttagttacagtagaagcctagtagtactactccattttcatttccagatggacattgccaatgccactgctcttctgcagtgttgctcaaagaccatagttaattcttgctaatgagcagtaccgctacatcttaagctaaagaaagatgagaacttgcttaagagccttgagctaaaccgctgacattaactatataagccttgagctcccttgctattaggaatattgaaatcaacatgcaaattctagtggtctaatcaatacgagaacatagttgtttgtgccaaagtttgcaattgatgaactatgtacggttcagtagtttggttgcagtaaggaattttcgttcaggtgggggtctttcagccgaccatgaatgcatgatgataatggatgatacttagaaaaattcaaggcaaagttttcataattgcactgaacgagggtttctgatcggatggtccatgccaagtaatcttggacacgtcacttagaaaattgattactgcagacgatggtacaataattgatgaccactttctgcagacaatatgatggctgcagagtgcagatactaatagaaacatcaggaacagtatgaatcttggacatatgacatcttacatgtgcatgaaaatatgtaaatgcctctacagtgactggagataggcggctatcaccaactcatggatttagatatcgcaatgcctttagaaatccttgaaaagctaaacaaacctatgccatttttttgtcataacatatatttatggattatatattggatcatggtcaactttcgtttttgaagtgtttgttggattaggtaccgtgatagctgtacctagatccaaatagcatatgcatatccaccttgtctcctggaaataactgtgatctagaatttgatcgtatcttttcttaatttactacacctatagattaatagatagcatccttgtccagtctgtcagcaggttaggagtatagaagctgacttgacttccactatgatctacaacagggaaagaaagttggatagaacagctgataagttgagttactagcagtttttgagcttggtgctgcagtctagtcaaccgtccaactgtccatagtgatgtccgggattcagggcttcccacaataaacatatagtggaaataacatcctgtactctacaattggctgtataaaaatgaagttgttctttttcaagttatggcatcgacaactactcgtaactcatgaatggtacatgctagtctttattattaaaatgatcctacattcctactgtcaaatcatgcaagacatcacatagctagaaaattacacctgctgagttccattttgaaaatgacagtccttttactagccactttttgtttgattcttcaaaatgattgaatgcgtcttgtgctacttgtcctagacaacaccaaactgaatgcccacagacacaaagccaccaaccgctcgttcgtccctattagcgacctggtcttacaagcaaacaaaagaatagtttagcttggtcaccactcacctgtgtgctgtttaattaagcttttgtttatgtatcatgcatggcatatgcaatcgcttgatctacaactagttgatagaaataaaaaaattgaatgcttttcttttgtttatgaaaaaaaaaaacaagtaatagctgcctcgctgacaatcaaatggaggtcattgatactgcctgtattttctttcagttttaaagcatgagtagtaatataaattcactttctaattgattaattatagtaatataaattcactttccaattgattaattaatactcctgctattagggttttcacctgtcagcttatcttcttgatgagtgactgaaactgctcattctatttactaagtttatctgttgccttattttcttgctgttttgcagacatatctgcctagcaaaatgcctgcacctttgatcccttaccggcaagaagaactcaacattctacgaggggacggtaaaattggaccatacaaggagcatgaccgtatctaccgttatgattactataacgaccttggccaaccagacaaaggcagtaaactagtacgaccagtcctcggtggcagccaagaactcccctatccccgtcgaggcagaactggccgggccccaacaaagactggtgagttatagatatcatgcattttcttcaatttgaatttatggcaccttgcaactggttccctcaaattcttttcttgctcaatattttctcagacccaaatacagaaagcaggcttcctctgctggacttgaacatttatgtcccacgcgacgaacggttcgggcacctcaagatgtcagacttccttgggtactctcttaaggctattgttgagggtgttctcccaataataaggacctatgtcgatacgacaccaaaggagtttgattcttttcaagacatcatggaactctatgaaggtggattgaaagtggccaatgcctctgcactagcagagatcaagaagagagttccctttgaacttattaagagtcttttgccagttgctggcgatcaagtcttgaagttacccctaccacatgttatcaaaggtaaccagctttctgcatgagcataactctgtatggttataccttattgggtaatttgattctgttcatatttggtattatcacaacttattgtttatgatgtttcagaggacaaatttgcttggaggactgatgaggagtttgcacgagaaatgctcgcaggagttaacccagtgatgatcaagcgtctgacggttagtaacttcatcgttgtaggatatgcaagtatgtgcatctgtgctcgcataatggagtgagtaatcttttttttgttctccaactgatcatagaatttcccggcaaaaagtactctggatccaaatgtgtacggtgaccataccagcaagatcaccgaagctcacattaagcacaacatggagggcctcacggtgcaaaatgtatgctgaatcactgacatacaaagcgaaacatttcagctctaaacatgcatgctatatctttgaaatgcaaataactcgtatatgactatactagaactgcatacactcaggagattgaccaataagtaaccatgctatgcaggcactgaagggcaacaggcttttcatcctagaccaccacgatcacttcatgccgttcctggacaagatcaacaagttggacggtaacttcatatatgcgagcaggaccattctgctcctgaaggacgatggcaccctgaagcccctggcgatcgagctgagcctgccgcaccccgatggccagcagcacggcgccgtcagcaaggtgtacactccagccaacaccggcgtcgagagccaaatctggcagctcgccaaggcttacgcctccgtcaacgactctgcttggcaccagctgatcagccactggtacagagccagcctcctctgtttcgttttctgtgttggagtatgaaaaggaggctcatgatgtttttgcatgttgctgctgcaggctgaacactcacgccgtgatcgagccgttcgtgatcgcgacgaaccggcagctcagcgtggtgcaccccgtgcacaagctgctgagcccgcactaccgcgacacgatgaacatcaacgctctggcacggcagacactcatcaacgccgatggcatcttcgagaagaccgtcttcccaggcaagtacgcgctcgagatgtcctccgtcgtgtacaagaactggaagttcaccgagcaggctctccccgtcgatctcgtcaagaggtaaaaccaaaatgaatgacatcttgcaaagctctggctgatcagaacacggcaagaacaacgatgtgaccaggatgggttttgcttttgtgtgtgcagaggggtggccgtgccggacccgacgagcccgtacaacgtccggctgctgatcaaggactacccgtacgccgtggacgggctggtgatctggtgggcgatcgagcggtgggtgggcgagtacctggccatctactaccccaacgacggcgtgctccgcggcgacgaggagctgcaggcgtggtggaaggaggtgcgcgaggtcggccatggcgacctcaaggaccaggactggtggcccaagatggacaccgtccaggagctcacccgggcgtgcaccatcatcatctggatcgcgtcggcgctgcacgcggcggtcaacttcggccagtacccgtacgcggggttcctcccgaaccggccgacggtgagccggcggccgatgccggagccgggcaccgaggagtacgcgaagctggagcgcggcggtgacgaggccgacctggtgttcatccacacaatcaccagccagttccagaccatcctcggcatctcgctcatcgagatcctgtccaagcactcctccgacgaggtctacctcggccaacgcgacacgccggagtggacgtcggacgccaaggcgctggacgcgttcaagaggttcggcagccggctggtggatatcgagaaccggatcaaggacatgaacggcaactcggcgctcaagaaccggaacgggccggtgaagatgccgtacatgctgctgtaccccaacacgtcggatgtcaccaaggagaagggccaagggctcaccgccatgggcatccccaacagcatctccatctgagtctcgcgtgcattctttagatcgatatacgtgtgctattgctagtgttgcgcgtttgccgtcgtcgatttgtttcattgtttgtatcagtgtgcattaccgtgattcttcgtagttcagggtctcagggataagtcgttgcaaatgtgagtaaccttgaggcatggataatttcattaggaattattcacatggaataatgaaagttaataaaatcattttgctttcagagtttgtttcaacttttatgatccatatattcccaaatagcgaaacaacgtcgttttagaatgcacaattgagcttttttatcattcttgagggtgagaggtaccaaaatcccatccattcattgagccagatccaagggttgacaagatttagtatcaggaggtacaagtttcatgtgcgcacggtacctcctcgcagtccgcatgcaatacttgagcggaagggaaaaattgtattttagcattcacattcgttcattctagtggataggagcgtctgcgtctccagcggtccagcccaaacaagcaaagcaaccttctcaatcccgacctcggcgggagtgacgacgacgtcaggtcggcctccttcctacacggtggctgcgtggagctggatcgattactgcggttgcgtagtgtgaaggctggttgattactgccgcggcgcctttccgcatctcagtggtccaatgcagcgcttgccactgcatccaacaagaggagagcggcgaggaacggcgcggcatggcgttgaaggggaggaagctaggacgcatagcgcagccggccagagcaaggaaggggagagatttgtggcagctgcggtgcagatagagattagcagccgagcaggttgcaagtcgccggtgcgacaaggtgatgggagaagagacacggacctatgctgtggataagagttctctctctctctctctcgttttttcatctggtccatcctcaccctgctaaatgaacgattggatttgatccagtacctcccattactagtacctcaaggtactatttcaagggtggtaaaaaagctctactaaatttgtcacaaaagatactttcacgcggctatatattcaatattgaaaatcaatcttctcttctaccttacctctatcctagtccaacagtaaattgtccttgattaatgggaaattttcagatgggggaaactcttatcttgacaacgagatacttaatgacagaccatctcatcttc

SEQ ID NO: 667 - DNA, 2799 bp, Oryza sativa
attgacaaacactcaaattcaagaaatgccatcgacgaatgcaagttccatgaaatgccatcgtacaagcgattttgtcccagaaatatcatcactgttagggttccgttagcaacgtaaccttccgttaagttctataggatgaacaatgtgtttaatggcgtggaatggacggaaccctaacggtgatagcatttctgggacaaaatcacttgtacaatggtattttatagaacttgcatttatcgatggcatttgttggattagggtgtttgtcaatggcatttcttcgattttctcaaggaagaaaaaggagatgagttgtttcattgtgcataaaaaaaatactatgtcagtttattagcatgcaaattcttcctagctaaattgtctaatttggctagaacaactttacgtaattaaatgccacatgaaaaatttaacttaatcataaatggtatcttaatttattatttttaaatatatcattagtctacatatatacctgttgtacaatcatagctctgtaaattgaatggaggggaaaatttggccgtgttctgatggtgtgtgtgattaagctaatcaatcgatatatatggactattacaggtcaattgtatagttgattaagctacctaattgatgtggaccatatactgtggacaaatgattaagctacgtactactataagctgtatatataggagtagtatatatcttatatatattgatgattgatcgattggttggttgattatatcctgggaatggaagctgcgcgcaccatgtcgatcgatggcacaaatgtggcgcatgcatatatacggccgtggccattattaattagtttatgctgcgttgtatgtatatactgtattatcgttgtcatcagctatagagcgagagcaatgggcaaatagttaatcaattaaagaagatatatgatccccctgattgggcaactggaactgggctataaataggagcgaaaacacccccgaggaaatgcatcccggccgatcgagctagcaaatatcaaaaagcagctccagcttcttctgatcgatcgatcgagctgagctataggcagtagctgctaattaagctaattaattgctaagcagtagtagagctagctaattaattaagatggccggcaagaaggtgcaggtttgtgcgctgttccttgccctcaatgtgctcttcaccatgcagatgggtgcagtagtgcaggcatgcgagccctactgccccacaccgacgccgccggtgacgccgcctccgtcgccgccgtcgggtggagggaataagtgcccgatcgacgcgctgaagctgagcgtgtgcgccaacgtgctcaacctgctgaagctgaagatcggcgtgccggagagcgagcagtgctgcccgttgctgggtggcctcgtcgacctcgacgccgccgtctgcctctgcaccgccatcaaggccaacatcctcggcatcaatctcaacatccccgtcgatctctctctccttctcaactactgccacaagacctgcccctccgacttcacctgccctctctaaattaatcgatcctccgatcccttaattaccataccattacaccatgcatcaatatccatatatatataaaccctttcgcacgtacttatactatgttttgtcatacatatatatgtgtcgaacgatcgatctatcactgatatgatatgattgatccatcagcctgatctctgtatcttgttatttgtataccgtcaaataaaagtttcttccacttgtgttaataattagctactctcatctcatgaaccctatatataactagtttaatttgctgtcaattgaacatgatgatcgatgatgcactgcacatacatatatatcgacgatgcgccaatgcatcaacgtacgaatcaatatgatttagggactgcttgtgactgaaaattccattctaaatcatgtaaattttgggagaaatttcatggtccttaaaaaaatatctcaaggtacgcaaattcaacactaatttttttggtatttcgagttacttagtatctagagataccaaattttacactaaaaatgtgatacctcccaatactttttcaaagatgataaaattacctaaattttaaaccgcgccacttaaaactaactcctcctccctcctccctcactcccaattcaacacgtaccgccgccaccgattcccccacctctcctacaaagtcaataagtcatgtcgcccaataaaatgcatgctcctactaacacttatcattttgagtttacatcccattccaacaagccaatttctaaacattagtactatttgataaaactaaactgaaagtaaaagtaacatggaccgatcttcaaagatatttaacatatatcatgatattcaaacaaaacgatgaattgcttcattctgcacaaaaggactacactatttactaccatccaactcctctagctaaactgttggttagaacaacacctttatgtaaaccgtaagtggcgtcttcaattatcataatattttattagagcatcgccaacagcataactcaactcctcccaatcctaaacttaggggattttagttgaaaaaaccgctccaacagatcaatcacctagtcatctactcaagaattggagtacttgctcccaatcaattgcctgccaggggagggggagggagaggcaatcgcgcgacgcgggatgatgggacgaataacattttttattggtagtttggggtggcccatactttttgtttaggga

SEQ ID NO: 668 - DNA, 6812 bp, Oryza sativa
gagtttttcttgtccaaatggaacctatataagatcgtagtgtaaattattaattacaaattggcaagtaagtaatatgtatttggtaaatgtgaacagtatcttccagttgcatcctattgctcacttacaacagttatttatgtcgttaccaacgcttatgtatgtatggctatagatcgtagcaacgtatagaccttagcaacgccggcataggcaacacatagtcaatgtgttgctattggaccttacaacgcttatttagacctttagccacacatatattcgctgctagaggggggttcctcttgtagtgttccggcgaaaagaaaatctacagaagcacagattctcgcgtcgcctagcgactagcgagactgctaagctagagtggttggccttaatcaaatactgctactgtccaacttgcggttcggctcatgtgattggtcgtcgcgtgttcattcgcgcacgagttcaatacttgtattactgcactgatcagttctagatgcatacatggttggtatttggcatctctgaaaattggacttaggattggatttacgttagacttgtgagggcattgaattgaacatgtagagacagacgagaggaaggagtagttgcgttggcgcctaatccgtttgtcgacagaaggaaataagcagcaaatatatagaatgttcaaatgcaggttctaacgcttgggaaacttctgtgtttggtcaactcgtctttcttaatgggtgatggaaaatatcttaaccgtgtcagcaacacggcaacttctctagaatctagattcccatgcaaaaatgaactattttttctactctaaacaaatctgaagccctcgaccacataaacaggtctgaataatataaccttaaatctgatgaaatcgatctttgctcactgtaatctgctcactaacctgaatacagtgatgcacgcaaaggcaaaaaagtataaataaaaagccagaaaagtcagaagcatctgtcatcatggcctcatgggtgccaatggatgatgcagatctgggacagatgagacgacaattgggcaataatgcccaactccaactccatgtagagaaggaaatttcgaacggaggtcgctttctatatttctcttgtcctcttcttctccccttcgtcctcgctaccatcgccctattaatattcctcaaaatccaaatttgagacaacccgaattcagtcctcagcgagtcggaaacgcgccgaaagacgaactggaggcgcccccccaaatcttgagatcgcaggtaatgtccataggcgccgagcttcatgagtcctcctgcgagggatcttgtcttgaggtttcttgcatattggcctgtgcattttgagttttgatgtgcttgctgctgatccgaattccatctccgttgttgccgtaagattctgaatcgaattcatgcatttgtacggcagatttttttttcccccgctagatccgtatggtgtggttatttgggcgatgatagtatgggtccaagaaacgcggttttccctgtgaattgaggatctccaatttgcttctttggcttcggtccatggcagttgtgttctccaatcccatggttcatgctagacgcttcctgcagacaggactagacattttcagttttggtaactgtgaagattatggcattgttttaccaagagaaactgctgcattgtgatatgtaaaaaattaccctttttttccttctcttttagtagaattattacggaacatgcttcgcttggcgtctgtatcgatctacgttctttattctaaaaggctgtgcttttttgtgagcattgtcatccttttttttttcctttcaactccttctgttcatttaatgaacaattccgttctttctggtgttgatactgccacgttttactgattttccattattttattaattcctacttgacaagattcttatcgaacaattattgtgaatcttttagtaggaatctcgtaaagcgccagtgtcgcattttcctttgaggatctgatttttcccatcaagcaatggtgggatagccagtagtaaaatttaggctttcaggctcactccacatcagaaaattttctacttacatactatcgtttgtagaacaatcgtggaagtttatgcccttgctcaaaaaaaaaaaaagaacaatcgtggaagtggaaaaagggttccgtgaagcgcatagatcaataatgtctaatctcttttcactcataaaaatgttttgcaggatggatggacatacaaatggcactaatggttcctgctctaagccatgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcaggtacctaatctagtagtttgggaagatggaatgctgaaaagattcccttgagccatagtaggacttcatatcattctctcatattatctcatatttggatccacaatttttacaggtttttgatttatcagaagaggctcctgaaaaggtgcttcacagattgtattgcaactttgagaagctcaagtctaatggcgaccctattgcttttcaaattcagagcaacctaagactaattgtgagtagcctaactagaaaacataaagaatgatctttttgctttaggatatgtcctcttaactaatgatctttgaaataggttgctggtggtgatggcacagcaagttggctgcttggtgtagttagtgaccttaagctctctcacccacctcctattgcaactgtgcctctgggaactggaaacaaccttccattctcatttggatgggtatgtctatgactattgttttgttccaacacatatattctcttcagttgtgataatctcctccctttagataattcacgcttgttgtgaatttgtgatcatatacgagctgtttttgttgttgagctgtttgacaacataagaaggtttagcattaagaaacatgcatttttgaattaatagtgaaatagtgatcatacgcttgatacctaaattttatgtcttattgactgtgagctgtgaggggtgcatgatttttcattctaaagtagaagattactgaatctgagattttcttgttagtttgatctggattccttggccgtctttttacctagtctgcataatctgcagccatgatctctgaatcttccctggcatctagttttatacctctattaaatttaatttgactgcaggggaagaagaacccaaccactgaccaagaggcggtgaaatcatttcttggacaagttaaaaaagcaagagaaatgaatattgataggtaatatctcaagcacacaatgttatatttgtttctgttttttctgtcatgcttgtgaaaagtacaagtcctgcccaataattcactgcgacagctctttcatatatgttgtgtagcagtcatttttagttttaaacatgagtaaaatgtaatcccttatatattctgcatatgaaagaaaacactcatttgaatgtacttttttaagttggcatatcatcatgaggatgcgagctccacaggaaggtccatgtgaacctattgctccgttagagctgcctcactcattgcatgcattccaccgtgtatcaggaagcgattcacttaatatggtaagacaactcactgtggatactgtttttacttgattctttctattacagaagtagtagccaatagccatggactttcacttttgaatagtatggacaattggacaggctgagaactgaatatatagatctttaagcttgcttagcagttttttcttttatatttttgttcaggagggctaccacacataccgtggaggattttggaattactttagtatgggtaagagttcctctggtatccaaggcacagcatgatgtttttttttttttttggtttatgctagttcttgctctaacagatatcaaacagtcaccgttgttatccagtaccttttaatcaggacttgttaacaatattatcgtagaacatattttagtatcttttaagcatatcatgattaataaggcagtaatagaaacatggtcatcatgacttcacatactgcagggatggatgcacaagtgtcttacgaatttcactctgagaggaagagaaatcccgagaagttcaagaaccagctaacaaatcaggttcttctcgtttctgtagggcaagtcttgtggcacatttcattttgtttatgctgaatgttgtgatgcatttctttgatgcagagtacatatgctaagcttggacttaaacaaggatggtttgctgcttcactaactcacccatcctcgaggtagcctgtcactaatgcaaccatgatgcccctgatattgatcaaattatcctcattgatcggtgttagcatttcaagtaccacgcttagctattatatgcctttacgtcggatatgcatgacgtgtacagctcccattttcaggaacattgctcaacttgcaaaggtgcggatcatgaaaagacctggtggccaatgggaagagcttaagattcctcgcaggtaaataaatccttgcttcctttgcagtgtatttgtacaaggcaatttccattttgcttcatctaaaatgtctggttcttccaaaatcccaaccccattttccatctccaagtttcttagacacatttctagaatgttatcatcaccacagaatgtagctatgaaaatcaacatatattccctctattgtttcagcattcgatcaatcgtctgtctgaatctgccaagtttttctggaggactgaatccttggggaacacctggcaccaggaaagtacaagatgtaagtagagcacttgcctcttctgttgtcgtttcactcctaatggctttgccatgggcaaagaatttataagttttcatggcaatatgcagagagacctgactgcaccatttgtcgacgacggccttatcgaggttgtcggctttcgcgatgcctggcacggtcttgtcttgcttgcccctaatggccatggaactcgtctagcacaggtgatgcatctgttctcaacccatttcctgaactccctacatttcagctagcattgctgatgcagtcacacatttcacatttttcaggcccatagaatccggttcgagttccacaaaggagcagccgagcacacgttcatgaggatcgatggggagccatggaagcagcctcttcccaaggacgatgacaccgtggtcgtcgagatctctcacctccgtcaggtcaccatgctcgccagcgacccgtgcaagtcgaagagcgtcaacgacccctcgtcgccgatgtgctgtagcaaccacgacgacgacgagcgcaacagcttggaggacgaagatgagtgggaggaggggaggaagaagtttggtgcagctgatacgttcaagttccctgatgaggttgatgttgctcaccttagctgagctataagtgattcagagttcagatttcagaatgttcgctactactgttagcgatactgcctttttgggggtttatatatactactagtttattagttatcagccctgtgtagattcgaccggctgtattcgagaactgcaaaattttccgagtaatgtcatattttcatgcaacgcaattggtctattcccagaaaatcatgtcccaaaacaaacttcttgtcctgaaccctctgtataggtttgctagcgtaaattactcattttttgcggggaagtgtaaattactcatgtcaagctgctttttacttgaaaaaacggtccattttacttacccgaacttgttcacttaacatttaaactatttgttttctcattttaccccccttaaattattaaaaactagctgggtggcccgtgcaattgcacggctagcacccatataaaattatatatttttaatatgattttacttaaaatttattaaatagttatttcgatgtcttaagattttgaaaaaccaaaccttatcatcctcgtgtttctaattttatagtttttaaaagtcacaccagttgctaccccttacttctatcatattattctttattagtttgcttgatctaccacttgatctaccactgtttctatttattctccttggaacctttaaaaattggatctaaactatagagtttatcgtcctgttaggcttcatttttataatttctataagtcccgtcaaacgttaccattatactcctctacaaccgtccactacataccttatcattctcgtgtttctaatgctatagtttttaaaagtcacaccagttactaccccttacttctgtcatattattctttattagcttactcgatctaccaatgtttctattcattctccttggagcttttaaaaattagatctaaaaactataaagtttattgtcatgttaggcttcttttttataatttctacaagtcccgtcaaaagctgccattatactcctctacaaccatccactgcatgttctttttattgtcgttgctatttttaaaatcgaacataattatcgtttaggttcatttttttactttttagaagttccgtcaaaacgttagcgactttgtcactgtactcctatacggctcgcccgctgccactcttatttattatcattgagatttaaaaatcaaacatgattatc

SEQ ID NO: 669 - DNA, 10055 bp, Oryza sativa
ttatggagaattactgagtggtgtgtctgctaatcaagtttcagtggatgatatttgtctttagatcaagtctaactcaagatttgacaaccttttgtttacgaagataacctatcaaatttaaaacttgtgcggatcataataagaatgtaaaagaaaaaagtaaaaatgtacttccccttgctataaattacttgtcattctaaatttgtttcgtgtcaaatatttatatatttgactatccattttagaaaatcatatagtttaatatcataaggccataagaaatgttttttaatgcacaaatttctaaaagttggtggtgaaaacaaaaatatttaacttcgtataaaaacgagggaatcattttcttttcatatacaaaataaaaactaataatgttgcatgcttggttaaaaaaagggtgcggtgttatatgtctagtggtaagtgtgccatacctcttttgtgtgatggagaaaaaaaaattccctccattccaatttgattatcccttgagatttttgaggtattatcaaattgatgatcgtctaaccgttgtctgttcgtttaaccagaggattttgtatgtccgttcgttgtgtgcagaagtagatgctattatgttgtctatttatttatctatgtagaagtaaatgacatcattatacgtctttcatgcttgcaattgcacatttgcatgtctatattcataaattgtgtttaattttagaaatatgtttttttctttgatctagcaagtgtctgtggttacttcgttaatcttaaggatttaccggtctagtattcgtagatactcatagtggtagagtttacatgcgtgcgttcataggaacgagtgtgcgtgtgttatgagtgtctcgttataccgtataattcttaaaaaaaagaaaaataatagaaaggcatctccgtcaatcgcatccgtccatgagcctaatactcgcccaaaaccgtccgattttttccgcagcgacgactcgtcagtcaatcagtcgattctcacgacgacgagggcgcgagacgccggcgcggtcctccccgccgcggcggcgtacaaaaccccgggggaggagcagccgccgccgcctccgcaatgccgcttggcgtcgccggagcagcgccaccaccatggccgggggaggggtcgtcgacggcgtccgcagatggctccgccgccgccgcggccgcaccgcctccgcctatcagcccttgcgctcgtcttccctggcgcgccaccctggcggcgacggtgggctcgaggtggtcccgggccccttcgcgctccccgccgccatccgcgtccctgcgcgcaactcgccgccgccgcccgacgcccagctcaggaacgaggttcgtgttcacacctgcccgcctcgtgtcagttgtgtggtggtgaactggtgatgctgttaaccctcgcgtgtttctcggattccgggttgatcaattgacaggctgtacgatgggtggaagctcacgtctctgccattttcatggattcttctggccttttttttcacgagaattcgatgcgattgagtggttgaagggtgtgaactcgatcgaatttgacttgtagggtgtgtgttcagttggtcgcgccgggagtttactcggtctaaagcttccccgcttttgctctgaaatttcggtaaaaaaatgacgtgtggcattgcctccaagttccaaggcaatctgactgtttgatttagtgccagccatgtttcttccgttggtcaagttccacggcaatctgtctgcttgttttagttcctaccatgtgtcctcccttggtctaggtggtggtggtggcacagcagaacaattccttcaaattcagtggtagcaagtaagaaccttagcttttctttgatgctattagcaattggagcaaccccttctagctcgagcaatttgtagcatgatgtggtagtgggccttgtagggaaaatatgcactttcccattcacaatgtgcaaagcttatttccggtatgattttgatgggttcttggttcgaagaatagttgtcttgtgtgtttcttcgctaaaagccacactgtttttcattcttggatacaaggatcgcgcagctctattcttatccaaaatttctctttgtttattttatgagcaattttacggtccttgaagagataccatgaggtaccttttttctattgtaaatttggtacctcttggtacctaggtactataaggtaccatgagataccaaattttacactaaaattttagtatctcatggtcctcaaggaccgtagaattgctcttattttttatataaaaacactcgccttcaagtggatttggttgatgctttattccaattttgcttcctggtggttctgtctgttaggtggcttctggtgttggtattttgcaacaggatgatcttttctcccgctctgcttgtgctttccaagtgcttgaatatattcttaccgtgccatggcaaaagaattattctgtagaattgtcaattgtggtgggctatggctattctgaccatgcaatttcacaggataggttttagctgttgcttgcttcacgaaggtgcacttctcctatttcttgtttggagctcaaacctttgtgtccctttttattatattaattcattaggtcaaatttatctcatgtgttctaagttccttccgtacacgttccatttagttttttgcttggatagttcggcagaagctctggtgtccttgtctttctgatgtcgttggcagtgacagattctactgatagcaaatcttgattgcaccttggatccaacttcttaatttattaagtttgaccttgagggtatagcatttttgtttggctgaaatctgactttatcactctgcccatgataattataaggagaagagcatagatgctggcctttgctatttttacttgctctgctgtttatctttctgttgataccatgagcattcagaaggtacctcagccactttcctgaaatgcttgggcagttgtattacttttgatcgatgcagttcaaaactctaatcgtgtacttcctttctctaatgatccttcatgtggggctcatttgttattgagcaaggtatatactagttacttctcttgtgttattgccttcacgctatttcgactagttaatttgttctttttaagcaactctgatctccatttccttacatatatgtaaattggttaccttataaatcactgcatcaaatgtgttttgatttttatgctcacaaccttctaagctgtggagcttaacatgctcaaatcatctcccttcctgtggatgaggaatgcatcctgtttcaattgttcatatgccacatcgaagctttgtggaagggggtggtgactctctgctgcaatctgattggatgactattgcttagttggtaatcagggtgtagtgttctctgctttggcagcaacaagaaacagcatttgctgttgtgtctccgtgtagggggttaggacctgggaacttaggagcttcatgaaagatgagatatttgttcatgataggtgagatatggttgcagagttggatgtaaataaggaaaggacgatagttaggaataatgcacctgccagtttctttgcatcaagaatggatgtttgccccttagttcatagtagatatctaagataaatgaaaaggcaacacatgacttttcagggggatgatgcaatagtaggtagtggcgtagtgcttgtccacttgagtgcaagtatctgtctattataactttgaattcgccaaaataaccacgagaattttggaccatgaatgaaaattgtgaagaaaagcataatttttgggcggtacagtgggctagtgataaattgcatactcatgctaactgtttggattagcaaagttcaaaattctaatattagtatcgaggatattgcataaaatccttatatagatgtattagaaaacccagattgagcaattaatttcaatttagccttgatgttctttaaaggttttgatgcactcttaataatgatctgccaattgtttgattttcttttttgcacgataattacatggtgataactatgatattgattttatgttcatgtggaacagagttgattgttataacattacaaattaaaattacttaatcttccacattttgttgtagctagaaatagtgcatcctgaccactgtatggatgttgaatcaatgcatgcagtctctttgtagacacatcttcaaagaaatccagtcttgattggtacaaactgaaacattttgcaaaactatccaatgtaaaatgtcgaaatattttagaattttattcaaattcttgtttaggtctaatgactctaacatggaggctagagatgatatgaaccaatggaattgtgcaatggttaggcacttagggttctttggatcaacgtgtgttcgccaaatcttttttatgctacatgtcttcttctgatgaaagatacatccctcttacgttacatttactctttttcatttatctaagctgcaagtttaatttaattagttctccatcaatatggtgcaaggagctagtagcgtagaagggtgcacaacatactggtgagggaaaaattgatgtgggcccacattatttttggacaaatccatcccttttgcctatccctcccctttccccactctccgaactcctaacctagtttcttcattcttcgataatcttcgaatcccccctctcctacgaccgcagctacctgttatacctagaaatccgacccctgttttttcttcccaaatcagattttgcttcctgcggtgccggacagcatttttggccttggaacactgacgacccacctaattcgaatcaccttattacatcttcgatcgttggtctgaactcgttctcgttctctttccacctgattctagttgccttattttgtaatagcttgtgaacacaattcatctatatgtagatctttttttgctttgacttaactgcattgctctgatttaactatgtttgttactgatcttgaccattgacatcgatcaataacatttttcctttcctgtttttatgttttgattatgcatgtcatttgcttgaagctacttttgccatattgatgtgtgccattacagtttccaaattatcagttgttctggttcagtttattttatgtcaacttcgattaatttgcaatgctgctttgctttctttttggtccttttgattgtcttattttactggattgttgaggactcctaaaatgttccctcacatgctctatacacattttttctattctgtgatggtctatatgattttgggaaattgtgatgttttagagaacatcggacatggagttctttacggaatacggggaggcaagccaatatcagattcaagaggtcgttggcaagggaagctatggagtagttgctgctgcagtagatactcacactggggagagagttgcaatcaagaagatcaatgatgtttttgagcatgtttcagatgccatccgcattctgcgggaaatcaaagttcttcggcttctccgccacccagacattgttgtgatcaagcacatcatgctccctcctacccgaagggagttcagggatatttatgttgtttttgaactcatggagtcagatctacatcaagttatcgaagcaaatcatgaccttagcccagagcatcaccgttttttcttgtaccaacttctttgtgctctcaagtacatacattcaggttagtgatgaaattagcatctaattaaccttgtcaccaacagccacttcattccaaatctgtatactttgtggaagttatatttcaaccattaatcattactgagtttctgatatatggtttaacttgtctcagctaatgtatttcatcgtgacttaaagccaaagaacatactggccaattcagactgcaaactgaagatttgtgattttggacttgcacgtgtagcatttaatgattcaccttcaacaattttttggaccgtacgactttattttctctataacataatttcccctgtaagattttcatagacttatactgtggtttgcaatttgaaggattatgtggcaacaaggtggtaccgagctcctgaattatgtggttcttttttctccaaagtaagctggtcattctgtaacacattgtgcattcctgaaatgtgcaagtccttcagatttgtatataattttttcttaaaaagttgcaaattctccaaatacaacttcttgtgtcaagatacaaagacgtatttaggcttttatcagtacagtatcacccatttcccttaatgagaagtgctaaatttaccttcttgcattgggcgctgtcatatttgttttttacaaaactgatgagaaagatatattcccatattttcatattcatgaagacagttgattttgtttgtacagtacacccctgcaattgatatttggagtatagggtgcatttttgctgaaattctcaccggaagaccattatttcctgggaggaatgttgtgcaccagttagatctaataacagatctacttggaactccatcatctgaaactttatcacgggtatgccagcttatcacgcaatcacaagaaggagaaatattacttatgagtttgctattttccattgtttcccatgcgagacatattaccttctgtgctattgctggcaatgaaatgcaattcctggtgctctactacttgtgacatagaagaacttcaccagcacagacttccctctttgtagatattatgccacagaattccttgttcatcaatatttgattgcaaagtctgagacacagtaaattatttcctgtctagtaatgtaattgtgatttctgctattctaatcacatgtcttgcagagacacatgagtattcatgcaatgatttctttaatatttaatataacacctgcagattcgtaatgagaatgccaggggatatttaactggcatgcagaggaaacatcctatccccttttctcataagtttcataatgctgatcctctcgctttgcgcctgctagagcgtttacttgcatttgatcctaaagatcgacctactgctgaagaggtattttcttttggtggaaaaggtttgggtaaattggaaccatgccattataattttgtaaagtttgagatatgccatcggtatctcaataacatgtaagacccacatgagtcaatgacgtgtgggtcaggatggcatatctcaaattttacaaaattataatggcatggttccaattttccctcttattttatgtccaattaatttcacaagtgatttctgatgagtaagcataacctttcctacttactttaggctttagctgatccatattttagaggaatttctaagttgagccgggagccttcaagactgccagtttcaaaatttgagtttgaatttgagcgaaggaaactgacaaaggatgatgtaagagaaatgatatatcgagaggtacaaagctaccgctccattttatgttatgggctggctgataaatccatctcactcaaaattacttttttattttctgaaagtaaacagatattagagtaccatccccaaatgcttcaggagtacatcagaggtggagaacaaattagcttcctctatccaaggtgagcaaattagtttttaaatctagtttgctggcgtgctttaaaaaaagtattgttcattcggtggtgctttatttcttcatacctagctggtttgctttattttctactctccggggaatatgattgttttacgatagtgaaaaaacataatttgtatatattttcatgctgatagtgctggcaggtgatataaccaacacccttatccatgtctcttttgctaatactaactccttacagtggggttgatcgtttcaaacggcagtttgctcatcttgaggagaactacagcagaggagaaagaagtacccccttgcggagacagcatgcgtctttgccaaggtatatagctggaattcactagctcctgaaacttaaaattgcctaaaatccttttttttatctgaacagagaatcttatgtggttcttgttctgcttgcttctttacaaaaaaaatcatgtgacagggaaagagtatgctcatcagtagatagcaataatcaagactctgacaatgaagagaggagagcgatatcttctattgcccgaactatgataagtcccccaagatcacaagaaaagggcaagaatcgtgcatctgcttatccaaatggcataatcaatctaaactccaatcctaagatctatttaaagagtgctagtatcagtgcttcaacgtgcatcattagagggaataaaggcccgaaggtatttgcctactgccagtatgatgacagtgcttaaattttagcctgacacttggtaaatcttatgagtaaattatcagtgcattttttccctcgtatctttgtttttgtgggtctgactaagttttactctgtttcactttgcctttttttttttcactctgaaggagaatggtatctctgaggacatggaagaggttgtctatgagttgtcagataatgtgaccaggatgctctcctagggcatcagtaaccagcgttcagccggccatgatcttgatgcaattccaaattccaataactgtttataccatcagtatcatggatccttgcctatatctatgagctgatactctaggctcttagcttatatcacctattgatcatcttccaaaagcatcaagcttggagaaatgagttgtctttgtcaattcgaggccaaatttggcaactcggcttgttgtacatgcattttcctcatagcctggcagtgtgtgatgactctatctgccatatgaacaatctggcacttttttaccttagtaccatattaccgtttcagaacaaaatcaacagatctcaatggtaattggtaaattatgtcaatgcatgccatattatcccagaattgcatgtgcaatttcatatcatttctagcattcagttggggggaactggctagctgcatgcatacaggttacatgcagcatactggtgtgaagtgcaaaagtggtgagtgggagcaggtaaatctgttgcaagctctggccagtgacacaccaacacgatctacatgcagagcctaatccacaacattttagcatttttttaactaatacaactgcaagtatatatgcattatgcaacagttacatcatcattgagcatcatttaagcatatcaaatctatctatctagttcaggatagaatcattagagcagcatgactagatgatgcacagggaagacctagtcacctgctgatatctagcttacttgaatatgtatcacataactgaacaaccactccaccatgtgcagcaagtctacaataatgccaacaacttaataggacagaattaaactaacaaatgttccatagtttcatgcaactatgcaagcatgctagatgaacaaaatatcaaccaaatacagtcttatctctgccaagaataaacatctttgaagtttcagaaagccagacattcttggtctctgaatctctgcaaatatatatacatctttcaatggacagatgacagagtagaatccagctgaattatcacactcgggatagaaaacatctgaaataattcacacatatatttccaaactttcactgaatcagaagagaagaggagagagtagattaatattcatgagcagcttgcacacatggtcgatcgtcagggcgacgccggcggcgagctctggccgcgctcggcgacgtcggcgtcgaggcgagcgttgtgccgctccgacgggccggacggcgggaggaagtcggacgtccggcggtgcaggacgccggcggcgccgggctccggcgaccgccgcgcccacgcgccaccactctcctcctgcagcatgtgcctcgcgccgccgtcgcatggtccgcagagcagcac

SEQ ID NO: 670 - DNA, 8096 bp, Oryza sativa
ggagatgtgaggggacatggcgggagcgtcgcccatggcgaggacgccgttgaggtcatctccgccgcccccaccggtacccagctccccgtctccttcggcgctagggcgggagaggagaggcacgacagccgttgggagtggagcggccggttcgagcgagcgcacgagcggggccactgccacctccgcaacccgcactatttggctggcgctcgccgtgccaaagtcggccgcggtgtccatctggatgaacggacgggaagagaaggaggcggaggcggaggagatcagggaaggagagggggcgacgaccttactgctaattttttcgctgatgccgatgtgatgcaatgccgcacctctccacgttgcccttatcttcgccaggcgtcgcccttctccctgctagctcctttccaccgcctgtcgggcgtcacgcccggagagaggagatgggagggagatgaagggagatggggagagaggaggaagaagaccgcccgggagagagaagaggggagtgagaatgacatgtggggccctcgtggccccaccattcttaattattttttggtgcagctgacatgtgggcctatggtttattattattttccagatcaaattgccatgtaagcgctatgccaatgccacgttggaagaagacttagtcaaattagccatgtaggagccacgtcagccaaaaccagggacactactgtcgaaggatctcgtttgcacagattttgtaagttgggagaccgattgtatcttgtttttcggttcaaggacgaaagtgggattcggtatcaagttgaaggacctgaaatgaacttattccttttctggactatacaactggacgaaaacttgtactgcttggggcaggccgggcaaaaaggtggctacgaaaagcccataccactaatgggcctcttgactccttgcgcttcctccggccttattactcccctctcccccgccccctcccctctcccccacgtctcgtctccccttcccttcccccccgccgccttcgccgccgacgcgccgatctccaccaccccccacctcgctccgccgccgccgccgcctcttgctactgcctccctccctccgccgcatactcccctcgccctccgaccactccccctcctctactcccccgtctcctcctcgccacttcgccaccccgccgccttcgccgatcccctcacccatcccgccgcgagctgagcagaggagccgtgggtttccgtcgtcctgctgcttccgcctccggtgagcacccgcgccctctcgttcttctaccctaggacttatcctctcttgtagatctggaagctaagctaggttttcctcgttgcgttagcgttagtactaataatgacagttgttttagtttgttttgaataaataaaataattagttagctaatgatgtggtttgtttcagtgatcgagtggtgcgttctcatcaacgggccttgtgcgctaaattatgcgatcttcatgggctgactcagctgcgaacgccgaggaatcggcgcccgcggctgctgctaaccacggcaactcgcgcctcccgcgcagctcatacgttcccccgcacctccgcggccaagcggctcctgcagcgccggcgcaagctggcgcgctgccctcggccgccgccgccgcgcagccttctgttggccagcctggtgtggttggtggccctcgctgggcgggcattgtgaatggtggtggtggtggtggtggtgggagcgtaggtggttctcgccagggctttggtgctggtggccgcggtggaggaggtggtggtggcggtggtgcatggaactcccgccctgggggttgggaccgaagagaccgtgaaccggatccttttgccaatagtgaggctgcggaagttgactttgagggcgagaacactggcatcaattttgaagcctatgaagacatccctgttgagacaagtggccatgatgtgcccccaccagccaatacatttgcggagattgatttgggtgacgcgctgaatgagaatatcagaaggtgcaaatatgtgaagccgacaccagtgcagcgttatgccatcccaatctccattgcaggacgggatctcatggcctgtgcacaaacaggatctggaaagacagcagccttttgtttccctatcatcagtggaatcatgaggtcaaggccaccccccaggtcacggggttccaggaccgcatatcctcttgcactaatcctatctcccactcgtgagctttcggtccaagtatgtccgactgaaccttgtgttcctctttgtattatttgcagaactatcttttattattttggttgattcgcttgcgatatttcattccatagatccatgaagaagcaaggaagtttgcataccagactggtgttaaagtggtcgttgcatacggaggagcgccaattactcagcaggtttgtgtctatttagtctatgatacgtttcaaccgtaatgccttgtattttggtctgtgcatacctgagtttcacatgctttgccttgtcaagaggattgtacacattttctgctttacttggacatttgctgatatgatgcatttacatccacggcttaaaattttaaatcgtgccatctaagagaactgaatactttagcaagttcacgtgtcacaatctgctacgataaaaaagaatagaatattagtgcaaggccctcatttgtaaacatcatagttgtactggcaaagcaaaccttgtggcctgtgctttaaggggcttttttgttggtggccacagtttgtcacaccaaaccttatgcgcgccacaatttcttaggttagtatttgattgagtgccacaattgagtcaagccatactttattagcacattggcccacgcatcatactctcattttctagccaaagtttgccatagttgtggccatcaaattgttagccacactttgtgtggcttgccacagttatatggcaaatggagttgtggcaaatgaattgggccgcttgcccagaatttgtaatcccgatttagttggtagagaggcaacattgtgacaagttcatgaaatgtagttatgaaatgacatattcaagtatctgtttttaaattgctaggctctaaattgggtttaacaaaatccaatcttgatgaaacttgagatccaaggagagcaaacataccttgaacaaaactaaagaatactatatatgtagcaaactaaataacataaattcttcttattattgcaataattcaagtgggaactttttgtaacataaacttgtgtatgcttgacagaacaagaaatacaaatataaaaggtataagctgacatttgaatgctaggaatgggtcttaaaatgtttttttccatgtaattggatattgtactaagtaaagtgtatggttgtttttgtagctgagggagttagaaagaggtgttgaaatccttgtggcaactcctggccgcttaatggatttgttggagagggctagagtctcactgcagatgataaagtatttagctcttgatgaagctgatcgaatgcttgatatgggatttgagccccagatacgtaaaatagttgagcagatggacatgcctccacgtggagagaggcagacgatgttgtttagtgctacatttccaaaggagatacaggttcgcttctttccctagtctggctttctgctattcgatcgcatcactgaatttgattgcagatttctgttttctaatgttaatcatttttgggagttttattcccttgaatagtgatccatatgttgtattttagttctctatgaatgtttgcatattttgttttagagtaaatttcacaaaactacaggtattttgaccaaattatcacaaaactacagatttaaggagttgtatcacaaaactacatatttagcaccaaatttatcacaaaactgcagattttaggttaagtatcacaaaaatgcatatttaatattgaacttatcacaaaactacaacgtttggagtttaaatccctagcaccattgttatggtggagctataaacattattactttgtgattaaattggttctaaacctgtagttttatgataatttagttactccctccgtcccataataggtgacgtttttgactttttatttgcaacgtttgaccattcgttttatttgaaaaattagtgcaaatataaaaaaagataagtcatatgtaaagtacttttgataataaagcaaatgataaacaaaataaataataattccaaaattttttgaataagacgaatgatcaaacattgacaaacaaaaactcaaaaagacaaagtaatatgggacggaggtagtactaaacatgtagttttgtgacacttcatcttaaatgtgtagttttgtgatatatttggtgttaaatgtgtagttttgtgatacactgagttaaatctgtagttttgtgataatttggtcatagtatttgtagttttgtgaaatttactctttgttttacagatggtttttgtattttcatattgcgattccacaatgaccatcaaattcatatgcttaaaacgttgtacatctttaaagtgattggatctagttctaacatgtgcatgttagaaaaatgcatcctttttgttttctctgtggttagttcattagtcccgaaagtttttgaaccaagctcacaaatttttgtttggttagcagtgaaaacctaccatgatctcacaaatgttaatcgttccaaagttaccagtattttccctttgggggcatggttcctgcataaagctaccagcatctaacttagtgttgttactgtgcctgcataaaatacaaggattacactaatcgcccaatgatttactgatgcagagaatggcttcagatttcctcgccgattacatatttcttgctgtcgggagagttggttcaagtactgatttaattgtccagagggttgagtttgtccttgatgctgacaaaagaagctacctcatggaccttcttcatgcacaaagggcaaatggtacacatgggaaggtactgtgtatttcaggctttgttgatctgttattttaataaaaattcatagatttagtgtgtatatatgacacaaggcatcccgttggctattctaaaatcatattgttttcatacttgttgacacatttttaataatttcttgtgtttcactcattatttcagcaagctcttaccttggtctttgtggagacaaagaggggagctgatgccctggagaactggctttataacaatgggttcccagcaactagcattcatggagacagaacacaacaggtgtggctttgctttgacttgcttgcatacagaagtgtattcttagggcctgtttggcacagctccagctccacctctcttggagctggagtccagccaaacagttttagggcctgtttggtacagctccaattcctaaatttaactccaggagttgggtctggagtggagttgtggagctgcctaaacccagctctacaactccagttcattttgtaagagagctccacccaactccactcccagttttgatggagctgaaactgtttggctgagctccagctccaggaggggtggagctggagctggagctgtgccaaacaggcccttagctccacctaaaatgggagtggagttgggtggagctctctcacaaaatgaactagagaggtggagctgggtttaggcagctccacaactccactccagactcaactcctggaactaaatttaggagttggagctctaccaaacatgcccttatagttatatgtcagtgtatggcagaagctgtataaagatatttgaaaatattaccatggcaacactgccttgttcacttagataagtcttggatatcattgcatgtttgtttaatttaataaagttcaccatatgtacactcagggtatctcaaaatatgtaatgaaaaaggttaatatacctaccaaatcagtaattcaaatcgagtctctgcatttgcatgtggtgtatgatgatgatcacatcatacttccatcatacatctcccagcaatacatcttcacgaagacccctttttttctgtagccattctggattacaagggtcaacaaatactgatacattgtactgtgcatgtatgctttctgaaacatttacatttgccatgaaacatctactgttatacgatgccattatcctcgtattatggcttctgcaaggtctgggttgaacatgatacatctgttctttatacaggaaagagagtatgccctgagatccttcaagagtggagcaactcccatcctcgtggcaactgatgttgctgctcgtggactggatatacctcatgttgcccacgtcattaattttgacctcccaaatgatatagacgactatgtccatcggataggaaggacagggcgtgcagggaaatctggtctggcaactgcatttttcaacgagagcaacaccccactggcaaggccgctgagtgagctcatgcaggaggctaaccaggaggttcctcaatggcttgagaggtatgctgcccgttcatcgtttggaggcggcggcgggagaaaccgcaggtcaggtggtggtgctaggtttggtggccgggacttccgacgagacagaggcagtggtggtggagggtatggtggtggaggtggaggttatggaggtggcggatatggtggtggtggcggtggaggcggctatggtggcggtagcagctacggaggtggcgggcaaggtttttctagtgcttgggactgatcctgatccagagctgtcatgagaactgaaatttgaaacaatcgtgctctattggcctccctttggtgacatggaaatttgaaatttgagttgccttttgatgatagtatggtgtggcatcgccttcatcattggcggttctctcagtctggtgttgatttttccttttttgtgtactgtactagggattgcttgtgtttttttatctgcgaattgtgaactcatcttttaatggggcctcttttattaatttctcctttctactgtttcatttcgcatcgatgctttactgcctgtgtatgtttatttacctctttcatatccactggcaaagtattcatgttagtttaccatgcaatgctaaagctaaaagcatttgctagttattgcttcaactattccaataatcagagcagtatttgttccaataatcagagcagtatttgtttgctagtcatttcattggcttattgttccagccggcatcactcgaggaacatttgaatgccattttccatattctgggtctgtttagttcgcaaaatgaaaatttttgggtgttacactggacgtttgactggatgtcggaaggggttttcggatacaaatgaaaaaactaatttcaacgaggcgaattttgagcctaattaatccgttattagcacatgtgggttactgtagcacttttggctaattatgaactaattaggcttagaagattcgtctcacgattttctctctaagtgtgcaattagttttttaatttatttatatttaatactttatgcatgtgtccaaaaatttgatgtgatatttttgagaaagtttttggaaactaaacagggccatttggctggagttttaaacagattcctcgctggagttaaatatggaccctaaatttggctgaggaaaatcagtagtgcagatatgttatgataattaccaatttttcatcaatttcgctagccgcgtaggacactgcaagttctgcaggctagtttagctacattttcaaagaacagattttgcaagtctaagagctagtgaaaaaaaaatgacggatgggcattggactacgcagaagcatgggtccaatttttttttataacgtgtcatgctttgcacattttattttatggccatataatttttagggtaatttgaagtaagcacaaaaacattcacccaaataaaaaaggtatgtatcctatttgaaatgcattcatgcattgggttcatatggctcactgttt

SEQ ID NO: 671 - DNA, 7333 bp, Oryza sativa
gaaatcaaaatataaaatagaaggatggagcaagcaatgagttctctccatttcaattaattattgttagctttgttctgagtcaaatattgtttttaactttgactacaatttttgaaattttatatagtttaaaaattatggtcaaagttagaaattaatatttgataaagttaaaacggagggagtaactaaatggagtacgatcgaccacaagtagagtacgcatgcagtgccacaactcaaatactaaatcacaagaatataaagattatatatatatatatatatatatatatatatatatatatatatatatatatatatcggattccgatcttgcctgtacgtgattgggttgattgcgttgcgtgtgaaaaacaaggagatatagttatgatcgacaggtagaggcagatatatagtgcagctgtggtacgttacgttgcatgcggttttccagcaaacaagcaaaaactaacgacaaaaaaacaaacagacagatcgatcatcgaccaatctatatgcatgggatgattcgattcgtcatgggtaaataacaacaagtagcatagcagcagtagatggccggatggatggatcgatcgagcagcactcaatccaatccgtcccaattaatatcccccatttatatctgtggatggatgatggaagggagtagtacttcctccgtttctttttaaaaaaaaaggtaaacttaaataaggatgagatatatgtctagattcattgtttaagttatatctcattcttatctatgttagttttttttcttagatggacaaagtacacatgtatagataaaatgatcaaacgagatggatgagaaaaacaggtaattaactactcctactatttgtatttatttattactaaatagatactatttctaaatgtacagcacctgtggatcatagtacaccatgtacacgagtataaaataaaatataaatagggacatccaggtcatgtcattcatttctagctagttagtatctcatctcctttttgctgaggctgagggagaggcagaggctgcctcacgcatccctgtcgatctcggtcaagaatggggttgctgatgaggcccgtcgccttgctcatctactgcaccaccgcctccctcttcttcctcacctcctcctcctccgccgccatcgccggtggcacgccggacggctcggaggagtggggctatgtccaagtacgcccgagtaagcatcttcaactcttcttcttcttcctcctcctccttttactttgatgatattgtgtatactagcttattattgggtatatattatattgatccatcgatcgaaataatatgattatgatgttggtccgtatatactatgtacgtgcagaggcgcacatgttctggtggttgtaccggagcccgcagcgcgtgaacaacaagggcagcacgccatggccgaccgtgctctggctccagggaggcccggtaatcaattcattaattaaatcgtacatatatatatatatatatagtcatcatccagatgattatatatatatattgattgcaggcagctagctggttccgatatcgatcgaccacccatatatgcataattgattaatttactgattgcataattatttatatatagtatatgaaatataattaatcatccagctagctaattaatcaacaaccattgctccctccaatgttatcgtagtagtacgtacgtagtatcatgcatcttgtgtagttaacaaacaagcgatattgcagggcgcttcgggcgtgggttatggcaacttcatggagatcgggccgctggacaccaaccttaaaccccgcccatccacctggctctccaaggccgacctcctcttcgtcgtaatactatgattttgcttaatttcgatctcattatcttaaacaaattttctggagagagagagatagagatagagatagagatagagtagttgtaggttggtgaaggatgaattgaatggtgcaatgagatggcaatggcaggacaacccagtgggcaccgggttcagctacgtggagggcggcgacaggacattgctggcgcgcacggacgccgaggcagccaccgacctcaccactctgctctcccaactctaccgcagcaacaacacgcggctgcaggggagcccactttacatcgtcgcagagtcctacggcggcaagttcgccgtcaccaccgccttggccgcgctcaaggccatccacgccggccgcctcgccgccagcctcgccggtacttacacccatatatccaccattgccccatttgcatctatctctacccatatacacagtaatctctttattatatacctacaccaaatgaatgtgtatatatgtaaacaatgacttaatcttcatgtctttatgcaggagttgcgcttggtaatagctggatttcacccgaggactcggtggtaagtactagctcaatactcccatcacactagttaataaatttagaacgtatcatgtttacacgagtcttctcgtgtacaccccgtatatatcttgcacaccaattaacaaatttcaaaaaaaaagaaaaagataaaatttccaacagcattacacttatgtgtaaagttttaacctcaaattcactgcattttgagagtaaaaacaaagataaaatttcttacaattttaagggtataaattgatcacaattttatcctttttttgtgcttcttatgtagattgaatttcaagatggaactttacacataaatgtgttactacctaaagtatatgtacaaacgtttttttagaatttttggtgaagtttgttagttggtatatatattgtgtacatgaaaaatattgtggatatgatatgctctcaattactccatcagtctaaaaatataagagattttgaatgggtggaatattttctactactataaatttggacagagagtttatctagatttgtagtagtatgaagtgttctatccgtttaaaatcttttatattttagaacggaaggagtaattagtaagaggaaaagaagatattttgggatttgatggaaataaacggtcgggtgcctatatttgttggcagctttcgtgggggccattgctgtaccaagtgtcccgccttgacgagaacggcctctacctctccgacaggttaacttactactacactacttttcgtttcaaattattagtcgttttaattttagttaaagtcaactgcttcaaatttaattaagtttatagataaaataataatacttttaatccaagacaaataaattatgaaagaatatttaattatcgatttaatgaaactgatttggttttgtaaatattatagtatatttgtttacaaacttagttaaacttgaagcaatttgactttgacaaaagttaaaacgtcttataatctgaaacagaaggagtgctactttttattttcatatcagttgcatgcaatggttggctagttagttgcttgcaattcatccgtcccaattcagtctttttttaattacttattgtttacaaaaatggatattaaggcgacgtataaattaaacaaggcaaatgcaaatgcaaatgcagcctggcgcagcagatcaaggcgcaggtgaaggcagcacagttcctggaggccgagaacacatggcaaagtctggagtccatcattctcgagcaagccaacttcatcgtgcgtctcactaatatttatacttatatacatatatgcacagagtttgtattagtttgtgaaagagaaatgtgatgggtgcaggacttctacaatttcctcaaggatgactcgtcgtcggatgctaatttggagcagcagcagcggcagaggctactggcgtcgctggggcagtcgaggaggcgctactccagctacctgagctccaaggtcacaacggaaggcggcttcgagggcatcatgaacaccgtcatcagggataagctccggatcatacccaaaaacgtcacgtacgtataccaacattattttacaacttacatatatatgtataatgcacaatgcatgcacatacaaatgatatagtatttcctatgtttcaatttatcccaatttattatactagatgtatcaaatctcatcttaggtagtaacatttctgggacgaaggaagtatatgggatctctgaatttaattgttgtcccatctaactttaattatatactgtccacgatcgaaatatatagctggagcgagcagtcagacgatgtgttcgaagctcttgcaggagacttcatgaaacccagaatccttgaggtcgacgagcttctcaaccttggcctcaacgtcacaatctatagcggacaggtatcaaactcaactctcctctctgctactcctacatttatgtatgggtctttcaacatgtggatttatcgctttgtctgatccatcgaccaattacttgatgtatgtcagcatgttctacctagcttacacccaaacattacacatcatgagtcctggctgttgctttgcatgcatggcactggcacagtatcatgcttcagttgtccgtcaggaaatgtgttatcacctgttgttttgtttgtccgtccccgtattgcctagtgtcatattaatccatactcatacaaggtactagctctacagtacatgctctttgatcgccagcaagaatatattccacatgacagacagcagtgcatgttgcacacctgctggtatcatcagcatctctagtccatctatcggattcgtgcaatctcatcagacacacatacatatcttcatcaggctaccctaggtgcatatgtatatgtgatgtgatatccttaggcttatcacgggcatatatctggacgaatatatgtgtatgtcagctccatgctttcttcttgtactcctaacttttgtttcttgcaccaacacacaaaggccaccaggaatatatagttgatttagcttcatctattgggaaaggcacaacctacatcgtaacagacacatgacccctaacatgtgtgactgtccattttgtctcaacttctgaaccatattctggatatatatatatatatatagagttactaaatgccaaatgcatcgcagcaaccaactatatatataaataaataaataatatatctgaagatagccaaagtttagctttcttatagttaattaattggcaattgttcattcagcttgatctgatctgtgcgaccaagggaacattggattggattcagaaactcaagtaagcatttgcagtttctgcacaaaccccccctctcttattactgcagaattaatgcatgagaagcaaattacaaagacaagtggtttaatggcccatgcatgcctgttgtttgatgtcaggtgggatggtctgaagaacttcacaaactcacgcagagtgccgctctactgcagtggtggtgaagcagctggcacccaagccttcctcaaatcttacaagaatctcaaattctactggatactgggagctggccacatggtaagtagtagtaacctctagctagtattccaacacatatactagtatattagagtaaaacaatggtattgttggaacctgtggtgtcagctaccctgattgcatgcaagtgcaattatttttgtgcaagcatagccatcaggatttggacaggctagattcagtgtgagctggaaagagtgtgcattcatgtagtactagtagctggtgagagagtttcttcaaggatcaatagcagcacatgcagaagcaagcaatacagtgcctttgagaaagacaagaggccggcagggacacatgcaccaacagtgatagatagatagggagaggaggagggatcagggatggagggagcttactaggacaggcaggtgaacttgtgtagtggcttcttcaatgtttgtcgatgctgaaatctattttccttctcttgctgacaggtaccaatagacaacccttgccctgcattgaagatgcttggtgacattacacaatctcctgctcagtagaaaagaggaggatgacactacatgctgacaccaactgaagattctttttctccttaatttctactttcacctttttacacagaaaagaaaaaggatatcatagcattgatgagataagaaaagatagcagagtgatataaatagagagagagagatctgtttcactttatattatagtactggtgcagctggtttttcggtgacagggtacaatataaaatcaaatttattgcatgcagcttgcatagtgcagcagtttcctgagtcatgaactgatatgacctgaccttggtttgatctcttcaatgctcaacatgcaatgcaaaagtctgattgcaggatatccaaaatagcaatgaaccacatcctaaaatcgtccagtaaatggtgtaacagggtaacagctaacaagcgccagagtttctgaacaaatgttcacttcgagatggtaacaatgttgcaaataaataaaaattgagcccctagtttcgcaagcaaaaaagggccaagcaacgcaatgtgaataatctgaaaccattctcaaattctactatagtacagcacacaacttcagtattcagctctgctgcagaaaattagctgttctgcatgctacacaccattatttcgaccccctttgcttcatgtcctacactgcaggctaacatctgaaaatctaaatccaagagcaagatgactacaaaaatgccgcgtatataactatagtttcttaatttttttattcaagctatttaccactgctcgagttctaaggtattcttggatacaacaaaatacaggataatgcctataaaactgcatcccagtagcctacacttttcccgtcttactgtttcaatttgtccagctccttgtcccagttaagaccaaacatttggcgcccaaagggcactatcagattgtatcggaaaacctgtaacatttgagaaaaataaaactccagattagtccattttgttctagtcattaagcatacacagggtgggcaggtagccagtagcaccttgtcatttatttggcgaatttgttcctgaagcagtctgtgatcatcatgccaggtagaacgatcatcctcagagcggttcgcccaagccttcctcaatgctgatctccatcgtgcaatcatgcctcgaatttccttgttcagctcaacccattcgggtgcgcagccgttccttgaaagtattctgtaaagtgtgtcttctgcaggatcagcatgagggtttgaattgaggtttaaaggtttt

SEQ ID NO: 672 - DNA, 7018 bp, Oryza sativa; identical to SEQ ID NO: 655

SEQ ID NO: 673 - DNA, 14904 bp, Oryza sativa
gtctagctccgcccctactactagggtgtttgaatgcctgtcacatcagatatttggatactaattagaagtattaaacgtagaccaatgacaaaacctattctataaccatagactaattcgcaagacgaatctattgagcctaattaatccatgattagcctatgtgatgctacagtaaatatgtgctaattatggattaattaagcttacaaaattagtcttaaaacatgattatcctattttctaggacgaacgatgccagcaattctgtactgattgagtgattgatttgcgcaaacgtggtcacgcagaatcaaaaaagtatacgaacgctaaggtgatgtttggatctagtgacttaactttagtctctgtatttagacactaatttagagtattaaatatagactatttacaaaactaattacataaatgaaagctaacttgcgagacaaatttttgaagcctaattaatccataattagagaatgtttactgtaacatcacatagtttaatcatggattaattaggctcaatagattcatctcgcgaattagtccaagattatggatgggttttattaatagtctacgcttaatatttgtaattagtattcaaacatccgatgtgataggaacttattagtcccatctaaacaggttctaaaaaaatcggcctttctttttttttcttcttcaaaaaagcgctttgttcatggatgccacgtgtcaacgcctgattcgaaacactgacatgtggggcccacccgtgtcacatggaacagctcaaggatctgcttcaccgcagcgctgatgctgccaagtatgcagccacccaacccccccctactccgccactgacaggtgtgtcccacaacatcctcacactgctcgtgggccccacgcgcagcttttttatttaaaataatcccgtacgttttttttaccaatactttttgtaatagtatccttttgcattaattattgttactgatttttctcgtcgttttcctttttctttcttttcttttatttttttttctaaagtctcctctccacctccagtcctcctcgttgtcttcctctgcgagagcagcagcggcggaggcggaggcggcggccatggcgggagcgggcggatgggacccgctcgtcggctccgagatccacggtttcctcacttacccaggttgccgccgccccccatccccgaccgcggccttttctatttcctctcgttttgttttgtttttttggttgattgagttcggcgcggggggatttctatggttcttcgtggtggtttttgctcttttttttttgtctcgtgctgtcttttctcggcgtgtttggttcgtttggggtttgagacactggcgtttgatgttttctcctgctagctgctgtagtttcctgtttttttaggtgttactgttcacacatttcccccatgttgagctgctgctgtgctggataggtgtgtttctgcggataatccttgctgtttgtggttcggtagcttgattgaagtggccgattgcttgttttggtttcgtgttgcttgtgttgttggaatttggtcggatgcttcgtagtttgcggggtttttgacagttcaattcctttgtctatctgattcttcctgcttaaatttcgttccgttaagtttcagggatttgcggctagctcaaagcttggtgttttttttttctaagctttagtttggcctgatatttttaggacactgagtttatgccgcattcgctgttgaaagaaataaatcaattttgagctgacttcttgattggtgtatgtgtcgtggtagacttgaactatgagaagctggtggcggaggcggcggcgcggtggttccggcctaatgagatctacgcgatattggcgaaccacgcgaggttcaagatccacgcacaaccggtcgacaagcccgtgagtatgtgttcatgcacccctttagaccctcatgtacctgccatggtcttttctttgatggtatgatgtgaactcaagggagcagagcataggggcacgttgattggtaaagtgttagagtgtaggaaggcagtcatttcttgatcttttggattggctgtcttgtgtgtgaaaaaaaaatgctgtcttgagtttagggcatcttggtccatcgcttaagaaataatgtgatggttgattttgcgatggtcttgcggtgttgagcacctgagcgtcccatcattcgcgttagatggatgaaagcatgttgagtattgaaatacatttacagtaggcataattgaatgaaattgctcttgttaagaaatatttgtgcaccaagagccgtattgttactattctgatcaaaataccatctctaggatcagattatggaatattggatgtagaaaaatttatatgctcccaacatcagttaggttaatattgctcaaaatgtaggtatccacttacgtattttctatatatcagttacctgaatttattatttgtcagcaacctcaccttgtacacaacattgcctaaaacttgctgacaactttaatagagctttaatgaaaatttttgtttggtttgattttatttatatgggaacatttttgttttattcttttgttgctggggattcatgaaactaaaattttgtgtttatgaacatcttttgttaccacgcatgcacaggaatttagtccttattcttatcctgtctatcttgagtattaaaatttcaaaatatcatctctatgatcataacagaatgtgcaatcatgcataacatgaatgcgtttctgtgtcttgaatgtaaactagttatcgtgcacgtgcaaagcacgttttagcaattcatatgcgaaagtacaacaataaaatgggacctttttcatgcagtgcactccatacgaattcttccggtaaaaattagagtttcatatcatagtatgatcgcaatttggatgatctttacaaaacatgcactttgtatcctagagtgacaacataagatgcagtgcaccagctgccttcattaacagaaattccaaagcttcgtatgaatgccccacaggacaactacatagaaacatgtgcatagatatctcatgaatccaaaaaaaaaaaaactttggagcatctctggctgagaaaataatttgaatcatgacactatatgatcactgtttctatgagattgctagaatcaccatctggtaaaacaagttcatcagctagcatctcatattctcattgatagaattgcattacagagaggaatacaatagcccatggttagcaatctcatggcggttgacctcaaacatatcaaaacctaagctaaagtgcaaaaggaaaagagaaaattaatatgatattctgccaccaagccacaccaatgtttgtaatatccatagcatgagaaatctttctccattctgtgtaaaataatgttcatttcaaacttgaagatccattactttcccaccagtattgttcctatcaaaacttaattgagatacatacgttgaaaaactatataatcatatccaaagtctaatgataatgaattaatgaatatataactatcgaagatcttttatgtctgaagtgagcaaatatattgaaaactgcattgaaagatgaacaagatgccatggaaggtaccgaagtatttcatgggacatgcagcttttataccaattttcatcatcacattttgtctcccttccatatctcgtccaagagaaacacaaaactgatcaatgtgtaaatttaactatcatcaatccctctccatagcctctccttggccttttaggcattgtgacaaacaacatcaataaagacatatacctactgatggccacatgaatgattattggatggccaatatctataagaaattctatgcaattacaggaacaacaataattgcatttaataatgagaaaaatattccctccataacgtttattgctgaagaatagtttgatatttcattttccaaaacactaagataatcattatatgtatggaactgtctatatgtgaattgtttatgatgcagtataatattattatattgaagctgcaacatagtgtttctaaattacctgtccttgttgacaatgttgacttgcaaagcctatcctattattcatcaccaagggaagtggccagcagcagcacattgggagaggaatgagattatatgtaattcttaaacaaaaaagaataatctgtcacctgtgtacatcaacaatgtaaattttgaaggtagcatcataacattagcatcacactgccatattgtcagaaatcaggatttctccttatttcagaggattaattgaaagcagaggaaccaaaaataagtgcattaaataaacaaaaggctgctcattaatctgatgagactctatcgttcctaatatacagacacaagattttgaattcagacttgaatctacaattcaactgtcagattgtatgaattggagatggggattccaaactcaccaacaaattcgtcacggcaacatcgagctgaatcaggtctcaacatgtcaccattcagctgaacaacaaaatacaaatagaggaccaatgggaaatcataattgacacatcgtttgccacaaaaaagcttgagcataagaaatagtgaatgattaaaaatgaaaaatgagagtcagctgccagcaacaaacgacatcgtcacgtaaaagcacttttaatacatacgctatagatagagtattatcacaggccaatataaattgtctgcaggtaaaataatggtagcaaacaaatcaaaatttagaaaagcaaaataatggacctgtcattgcagaattttgcggtgtagggcttagtacattacccattgaaattaatcagaatgcatggtgattgtgcactatcatatcatcgtagctcaataactccaagtctatttaattgaattaaaggcaaagtattagtgaactctaaaataaagtccacactctattggatgcaataaaattttgatgtttcttttagcatgaaaatatcagaagtacaattaattagaaacgtgtgacatagaaatactacctgtcattataatgctattctgttgattaatgtggaaaactatgcagttcttttgatttccatctgagctttggatttcaccacatgtgtcaccagagttcagtgcaataaaatttcttctactgcctaaaatcatacatcatgaattgttgtgagtactaaaagaagtagcagcatctaaaagtatagcaggttctttcctgcttgaactttcagttgcaccactatcatggccagagtctcccattgagtcagtagcagtagttttcacttcttaataatagtctgtatctagcgaagaaaaaaaactatataatagcaaaacagaaatatattgaacatatgtctgcactgcagattcctacaaatatgcatactgatcatgtctccttatccatcacacaaagcagcatcatcgtcgtgtctgagccatctgcagacatgaacagcaggtggaattagcgtcatgctaccatcgctggccccagtgccgcccttcttgctccacccatgcctagcacaaaggaacctccatacacacacacccggcacatacggacttttgcaaacctctgcatccacctacatacagacatacagctccaagcacatatacatctgtgacaaacaacacactgttttttattttcattataaaaagtcatggttcttgatccatctccaccaatgcttctcctaatcagaaaaaggtaacaccaataaaagatttgatcgatctccaccatatgcacaaatctaacaacacaaatcatcccaggggtgacagcaaaagaagggttgtgtgttctttttggtgattgtttctagggtttgagcaggagaaatattttacaaatcaaagcagtagatcgaagcaataccttgtgagtgatgctcctccatcacctagaagatgctcgccgacggggagatgcacggctttggttcttccacaccgaagccgttgtcgaatcagccgtcctggtcgaagctgcggggatgggtaacagcgggggcgagtgggcaatgccctcccagtacccttttcatcaaccgcggatggggccgaggtcggctctggccgcggcggtcgtggtggcggtggcggcggaaggggacctcgacggcggcggatggggccgaggtcggaaccggccacggcggtggggaagaagcagcggctccggcggcagtccacgcggggaggatctccagcgaggatgcagcgatgtggtggcagaacatgcggggaggaggagcaagcgaggaggaggagaagcgaagtcttcgcgggtggaggaggagcagcgaaatatccgcgcgtggatggatcgcgcggtggtgaaatcatgcgcgcagatggacggtagggattgatccgggtgatttggcctgtaggattggaaggagacaactcctcctttttatattagtatagattacaaattaatttgtgctttctctgaattctttcttttgttgttctgccatttctactagtcaggcttctctatgttcactttgacactgacctttttttttaaactctgctcacccatctgcacgggtaatttttagtggctatttgtcattcacctttttttcaccaataaaacaccactctatcatgcacgatattccataagaacattagtcactcaaaatttcttttatgctaactgtataattcagtccaaaatcccttatattttgggacagagggagtaactagggtatgtttctgattgcattacattgtgaggatttccacctcttgaaattatgttgaaaactgttgcatgcttccgtgaatcatatattagtccccagtttccagttccatccttttgctatcagaaactgttttgtgcattccaagcaaacatgagcactaactttcttttaaatcaggtggaactgttgttctatatgatcgtaaagtagtcaggaacttccgtaaggatggccataattggaaaaaaaagaaggatggcaggacggtccaagaagctcatgaaaaattaaaggtgaaagggggaaaacccaaaaattgcctgactggtgctatattctaataccccctttactggtattgatttgtgtcattttgtagattggtaacgaagaaagggttcatgtctattatgctcgaggtgaagatgatccaaatttctttcgaagatgctactggctacttgacaagtaagagttgaactccaacagttctatttttttttctttcaaatttcgacaaaatcgacttgcatcattgtttgcatcttatggtcttatctgcaagtagactgtgctcttttcagcagattgtgacaaatagctactattgtttggctaatacaggcttcttaagacatttttctgtcaatatggctacattcaccatgtcaaaaattaatatattcatatatatgttaatgttggactaggacaccccattgtgttctttgctttcccaaacctgtctgaagtttagtacaaattttctattctctgagctggaaaactgctttatactaggggtaggatattgcagttattgcatatttgaattttatgttaatggatacattagctttttatacagtataacttatattttattttgctgtgccgtgttttcttcccacttcaatgagttaaaattgagacatctctaataatttttgtgatgaacgtgataacatattctatgaacaagaatgtggtcaaattttgtattgataaccttaggatggatttctaacaaaagaaaatttgtatttggttacagaatgcatagatatgctgtaaaattgatattttccacagtatgttcagatgcaaaattggatagatataccatgcaactcttatttgctgatatgattctgcaacttttatttgctgatatggtcctgcaaattttattttctgatattgttcttggttatttcttattcagagatttggagcgcatagttcttgtgcattatcggcaaacagctgaggtacttctttttctctcttgttttatgttttacaataaattattcatttcggatgctgaagtgaggatgcattctaaattagtaacactcagtaactcgttaagtattttttgatctgtttcagcttatgtagatctcatgataaaagatataatctttcaagaacaaatagaaagagcctgcatttggttatcacattctttctgctgtttgtaattttgtatagtttttttttcttttgtattttcctgcactgcattaagttgaccagatgctcttcgcctactaactgttaaaaggttggtggctagatttaacatttttatcagtgctattttctttgttgtacacaatgattaatttctaacgtggcccagcggagcatgctgttctctgtatcttttattcaaagatttatttagctttctatggacaaagaaagggtaccagctatgcttatctagttttcaagttgtcacgcaagtcaaatcttcactcctttaaacggagtgatggtgtatatacacccattcccttcatgacaaaaaaaagatcttttcaggatacttctaagtaaaacattttcttttagatcacaagatctaattagacatgttgtaggatgttctgcaaagggttgatgtcgttgatcctctacatatttatagtttctgctatgatcagtctcttaatctggtttatcttgatcaggaaaatgcaatggctcctccgaacccagaacctgaagttgcagatgttcctacagtgaatttgatccattacacctctcctctgacctctgcagattcaacctctggtcatactgagctatctttgccagaggaaattaattcacatggtggcatatcagcttctagtggtgagacatgcttggatcctgaacatttattggatgtaaatgtgcttcattaccagctttatgttcagaaaattttgtccgaaagtttagcttctactagtttttagtttctcattcttttccatattgtcatgtcataatttttgtaggctgttcccttctctacatgtcttactaattttatcttggattgttcattacgcagagactggcaatcatgattccagcctggaggagttttgggctaatcttttagagtcatctataaaaaacgacccaaaagttgttacttctgcctgcggtgggatttttgacaaagctatgacaattgatattactgttgtagagttataatcctgcttattgtataaaacaggtggttcctttgtgtccagtcagcagattaataatgggccgaagaattctggaaacattgtcaataccagtatggcaagtaatgtaagttagctgctacaaacctatcggttttaaactgataagtgatatgctctgtgatttaaattgcaaacaaatttcactacaattctggaactcaattgctattctttaggttttagctttaaattcagcatagcatacctggttgatactctggaatttgggaggagcatttgatttcatgcaattctcttcttccttcatcaatactcagggtctttctgtatgttaatttttatgaaccagcaatgcttcctgtgaacttataagtcttctatatagtcgtaacatatccaacacattgcatatgtgattattctgccaatctggttataatgcaaggtggccagaaaagctgttctctttagtctttacacttccgtcatctcctgtttttttgatctacaactacaacacgttttatcttaaagccatggggatccaatgataaatatgagtatgcgctattcagtatacatgggttctatttctgcacacatttatgtgtatatgtatatatgcatatttttttgtatctatgcaggctatcccagcacttaatgtggtgtcagaaacttatgctacaaatcatggcctcaatcaagtaaatgcaaatcattttggagctctgaagcatcaaggagatcagactcaatctcttttggcgtctgatgtagattctcaatcagatcaatttataagttcttcggtgaaatctccaatggatggtaacacatctattcctaatgaggtgcctgctaggcagaacagtcttggactgtggaagtacttggatgatgacagtcctggtttaggagataatccaagttcagttccacagagcttctgtccagtgaccaatgaaagactattagaaatcaatgagatctccccagaatgggcttactctacagagactaccaaggttgtccttttgatatctagcaaacttccatgctgtctagttttagtttcattcttgaaatgttcaattttgatgggaaagctgcattccattattatctgttcccagttaccaaaattattattcttgttaacttcaaaaaaaaatattgtttttattgtctacaaggtacctcttggttgggttgtttctgtcataactccatatgctactttgactaataatatttacaaaaagaatattttgaataaatggagtagcatattacttcctccgtttcataatgtaagtcattctagcattgcccacattcatatagatgttaatgaatctaggcacacatatatgtctagattcattaacatcaatatgaatgtggaaaatgctagaatgatttacattgtgaaacggagggagtacgatcgtttgtttagtgataaatctagtaacatcattattaaatgattgatcttttttattttttcattattgatagtcaaagttaaacatgtttactattctaaaaatgcttatattttgggatggagggagtactatatagaattgcatgcataatccacctgagctgttatgttttatatttatgttatatcaaactgcaaattactaaagtattgacgactgctgaattgtaggtcgtggtgattgggaatttctatgagcaatacaagcatttggctgggtctgctatgtttggtgtctttggtgagcaatgtgttgccggagatattgttcaaactggtgtttaccgtttcatggttggaccacatacacctggaaaagtggatttttatttgactttggatgggaaaacgccaatcagtgagatttgcagtttcacgtatcatgttatgcatggtagttccttggaggctaggctgccgccatctgaggatgattacaaaaggacaaatcttaagatgcagatgagactagctcgcttgttgtttgccacaaacaagaaaaagatagcaccaaagttgcttgtagaaggcaccaaagttgccaatctcatgtcagcattaccagagaaggaatggatggatttgtggaatattcttagtgacccagaaggcacatatgttcctgttactgaaagcttgcttgaactagtgttgcgaaataggttgcaagagtggcttgttgaaatggtaatggaaggtcataagtctactggtcgcgatgatctaggacaaggagctatccatctgtgttctttcctaggttatacttgggctattcgattgttttctttgtcggggttctccttggatttccgtgattcttctggttggactgctttacactgggctgcataccacgggaggtaccctctatgtcctgatatttctatccttcttttgctgtgtaacatagacgaaataatattaaaaattaaacaacccatttactgcatgagttctggcagctgtgatgtgttcagcttatttgtaagtcaagcttgattggaaactgactaatgagaaaccaaataagcagctgttagacaacatgaaccgaattttgttatgaacaacctgctacatctggaacgtttgtaatgcataagcagtattttctattatagtgtgatcttagattcatttggttcatttttgctggagacaactagtaataggcaatcttgggtacattttgtgtcggaatagatcgggtcatagatttttgatgactttcttgtgctcaactttttaacattcattttccagggaaaggatggttgccactcttttatctgctggagcaaatccaagtttagttacagaccctactcccgaatcccctgctggactcactgctgctgatcttgcagcaagacaaggttacgatggcttggcagcatatcttgctgagaaaggattgactgcacattttgaggccatgtcactgtccaaggatactgagcaatcaccatcaaagactaggctaacaaaactacaaagcgagaagtttgagcaccttagtgaacaagaactttgcttaaaagaatctctagcagcctatcgcaatgctgctgatgctgccagtaatatccaagctgcactcagggagagaactcttaagcttcaaacaaaagcaattcaattggctaatcctgagattgaagcatctgagatagttgctgctatgaagattcaacatgcatttcggaactacaacagaaagaaagcaatgagagctgctgcacgaatacagagtcatttccgtacatggaagatgaggaggaacttcattaacatgcgaagacaagttatcaggatacaagtaagcttctgcatcttcttgttgcatgttttgatttgttacttctgtcctcactgtgctgaagagcacttgtggtagctcaatgtgttggaacttggaaggcaaattaatgtcatttgatatttcaaattttcaatgttcttatttttggtgagaaaaaaaaaggaagttgctgtgccttcttatattgttcatgtcatgtgtattggatattgtgtattgactacaatattttgctcaggctgcgtaccgaggtcatcaagtgagaaggcagtaccgcaaggtaatatggtctgttggaattgttgagaaagcaattttgcgatggagaaagaagagaaaaggccttcgtgggatcgcatctggaatgccagtagttatgactgtggatgccgaagcagaaccagcaagtactgcagaagaagacttcttccaggccggccggcaacaagccgaggacaggttcaatagatctgtggttcgcgttcaagccctgttccgttcttacaaggcacaacaggagtaccggaggatgaagattgctcatgaggaggccaaggtaattttttttaaaactttctccaataattgctggcatgtgccgactaccatatattatttgatttttacacattccaattatcctttagaacttgtattgtagccatttgtcaaccaaataccatctccaaaaaaaggggaaaaaacccataccgcagcatgcctaacgcctatgtctttcacacaatttcttaaagaaaacatggaatatgctattgcagtggcatatattttttgttgacacaatctcttgagttatgcttgtcactgtgctgtgcagattgagttcagtgaagggcagctaggagcagcatgcaggagttgaaatggtttttagggacagctagtttctctaattcttgtcttgtacattattggaaatgctagaacaacctgcagtttgccgacgctgtacattttaggaccatctgaatgatctgatacagcttttgctgaccccttatggctgatgaatttgatgttagccctgtagtaactgtggtggtttgcgtttggctggctttaagctggacataaacagcgtgtgcttcaatgtacatgtagatgcaatgcaagtacatatcatgttgtaaatgctaataagattagcaataatcagcaaagccctgagccaatgacaaggagtgtggtttttctctgtttttacaagcctgtttttacgtactcctatcgtcctaaaatataacaattttaagatagataagacatatcatgttatattttgggacggagttatattttgggacggagtgacattagaaactttggtaaaaaattaagtggacttccttttattgtcttttatcatatgatagcatgatcatttattcatacgactgtagcatgatatcgcgtctaggaccacaacaacaaccactgtaccacaatcaacgtgcgtaatggctttgattaacgaggccaaccgactatggtcaattagcgtgttggatacgcgtggcgagctcctgaaggaagccgacgagcctcttgaactccgtcgccgacgagccgccgtcggcgacgtcccgtctcaccttctccgccagcgcttgggccgtcgccctgatctcgccggactccatcgcctccctcaccatcctcgccacgacggcggcgtcgcacgcgtccttcatgtccagccccgtcccccacacgccgcccacgaacctgctgttgatctgctggtcgacgaagaacggccagcacaccgtcggcacgccctcgacggcggcctccagcgtcgagttccacccggcgtgcgtcaggaagcaccccacggcgcggtgccgcagcacgtcccgctgcggcgcccaccgcacgacgcgcgccttgctgtgccccgccgccgccgcgacggcttcttgcagatcggcgtgctgcagcctcgccgtgaccatgtccggccggagcacccagaggaacgggtggccggcggcgacgagcccggacaggaactccgtgaactgctccggcgagatgacggtgaggctccccaggctgacgtacacgacggaccggtccgcctggccgtcgagccacgccatgcagccgtcgtcctcgcgccacaggctggtggccgccgccggcgcgggggacatggcgtggagtggaccgacggcgaagacgtcgcgcacgcgcggcgc

SEQ ID NO: 674 - DNA, 3778 bp, Oryza sativa
ggggtggagttggagctggagctgtgccaaacaggccctaagtgttctaagtaaacaaagcatcttaatataaatatgtttgttttacggtcttatatgctattttcacgttccattaattatgtcataaactgttgttgatttgtgccagttttctcctatttcagttagtagtatcgtattttgcactacgtcggtattttacttacctttggaaattgtaatcgcggaacttgtaaccacaatataccgaatttgccattgttcattggttttctctcgtatctctaagacaatcataattagcatgtgtagctcacgctaaaattaaaagtttagttaaaattgaaacgatgtgatggaaaagttgaaagtttgtgtgtaggtaagttttgatgtgatgaaaaagttgaaagtttaaagaaaaaaattaggaactaaataagacttagcgtaaaaaatcgtcaaattcactcgaacgtactactatagtactatttccgtcaaggtttcaaaaagacattagtcgatcgtaccagtctgactcgaatcgtcggtcgttccagcagcagatgcaattgtttagtacaagttgcatcctagtacagtagaagattcgccaggttcagcgaaaacctcgcacggtttacgtgccagagttggcttcgtgatcctctcgtccagaaaggcaatggaatatactctactgctcgtacgcgcccgtgagatgagcccacgcgcacgcccaacccatcggcaattcggccttgtgctgcccagtttttgcgcgcgcgccgctgaatcctcaaaaatggacgacaaggcgacggcattccgtttcgcgtggtcgcagttgcgcctcccccacccctcacccgatgaccaccctacgctagcaatcttcctcttgtcgtcgtcctcctcgtgctccgtggcatggcggcgcaggtgctcgcagctcgcgtataaatagcggccatgtccatacacggcagactcacacaaccaacattcagagttcgagtgaaagttctctcacaagttcagagtagcatttggctagtgacagtaactggtcagtgtctctcaccatgtcgtccaattttgaggccaacaacaacaatggcgagaagcagctggtctgtgtgaccggagcaggtggcttcattgggtcgtgggtggtgaaggagctcctcatccgtggctaccacgtcaggggaacagccagagatcctggtaagttactaactagtagttcacggtgttaccattaatttgctgcattttgtgcttgatttattgatcggttcttgcacgcgcgtatctgtagctgacagcaagaatgctcacctgcttgagctggagggagccgaccagaggctctccctctgccgtgccgacgtcctcgacgccgccagcctccgcgccgccttcagcgggtgccacggcgtcttccatgtcgcctccccggtgtccaacgaccctgtaagttcactagcctggttcttgagcccaaaagagacgacaatggcgcctttaacctcctccaacttttactaacgctgctccgtgctgcaggacctggttccggttgcagtggaggggacgaggaacgtgatcaacgcggcggcggacatgggcgtgcggcgcgtggtgttcacgtcgtcctacggcgccgtgcacatgaaccccagcaggagccccgacgccgtcctcgacgagacctgctggagcgactacgaattctgccgccaaaccgacgtaagcacattactctgctgcgtttctaccaactccaaccgcgttgcttgcatgaacagtaaattgatcatctcggcaaaattttctcgtcgtacgtgcagaacctgtactgctgcgccaagatgatggcagagatgacggcgacggaggaggcggcgaagagggggctggagctggcggtggtggtgccgtcgatgacgatgggtcccatgctgcagcagacgctcaacttcagcagcaaccacgtcgcccgctacctcatgggcaccaagaagtcgtaccccaacgccgtcgccgcctacgtcgacgtccgcgacgtcgcccgcgcgcacgtcctcgtctacgagcgccccgacgcacgcggccgctacctctgcatcggcaccgtgctccaccgcgccgagctcctccggatgctcagggacctcttcccccagtaccctgccactgcaaagtacgcaactattagacattgatttgcttgtgtgcgttgctgaaatagtcttctgagatgtaatcgatcgatctcaaatttttcatgcgtgtgtttcttggatttttcaggtgtgaagatgacgggaagccgatggcgaagccgtacaagttctcgaaccagaggctcaaggatttggggttggaattcactccactgaggaagagtttgcatgaggcggtcttatgcatgcagcagaagagtcacctgcctctgatttatcccgttccaaaacgtgcttacctataatcgagatacaaatactcggatttgtctgttgtgatgggaaacagagagcaacagggagaaaaaaaaaacaagaaaatacaagggctctgagaattcagtatgaaattgtttatttgagtaagtgtagtaggcatttgtattttgttgttacacatgtaaaacccttctgtaatgaacaataaggtcccatggagggaattgtaaatgcaaatatggattccatttatattctgggtttcaggatgtaaatttgaatggcactgtatttattcctattttgcgaggcaatttcctagtatacagtgcagtaccgaacctaaatgtctctccctgcagatcgcatggagttgaagtgttaaatgtgtgtgcagatcacgtcgagtttacagtgtttcggcagaaattggagagttatctgaactccagagcactaaagtctgacgacacttttcatagtttggacaggtatctgaactctgacgatgtcatcgatggtatctgaaccgtagagcgagcgctgacattctgatcaatcatgagagttggatagtatccgaattctgacactcttgcagagtttttgttcacagatcaacaggtccgtgaccaatttcataatagcgaatttacgacgagagctatccgaactcttgcagagtttgtgttcatggaccaccaatttcatagcaaattagcgacaccgaacattcatggatcaccaatttcatactccctccgtcccaaaattagtgcagttttgcactattcatgttcaacatttgaccgttcgtcttatttgaaaattttttatgattagtatttttattactattagatgataaaacataaataatgctttatgtgtgattatatatttttaatttttttcataaatttttcaaataagacgaacggtcaaacgttgagtacggatatccacggctgcacttattttgagacggaggtagtagcaaattagcgacaccgaacatcagtgacaactcttcctgcaggaagatgtgaatgtaaaaggcgcagaggatcataattcagagcctagccaagaagaaatcaaactttaaacacatcaacatcaaattggatatcatctatatacaagaacactaagggtgagtttgagatatagaggattgagaagatatgtaaaacgagatgagccattagcgcatgattaattgagtataaactattttaaattttaaaaatggattaatatgattttttaaagcaactttcctatagaaaatttttaaa

SEQ ID NO: 675 - DNA, 3289 bp, Oryza sativa
ttatgtaatggaaggagtaatcatgttttatcatctcacaacaataaaaatactaattataaaaaaattcatataaaacggacagttaaacgtttgacacggaaacccaggtttatccttttgggacgaagcgagtatagctgagacttgccggtccattctggaggcatttggacactatgctttcatagtcaaacaattacgtctgcttgacagatcagaagattctaacgtatatactacatccgtttctaaatatttaacgctattaacttttttaaatatatttaactattcgtcttattaaaaaaattaagtaattattaattttttttcctatcatttgactaattgttaaatatactttcatatatatatatatatatatatatatatatatatatatatatatatagttttagatatttcacaaatttttttaataagacgaacggtaaaatatgtgctaaaaagtcaacggtgtcaaacatttaaaaacggagggagtatttatcagaaattctaccatccaccgaggtatttttacttagatccacttatagcatgacactgatattttacttatattaaaaaacggatggagtacttatatttttactaattttttacttacattgatgtatcagtgtcatgctataggtggatctaattttttttataacttttatctacctaaatcaaacagttgagataattgttagtaaaaatttaataagaaagaattaatacgtgtagcagtgctctaaataatattatatctttctttgtagaagcatggataccaatagaagtatctaatagcttaaggtgtaaatacacctgtaccttatttaatactagccattcatccatttcgcttttccaatcccacctcactttcatctagttaaatcaaacggttgagaaatttgttagtaagacttttgtaagaaaattttagtatgtatagcagtgctcttcgccaaacacaacctaaaaattctttccttctttcaccaagcttccatgcatccgggcgagccgcccaacttgatcggagtcaagtggccgagtcgccgctataaatttcggcagccaccaaaacatagccgccatgcgccgcgtccacagctcgatcgctagccctactcgctagctagatcggcggccatggtgaacggctacttgttccgggagtacatcggcgcgcagttcaccggcgtgcgcttctccgacgtgcccgtcaacccgggcctcagcttccacttcatcctcgccttcgccatcgactacttcatggcgacgcagtcctccaagccggcgccagccaacggcgtgttcgccccgtactgggacacggccaacctgtccccggccgccgtcgccgcggccaaggcggcgcaccccaacctcagcgtcatcctcgccctcggcggcgacaccgtccagaacaccggcgtcaacgccacgttcgcgccgacgtcgtccgtcgacgcgtgggtgcgcaacgccgccgactccgtctccggcctcatcgacgcctacggcctcgacggcgtcgacgtcgactacgagcacttcgccgccggcgtggacacgttcgtggagtgcatcggtcgcctcctcaccgagctcaaggcgcggcacccgaacatcgccacctccatcgcgccgttcgagcaccccgtggtgcagcgctactaccagccgctgtggcggcgctacgccggcgtgatcgactacgtcaacttccagttctacggctacggcgccaacaccgacgtggcgacgtacgtgatgttctacgacgagcaggcggcgaactaccccggcagcaagctgctcgccagcttcaagaccgggaacgtcaccgggctgctctcgccggagcaggggatcgccggcgcgaaggagttgcagcggcaggggaagctgccggggttgttcatctggtcagcggatagctccatggtcagcagctacaagtttgagtacgagaccaaggctcaggagatcgtcgccaaccactgatcgtccatcgaacggtcgtgataatacttatgaaataagagcaaataaattgcgaaataatggtcgtattatatatcgagcgtcattatgcacgacttacgtgctaaataagaaatggacttatgtgccgattggtaatcggcgatatatggatgtcagattttcaaaccggcacctagtaaacggtgtcggtttagaaacaggtacctttataagattcctaggatgaaaaaaaaggaggctcgttgcatcggttcactgagcgcatccaccctgcgtcatccctaagccttgcccttcgaaatcaatccaacgaacttccaacaatcagcatcatcgccattacagatcacaagtcataaaatcgatacaacaacaacaacaacatctaaaaacaaaaatgaaaggagaacaacaacattatcatcattgaaaggatccgccgcgggagaagccgccgttgaaggatctgccgcgagaaaagttgccgccaccggatccaccatgaaagaagccagtggggaggggcggcgctgttcttgccgctcccaagcaccggtgtgaagggggcccctcgcgccgaataaataagagcccgtggatagagcaagcgacaaaataagaagattgcaagtggaaccgtcgaataaaatggaaaaagaattggaacgttcgcaacttaatcaatggtagtcaaagagatataggtcaggcttcagctatcactccctgcagaagaactatatatatttccttcttatcatctgctgaaatcgaattttgcaatgccgaaatccaatttaatgttacgtcacttcgttttacatttctcttgacaccgaagttcattttcaaggatacattgtactgtattccgtgaaaaaggaaattcaggcaattgatttattcggcgatttcacatgcacacaattcactccctcacactcacaaccggaattgaagcttttttttttttatcatgacaatacgatagagctccaggatagaatcaagacaagatcttcgttggtctgtgactccgactccgtataaacaggagcggatatagaacgaaatgaagaagggtgccacttgtttaatttactttactttaggtcgagtttaagctgatgccagtgtctaagtttgtattaggggatacacacatggtggaaacaggtggtgtgtagctaaaatgttttcttgatcaggttcctgggcacccctctactatagctctgcccctgcgtatgaatcc

SEQ ID NO: 676 - DNA, 5243 bp, Oryza sativa
accagcttccaaattttgaaatttgaagctttgattataggatttatttttcatctaagtttactttccggtcttcgatttcaaattgataatgatacaaatataaaaacttttacttttatttgaaagccaaatgaaaaataccctgaaacgaagaaaaagtcatttaagacaaacttagagataccccgatgtgtatgatcaaaatggggtctgatacactgctgatcagttcccacattgattttggtgtgatattccgttccataatcgtctttaaaaaacaaaagagggaaaaaaacaaaacactatgcaaccgtgcaaatgaaagcatcgtcaaatgattaaaaacgtcaaaccaattcaatcaaccccaaactccaaaccaactttttttttctcttttcttttttttctttttgtcgatcttgagcgaagcaatcctccaaagtccaaaccaccaatcgaagcaagaacacaaaaacaaaaaacagcaccagcgaattcggtgccgcccatcggttatggctctcgccccacacatcttgcgttccttctcgcagcaaacatttcccaaatctcaaaaaaaaaaagaaagaaaagaaaaaccaaaagaggaggatgataccgtgatgacaccatgcaaggcagttcgtcacatgatctggttcgctccaaaaagctgatagtaaaaatcatcccaaaatatctcctcggagaaaaattcttaccacaccgtccctctcctgttcatccctgttcgtggccgaatcttttgtttttaccgaggaatcttttgattagtggttgtagtgacatcatggacagaagaggaggttggtaattaggcggggtaaaaaaggaccgaggcgacgcgagagctcgtctcctccactcctcgtcctcgtcctcctcctcctcttcctccatttttttttcttttctttttatttgattacgccgtcgctgtcgagtagcgcgtcagctgcatccgcggttataagtagcggccaccacccaccacccccggcttcctctcccactgcgccctccgcgtgagcggcagcaagtgttcactgcgttcttcttctcgatttatctttcttggtttcttgatctgtagcttattagcggccatgtgcggcggagcaatcatctccgggttcatcccgccgtcggccgctgcggcggcggcggctgcggtggccaagaagcagcagggcaggagggtcacggccgacgtgctgtggccggggatgctgcggaaggggaaggcggcggcggcggaggaggactttgaggccgacttccgcgagttcgagcgtggcatgagcgacgacgaggcggaggggggcggcggcgaggaggaggaggacgacgacgacgtggtcgtggtggtccccccgccggcggcggcgaggttcgtcgtccgtgccgcggccaaggcggcgcccccaactgcaggtgaaaaaataacgcataaagctagctctttttcccccttttctcgttagacgagcgcaagatgcggccttttttctgggtccgtttcttgcgttcttcgtgtgatttggggagagaattggggtctcatggggtagctgccaaatggggcttcatcaggttgcgccatggatttgatcttgatgcgaaccatgggacggcactgtgtagtatagtttttttttcttcaatctagcgtgttattagttcttaacttcattaatacctgtgtacgtaaacttgctagcgaatctggttcttttagatggatagcatctgtaggtttggtggtttacgaatttacactacgaaataggaattcaactttgtcctagattctactcttctttctttttcctgaattggagtagcaaagagagagtgatgagttttagatatttattcttgtgatttcgcagtgtcattatgtgttttaatcactaatatttgtgttggattagagaaaatttggctttgtagagttgtagtatgttcttggattaacctatgtttatggatgctcttctgtcgctggatttacttgctttgtttctaataagtgatctagtagtgtaattacgcaaaacttaatggccttttttttttccttggcaaagtttcatctgtgccaccatctcatcttgagatttggagtactctttgaggcatatttttttcttgtactcttgatttatcatatttagctgttagttttcagagtatgatgggttctgtagtattatctaaaaataaaaaaaatgatgggttctttagttgttccactctttatatagattgttagatgcatgtcaaagctcccttcttttttttcttgttaattctaaacagaagaaactttaggtgatgctgtcaaagctcccttcttttttttttcttgttaattctaaacagaagaaactttaggttgttaatttgaactttgttggtgatctcgtactctcattcaagggatacgaatttaaagaattattttatttttttaaaaaaactaacgaatataaggaactctaatttagtagtttgtacagttgattttgagctacatcaaaatataccctcagagggacctcgttagttttatgcatctgagatctcattcctggatagaacgttgcaggtgagtagatgactactgtagacagtatatgtagattattatctattgttaatcatagggcaagtgagtagttctacactttgacagtgcttacaccatatgcttgctatattcatggactttaagatttcttatatatgtcatgatttatttgagaagtgatcaattgaactgattcatgtctcaacctctctgtgaacatccagtataacttcatcttcatgttgcttgagagtgtattgtgtaacttacagtttatagctatgatatttcctttatatccttcttccaaatctgtttgttgagatgtatactaacaaataagctttcgtgtagatgggatgttgactacaaagcttgtccaacatgatggacctactgctagatcagcaaagcacaagaggaagaatcagtacagggggatccgccagcgtccctggggcaaatgggcagctgaaatccgagaccccagcaagggtgtccgtgtttggcttggaacatataacactgctgaggaggcagctagggcatatgacgctgaagcccgcaagatccgtggcaagaaagccaaggtcaactttcctgatgaaccagctgttgctcagaagctctccctgaagcaaaacgctgccaagcaagagaaactagctccacctctgaagacctgtggcgatgatgctttctttcagctaaacagttcagacaatgatttgtttgcaatgcttgcaaaggtgcctgcaaagccggcagagcctgttgatctcatgcctccagtcaaacctcttgcttccactgagacattcgagatgaacatgctctctgatacgagcagcaactcatttggctcttcagactttggttgggaggatgacaccctgaccccagactacacttcagtcttcgttcctaatgctgccatgccagcatatggtgaacctgcttacctgacaggtggagcgccaaagagaatgaggaacaactatggtatcgccgtgccccagggaaatggcatgcctaatctcgcacaaaacatgcccaccttcgatcccgagatgaagtatttgccattaccttatgttgagagcagctcagatgaatcaatggacaaccttctgcaaaatgatgctacacaagacggggcaagcaacgagggcatctggagccttgatgagctgctcatggcagctggtgcctactgaggagacgaaatgttctggtcagtgtggtctgtcactagcaaaccatgtaaggcactccacactacctactattttgatttcttgtagatacattttcatgtacagattacatatgttgtaaaatgggatatggttttcttgtcaggttgaatgtgtatggccaagatgaagagctggtgatgtctgctatgttttgtagagggatgctaccaaagtaatgctagaatattacaagctgctatcagctgtactctctatgacaatgtttatactatgtttgctgtatggtgtggtctatgatttgaagtatgttggagactgattcaaataactgccttggccatgtgtgtgctgtaatgtgcttattaagttatatagttgtgctcatattgcgtatctacaatctgcaactttgaaagtgctcgctttcgctttcctgtgcagttctgcttttctggaatgtcaacagctagtgtgtgacatcagaaatctagagaaatcaagacagaatcaagcttacatgttaacgatgtatgagcttatttgtcttgcccagcttacttgttgggaatgatttgtgtctcattccagcaatgtatattctgagcagtcggtggttaaggcataagctgatttttggcttttctttcgtgctatatttatactttgatgctgaagatttaatactggggcagttgattggctacaggactgtgacctgaaaaaaaaagcttaaataagatcatttgcacactggatttggttcctggttttgctttatcatattggcattcggatctgcaaccacaaagtctttcatttactcgtagctgttagcttatctttttcgtctttgcgatgcttagtgatgtacttttcagcaagtagccaatgtttatggcttaaggcagaaatttcaggctccagggcgagtctgcttcatggcggattatatctcgagattttgcttctgacaacaaatcgaaaactagggagcaaattggccaagttgggaatttctcctctggctcttgccattgggtgtggtcctctccgaattattgccatgagagatagtcagtgacagagacggcctgggttcagttgcatcgtggtttaaggattctaaccttttcactgatcaccattttccgccaagtggttctctcagaaagtctctagctccggccttaaattattttaccagggcagtgatcggcacggcagagtttacacggatctttgaacaaaaattcagaatctgaatcagctaagaaaaaaaaaatcattcgtaagcacttggacttctagtgcatgacgaatgttcatgtctcgtatttaggagccgtttgcaacaacggaaaatcataatagaacaatacggtgacaattgagagtacagg

SEQ ID NO: 677 - DNA, 5536 bp, Oryza sativa
atatatatgttaatgaatctaaacatatatgtgtagattcattaacatccatataaatgtgggcaatgctagaaagtcttataatataaaacggaggaagtacatatgatctataaagaagcaacattcatcaagccttccggttcatttccatcaacgtgtagtgtaagagacacagcactccatctctcaattccttcttgaagttgtgcttagagtaggtgcttcacagaatcaatgcaaatactcacggtgccaaactcatacactggcataccattgtagaatttaccaactctaggcataaacagtaagccttgtgccattgcatatgcctggatagactccttaaagctcaaatcctcgccatggctgcgctcattggcaagaaattctggtggaaaaaggcccttcaagcccttgtaccagttcatgatcgatctcattgaagtcaggacttggtgaacacagcctgtacagggcctgctgccacttgctgaagaaatctacttccaacatatggaccatatggtgtacagggatcacagaagcccagatcattacccagttgaactggtcgaaatttttacgtgaactcaaaatttaaacagaaaacctagacaacggtatcccgttggaacgggatatccttctatgagacaatacctgatacccgaaatctgttatggtaccagctgcatggtacccgatacctgtgatatctgttacccgatacctatgatacttaggacctgatagctgtgatactcgtgcaagagaatagttaatatgtctatcccattttgtagcagccctcaaatttaaaatccagaattagcttcagcaaacattgtttggggcgctggcatgggcctccattgggcccaaaccgtgtgcgagaattcggcccaacctctatccaacccccccccccccccccttcgtcatgccggcccattaggacacgctcagtaataataataatacttttattaccaccattttttctcctcctcgtcgtcctcctcctcctcgtcctcgtcgtcgtcatctccaacgcgagctcgacgaagccaaggagaggaggagagagagagagggagagagggaggagtgagaccgacgcgaaggcctccgcccccccgaatccggccaccgccattccgctagatcgttggcgcctcagcttcccttcctcccgcggtttcttttgttggagggatttctcgaggtaagcaaacagcaacccatcgtggaatgatgatgatgatgatgaattgagattgtttgggcgagcccggttggattgggtctgggcgattcgttgggagatctcggatgctcgttgattttagatttttggggggggggggggggggaatcgatcgatgcgggatttggacggtcagcttgcccaaaaattggggggcctttcttggcgattccaagattttaacctagcatttcgtggaattggtcgtttggttggggttgtaggattagggatttcggatttgattgtgctgtgatccgctatatgctgtgctgattgctctggcgggattttttttttggcaggcatgcagagccagatcgtgtgccatgggtgcaggaacattctgctctacccgagaggggcaccgagcgtttgctgcgcggtgtgccatgccgtgtccagcacagcaccgtctccaggtaatggcacatctaaagcttttgttagtttcgtttgtgcaatcgaccatcaaggttgcaaacactggccagaatttgccgggtcggccgaaggattaggccaacatgattttattaggattggaggatttacaggtacagattgcgattccatctcgacggtatgctgtcgaaaaaatcgacgtttcatccaagggatcagaatttcgagggttgatattagatatctgtattgcaatgttgatgcttgggtgacggtactctttgatgtatgcgatgatcaatccaaaaaaactgtttcttttgaacgctgctagaactccaatgttgcaagtccagttagacaaaggtcaagataagatagtgaaagagaggtaacatggaaatataaagggcattccacggctaacttatccttatagaaaacccagtgtactcattgtattagcttaaatatcatatactagcacatgctgctcagtttctaagcttacatccctagttctactgcctgattcccgcagactgcagcatttggttcttattcctttaaatggtgttgctgtttttttctactagattgtaattatctaccaaattatgttctgttccatagagtgtctcctgcataagatcttctttcgcaggctgttgtgtgatgtatttttttcatcaaacactgagccccttgtgggccaaaaagaaacggcttgatttttgagaaataataaagaattggtttgtcgtgaagcctagcagcgcatcctaatgtccaagtccaacagtcacctaggaggagctacaaatgccatatgtagaggattcctgaagcactgaatggggtagctcacgtaattagaatctaaacctcgggttatcgttttaccatcgctctcattgcttcatatcactgtgaactttgtagttgcttcaagttgtcatgctcatgaaagttgggtaaatttcatgtgcaggaatggatatagctcatcttatatgtggtggatgccgaactttattgatgtatactcgcaatgcgacatctgttagatgttcgtgctgcgatacagtcaatcttgtcagaccaggtacttgcatgtttgtggaattggcagaatttttattctgcttatccttaaaagcatctgcatttacctactgggcatgctaatgtattgcagtgtactaggtatgttatataaagccagtataggttgctcaggcacataaatctataattaattgtgttaagtgtaaaccaaccaaaattggtgatgttatgtatgtgaaaatcaatatagccctcttatttacagttaggttagtataaatttggtgtattgcaactttacataagctggtttcactgaaagctagactacatcagttcttacattgtttctgggctgttgacttctcatctggcaaatatgtatcattgactacttgatcagtgagttgaggtcagtttatttcaaaggcaatactcaaaattgtgtggagagcacctgtgttgctgaagtctttcttttctgattcttaaataatgctcagtttttcttttctgtggatgagtttgttatctcttatcgagacaaggactcaacatgtgttgctggtcccgattacgtgtgtgccatttctagtttcatttatatgattgaaatggagcaaatattttctgaagtataaaatcatggagtttaaagacaataagctgataataaaccttcactaggttcttgtcttccctgtatctctgtttcatgcatccaagtttcctcccatatactgtacatcattaatcatcatgatgtctgacatgtctctcaacttaatggattctgtttgattgtgaattatgatgcagtgagtagtatagctcacttgaactgtggccagtgccagacagtgttgatgtatccatacggagcaccttctgtcaagtgtgctatctgcaattttattacaaatactggggtaaggctgtttctttttactggttatctttgctggaaatgctataagtgctcatctacgcttattgacttcaaactatttcttatactcagatgaatacaatgagacatttgccaccaaatggaacttcatatactgccccatcaacctctgctgtatgtccagttgttcataccttgagttctcttgggcattcatattggtgatttccatctattaatcacttcttttttcccttgtcgttggcagccaaccactcaatcacagaatgttactgttgttgttgaaaatcctatgacggtagatgcaaagggaaagttggtaagccacctccttattgctatctcctgtcaaccttgcctgcgtgcatatttctaatccccagttaagtcattacattcttactgatttactccatgttttctacgcaggtgagcaacgttgtagttggggttacaactggtggtaaaaagtaacatattggcacacagtgcaccttgttttatgttccatatatggagttggaaatactttgtattatacacaaatgtttgtgatcaattgctggaaggaaccctgaagagcataggggcactcgcaatgtgcacaattacaatcaagctaaaaaaacaaactgcaggtgtgaatactgagatactgtagtttgttacccctgattcttttgtatgtaatatgagagctctgttggattttattgtgtgatcaaatcatctccagatggcactagctgccttctcaatgaataataacagattgcgttcaacatagcgcatgttttgtatacaacctgaatgagctgattttgtaaaatgcatggttttactactatttctggaactagactgagcatgccatctcatcgttcatgtgttaaaatttatttgcatattgtttctgtaagcatatggactgttgaattgtgctcatagtggctgtactccagttatttgcacgctgtacatggtacagctaggtgcagttaataagaacgctatgtcaagtgtaatgatttgaaggggagaactgaccaggtacaacaatttattttggaaggcacaaggtacaacaatttatggcatttatggtatttctagcttttttagcagatattaaggtcgaggaaaaaaaatactttggtgtcccttattaaatgagagatttatgggcaaattacacgcatgaattgcttaaatttgtggacagaaagtagtataactagacgataccccgcgtgttgctgcaggattgcaaatgattcattgacaaaaaaaatttaaagataattcatatttgtaacttgagaactatatcagttagatatcatatatagcatacatctggatattgcattcgtgtgatgcataatacagaaaatatggacaaaataaaatgcgacgcataaaccatccaatttaactggagaacaaaacttaaatcatagcgaaaaagagtgaaattgtacagttacagagaattagaaaataaaaatattaggtgtgtgagcatcacttgattgaatactcctataagaggacatctattttgagacatgggagcaacaaataaacataggcaagagaaaaaaaatcaatagactaacagaaccacatgcttgttttgttgctatgcaaaacgaatgcaaaggtgcaacagttctgctcgtcacgtactactaaaatctaaactatgacgtactttttagtggtgcacagtatagcatgtaaggcatactgaattaaaaaaataattaaatacaatcttttttttgactggaattaaatacaatctttaggcttacaacacaattagtttgcttgattcttaaataaggaatatttgc

SEQ ID NO: 678 - DNA, 8442 bp, Oryza sativa
aaggtgaagacaaatgttatagccaatcttatacttgtaatatgagtttataagtagttagctctaccattcaacttgagtaaagtgcattggcggtccttcatcttatagggttgtgttatataggcctctaaactctcaaaatacatatctgagtcacgtaacttatcaaagtgtatcatctagattctaaattgacacatcacctctaggatcctacgtggcgttgatgtagcatgccacatggacatgatgtgtccttttcttttttttcttcttttatttttctttttattttccattttcttctcattcttctttttttccttttaaatttgtagccagctgcagcacgaactctaagacgcaatgtgtatatgacaagtgagatcatatattaatagtgtagtatatgtttataggtaactattgtatatattggctattaaagtaactatagataatttggagctagtagttggttatactaatcttgctcttagagcaggtacaatagcaggctattagccagctataaacatattttaatgagataaaagatgagagagaagaatagcggacttagatctgtagccagctgcaacacggactccaagacgcagtgtgtgtatgacaggtgagaccatatattaataatatagtaagcaactattgtatgaattgactattatgttggctatagataaattggagttagtagtgggctatactattaaacttgctcttatgggtgtaaaggtactaggtacagaggtagtgttccctcacgctgtcgtcaccatgacacgtcatcagtcgttagggtcggcacagcatctccattttgctacacgtccccccacacccacccaccccaaaaatgggccacgcctagtacccgtagccccgcgtgccaaccattttataccccggtgggccaccacccccacctccacagcccaagagaaaacacacgcgagcacacacacacccacacacaaaaaaaacacacacaaaaaaaaaagaggcgagagctacaaaacgaggccgaaagcgaccaaatctcgcgacgaattccgcctccactttcccttcccttcctcctccacctccacctcctcgtcgcgatccaaatccgaatccggccatggacgccggggcgcagccgccggacacggagatggcggaggccggcggcgggcagcagccgcctgctgcggctgcggcggcgggggcgggggcaggggcggggatgatggagaacatccaggcgacgctgagccatggcgggaggttcatccagtacaacatcttcgggaacgtgttcgaggtcaccgccaagtacaagccccccatcctccccatcggcaagggcgcctacggcatcgtctggttcgtttgctcccccctctctcccattccgttggcggcggcggcctgattttggtttggattttggattttgggtttggatgacagctcggcgctcaactcggagacgggggagcaggtggcgatcaagaagatcgccaacgcgttcgacaacaagatcgacgccaagcgcacgctcagggagatcaagctgctccgccacatggaccacgagaatgtcagtgctcccgatccgctccattgtttcgaccacggaattcccttcccccccacccaccctcgatttttaggcgcagattttgagattctcgttgaatgctcttgtctctggttagttaagttggttgcattaaatggggaaaggaggaggaggtgagggttaggttaccaaatgattgagttcgtcactgctcggcctaatttggtagagcttttccctccattcttgctgctgatgatgagtgctgcgagcttcagaaatagaggtaactttggagatgcctttaaagaagccatctgccttttggggatgttgttattcattgtgttcttgaatagtgggggagcgagtgatgtgaacagacctgacctggagagtagcaacatcacatgattctcgtacgtgctgatgtcacaagccacaactagcttgaggaggaggaggaggaggaggaggaggaggaggaccaatctggtgttacacctttttcctaagtcagtcaaatccagtctgaatgcagtgggagtgactgccagtggggagggaattaggggataggagtactaggaattgtgttattgttggaaagttttgagattgactttgtgtgtgcatgttggacttggacctttgaaatttaccaatttaaagactgactaataggagtagcccactgttgtatttcctgcgtaggcctgaagtatcattttcagcttaccagaggcaacatattttttctatggttagtggtagaaagacagccacaggggaagtgaattagagaataggccatatcttcatagccagccctagaaaaactcagcttcttctgaagaggtgaattaaatttggatggtcataaatattccgttataattaaactagtggattttcccatgcaaatatgagaggagctagatttaaaattagagttatattttgtatagaatttactggtcaacctggaccgttgtaatctagacccaccactataataaacgggcatatatttatcttttttccccgattaatgtcgttattctaggcttctagattgaacgtggtggcacccttttgcaccctctttattataacataatagatcaattgatacttccctaaaaaaggttcatacaaaaagttgctcagatactgcttttgctgaaccatagactggttgacacaggcatacacaaatgcatgctcatgcctttttttggaagttttttcaaactaaaactgatccattttgtttgtatcctactgcagaaagagaagtgtttaatttcaggttttagtgctccaattatgcaggggaggcttttgggagttataccagttacgggtgtttgtagaaaacgatcggattaggcaaattttggagtagaagtccttagataatgcacctgctttattgccatcagctaagattgtgtatcaagtcaaattctacttttcaaatctggctataaattcaattgtatgtacggaaagttggaaacatgagctaagatttgtacatcaagtccaattctacttttaaaatatagcttgcacaaaaaatggctattttgcattattacataaaacattacttccaaattggcgatcctgtattctgaaagatgtattggaactttttttttgtcatgtgcacgtgctgcaggttggctgcagacagaaggcagcagcccgagtagcgatttctggctgcagtatattacttcaataccaagttatcatttaattatgaagtgcactaagctgttgctttctatgtacatgtaagcttatctatgagataaaaaaacaaacaaacaaaaaaagcccgtggttaggatggcttgcggcattcagctaagtcgagaaaaatgcccctgaacgtggcacgtcactgggcatgcttaacctcacgcggggagcactcttctaccagcattaacgaggggggattttttttgtgcaaaacctgggcttgagccttggtcggtgtcccctctaccagagactctaccactgtgctacacacacgtttgttcagcttatctatgagataaattattagaatcctctacataagttattagaattatgcaaagtctcctccattgcttccttctattgatctattatatgtccatcttcgtctaaagccctttactagtcactattcaagtcatcattagcttgctgttcatccccattacacactctaattttcattttaagggaaatgcatgttggtctgcctccttaaaaaaccaccatgtttgagcgtttaaatggcaaaaacacttgagctataacattaagccatcatgaataagatagatctctttgtcaagtcattttcatatggtatttcctggtccatgcaatatgtttgttcttgctttggttggtctggacatagttgatttacttattttatctactcctataagatatttggagctggtctgttgtatttcacatatccagcaagctcttgtgtttgcacatcgatgctccaaaaggcaataacttgtctcaacttcctacttatgtgatgcagattgttgccataagggatatcatacctcctccacaaaggaattcattcaatgacgtttatattgcatatgaattgatggatactgatctgcatcaaattattcgctcaaatcaagcattgtcagaggagcactgccaggtaccttcttcaaaagaaaaacacaactttatttccactttagcatttatttcatacaaatggcttttctggtctgcttggattctcttgcttgtctaggcctctgctcaaattgagttttcaagacctaaaaagtgggaagtattgaagtatgtattgatggtttataaatgttttgtgtaagaactataaggaatttggtacaaaaggttgaatgtaaagcttttatggtaattttgtatcacattttaagaattctgcaggtatgcataatctttgaaattaagaaacgaatttagcgacctactaatatacctgaacgtacctttgccctgcaaagcatatatgcaaagtgctacaattaggttatctcagtgcaccattgatcattggatcaaactaacgttttctttggagataccatattatttgctaaccgatataaaatcgaataatgagttgattgctatttatcagtagaccacatactgttaggagctggcggcaaggcaccgcagctccgaaggttgtagcagtgcttgacgggagggtgatgccgatgccctcgcctcccacaaagccatggtgaggagaaacagagaaaagagtggccttatataggcgattacaatctgctaatgaatcagaactaactgaaacaaacctcaaatcttaagggataactcttatctaatgcaagcaacagataacggcgagaacgacactgtggcgtgccatgcacgctcaccgaactcgtgttcttgagacattcaaaggattccccacataacacattcaacgtgagaagggttcaatgcccaatcacactggagaggtcttgctgtattgcagcttgcaagctcttatgatcaatgctacagatagatctctccctttcttgagtggaactctagaatggctgcctcacctatctttccttatccagataacttgattgtgttctcttgtattttccttgtgcatgcatctaccatgttctgagaaataatacatgtttggtataactgttcttgcgtaattctttacctttttgtgcagtatttcctttatcagattctccgtggcttgaagtatatacattcagcaaatgtccttcaccgagacttgaagcccagcaacctacttttgaatgcaaattgtgacctcaaaatttgtgattttggacttgctcgtaccacctcagaaaccgattttatgactgagtatgttgtcacaagatggtatagggcaccggaacttctgttgaattcctctgaatatactgcagcaattgatgtgtggtctgtgggctgtatttttatggaactcatggatcgtaaacctttgtttcctggaagagatcatgtccatcaattacgtctactaatggaggttagaacacactcttatcttttgaactttattttatattgaattgatcaggttatgttgtgtggtcatatatttagcataactggagtactgttttggaaatatataatatgttgattatcctatgggaatatgttaaaactaaggaaaatgcaaagaggagagaatttatgttgctccagaaggtcctggctttctggctgatatgcaggatactgaattctgagtcatggctattaatacaaacgcatttctcactagaggatttatatactatctgtttcacattattgtgtgtttgattttcctatcataaatttcttaattgcagctcatcggaacgccaaatgaggctgatctggattttgtaaatgaaaatgcaagaagatacattcgccaacttcctagacatgcaaggcagtcctttcctgaaaaatttccacatgttcatcctttagcaattgatctggttgaaaagatgctgacatttgatcctagacagagaataacaggtcagtattggcatagtatgttttagtgatttaaagggcatttgaatgttgtttttgccatcttatctatcttgccaatagcaagtaaaaaataggcctttctcctaaagaaagaaaagagtgaaagaagcctttgaaagccctcataaactatggttttttttaacaccatgtctacctttcttttaatctgccactggccatttctagttagcgtttaccacttcctatctgttttaagatagaaagtaacaactgcagtggatacttaaatatatttgtagagcatctgtgcatgacttctatattactaaatcacatgcaaacctaaatattttttttaaaaaaaaaaactatgtcgatcctttttacctcttgatccaccctaacctaatccaggtggtataggtgtgtcatcactttattcttaatgcgtgaattgagcatcattcttaactcataggtgggaatgttgaaagagtcattgccttgtggtgttttctaatgttgaaaatgcattgttccctgtgtcaaaacttttgacctgattttctctgcatgtttcatattactgaatgcccccttatcttttctcctatttcttcttatccagttgaaggtgcccttgcacatccttacctggcatcactgcatgacataagtgatgagccagtctgctcatcacccttcagctttgacttcgagcagcatgcattgtccgaggaacaaatgaaggatctaatctaccaagaaggccttgcgttcaaccctgattaccagtagctggtgttctatttcagccttggattgattctattcatatggagttttttcctcctgcgccacaaaaggtcgccgacagtgatcactagttgtaaataattgcctcacctgaaaaatcctccctggttcaaagctgaaggtgttgttctaagagtagaaatgtactttgtgatcaagttcctgggtagctgctatgccattcttatgcttatgtatgttgtttaatgtgggatttttttccatcttaaatgtttttagtcccttttgtaagaagagttagttcatgaacgatgacggcctaaattctgcggttatcatcaaattccccattttcttgtcgattcatggatttctcatggttttacttaatgctccatgttgtaagacgtggtcaatggaagaggatatattgactcttgattcagtggtggcagtttggagttgatcgtaagactggaacattacttcgagattcttctaagttgtagactccctcatccattattctagtcttttgccaattatttcattgcttctttttacgttataatgcgatgttctggtgcttgcgtgcacgttctctccagccaaactcaaaaactcatgtacgctacatcccataaaatgtggtgtatgaactggccacattatcatttcatggagttggtatagccgtgtaggttgtgaactcgtaatgccatctccatctgcgtcgtatctcaataatgcaagaatgcaacctaactaaataataaaaataataataatgtttcactaatttattttcaactgtacgtctgtgcgaaagaaaaaaaaaagcttttgtggacaaaaatacagtaactagctagttttctatatccacactaaacacatcgaacatactccatccgtcccaaaaaaaaaaaactcaacatagaaggggatgtgacccctcctagaacaacgaatctggattatccttaggttgagtttttttttttgggacactgcttactactgagacaagtcctacactcctactagagaggcaaaacctttgctttggttatttaggaaaccatagttattatacttctgaccatgcagcacaggggactgaagatcttataagttggcacggaaatatttccgtgactcctgctgttttatgctgtccgccacatgggcgatgacgccggcaccggcattgtgaagccactcattcttaacctgcattgcattgatgccatgaactccagtggaaatgaaaagaacacatttaatttggtcaaaatggtatgcagtacatactactaacatacatgtatgttgttatgagcaaagtaaggccatagtgctgtatggaagttgacatctactttcttccaaccgaccctctgcaagccatggatcatctcctctgttaccagaacacagaattgatgttcatagagtgagaaacaagggag

SEQ ID NO: 679 - DNA, 4755 bp, Oryza sativa; identical to SEQ ID NO: 352

SEQ ID NO: 680 - DNA, 3910 bp, Oryza sativa
aaatacaatttataaataactgaaattcggaattaaaaaattaagagtattagaagaatagtatagagtccatactattaagaaataatagaaaatcagaattaaaaataaggaatattagaaatagagtatagagtccatatagaaatacaattaagaaattatagaaattcaaaattaaaaataaggaatattaatagagtccatatagaaatttaaaactaactattcagaataaacataatagaattaaaagtagagtttagagttcgtataaaaatacaatttacaaataactaaaatttaaaattaaaaaaacatgggaagaagaatataaagtcaatatatgaatataatttagaagtaactgaaattcgaaattaaaaattaaagaatattgaaagatgagtttagagtccacatagaaatacaattagaaataatagaaattcagaattaaaaataaataatattagaagaagtgcctagagtctatatagaaatacaattcacagagaacaaaaattcagaataaaagaaaataaaatattgaaagacgagtctagagtccgtataggaatataatttacaaattactacaatttgatataaaaaataattaataactaacatgtatataaaatacaatataaatattacacattagtagtttcgtaaagttagtacaaaatttaaaattatgttgttattttaatatattagattgagaaaacatacatgctattatataggagaaaatataatgatgctagccgcgtaatctgcgtaggaatcctgctagttttttttacaccaaaaagaaaatttaccgaggtccacaaaacgttgaactatcacttggaacacggcaatacgaaacacaacaaaaactgactcgtctgatttgtaaaaccagagagaaaagaaaaagggggaaaaggaagttataattttcttgccacccccatcacggcttcacttggcctcgtctataaaaaaacactcctctgtctcgaatccttcttcctctccctgcccccgatcggcctcgtcctctccacgccgcgagcccaccagaaaacgcacacgccgacgcgagccaatcaacccgccgcgccgcgcctcgccgccgtcgcgatgcgaccgggcgggccgccgagcttgcgggcggggctgcagcagcagcagcagcagcagccggggacgccggggaggtcgcggcgccggccggatctcacgctgccgctgccgcagcgggacctcacgtcgctcgcggtgccgctgccgctgccgctgccgccgtcgtcggcgccgtcgtcgacgtcgtcgtccgggtcgtcctcgctcggcggcgtgcccaccccgccgaattcggtcggctccgcgccgccggccccgccgccgctgtcggagctggagcgcgtccgccgcatcgggagcggcgcgggcgggacggtgtggatggtgcggcaccgccccacggggcggccgtacgcgctcaaggtgctctacgggaaccacgacgacgccgtgcggcggcagatcacgcgcgagatcgcgatcctccgcaccgccgagcacccggccgtcgtgcggtgccacggcatgtacgagcaggccggcgagctccagatcctgctcgagtacatggacgggggatccctcgagggccgccgcatcgcctccgaggccttcctcgccgacgtcgcgcgccaggtgctctccgggatcgcctacctccaccgccgccacatcgtccaccgcgacatcaagccatccaacctcctcatcgactccggccgccgcgtcaagatcgccgacttcggcgtcggccgcatcctcaaccagaccatggacccctgcaactcctccgtcgggaccatcgcctacatgagccccgagcgcatcaacaccgacctcaacgacggcgcctacgacggctacgccggcgacatctggagcttcggcctgagcattctcgagttctacatgggcaggttccccctcggggagaatctcggcaagcagggagactgggccgccctcatgtgcgcgatttgctactccgactcgccggcgccgccgcccaacgcctcgccggagttcaagagcttcatcagctgctgcctccagaagaacccggcgcggcggccatcggcggcgcagcttctccaacatcggttcgtcgccgggccacagcagcagcagcagccgcagccgcagcccctcgcaccgcctccgtcatgatgaattccgatgggattccggcgttgatccggctcggccatggatggacggtggtttggcattgagacgtgggatctaggagtgctcttcctagccattttgggtattcaagccaccaccacaatttagtgatttaccctcatcatcatcccctctcttgtcgctgttgctcctggaattaagctcctctcctctcctccccttcccctcctcaacttttctttaatctcttcttcttcttttttttcttcttcttcttccaattaagttcatgttcttccaaatgatcatcatataatatgggttgttaagaaagcaatttcttcttaattaatttattttctaaaatcatcattggagcagtagaagtagtagtagtagtaggtggtggtgtccatctgctccagttgcaggaggaggaggagaagatggtgacaaaacaacattgtgatgctttgctgtgctggcttcttggattctgcaaattgtggggggtggattggattggattggatggatcatgaatggttggagcaagcaaatcttgaaatgggaaccaaatcaactttattttttcctcctcctcttcctgaatcctgatcctttctctctggtggttttgaggggagaatgatcgaatgaaatcatgaattgctctctttattctttgtctcactttgctaccagtagtagtatattgcttctgaacctgtgcttttcttctcttctccttttccctttcccagttcattatttttggggcccctgtagggatggcactactactactttgcatgcatcgatagatttgggtcatttttttttagcgtgacatccttaattttcacgtagtaaaaggaaagcatgaaaaagaacaagaagaacaggggacgcagccgcgaagggccctctgcttctgttgtgcagagagtgacaattgcttgcaaatggatagatttgtaggtcggcgaaaggggctgtacataggaaaagcgatgatgagatggtatgagatgagatgagagcaagagagagaagaaccaaccaagagggtgtcgcctccatcaatgtggtgatgctgtacgcaggccgtcctgtgctgacatgtgggcccgaatgggctgcttgcttcgtggaggtgtatgaattgagtttgtgaacagtgtgcatctacaataaatagacacggccttctcatgtgtgtgtgtatgagctgacttatgatgatgatgcagtgcacttgcagcaaagagtacaatgcgccccagctgagaggaacaattcaactgtgatttctaatgcaagattttatctagtataactttataaattacttctttcgttctaaaaagtttatctgttagttaaaaatgaaccagcatgatacaaaagaaagagaggagtgtgaattactcatcctcctatgtcctatcttagtagtaggttaaaaagggtgtttaattatctctcccagtgtacatgaacatgatgatgagtacttcgtcgtaccacgtatggttgcatgcgcagtactcctctgcttataatgcgtgatgcggtatgtcttgcgtgatgcattattggtgtagttaagatggcacgagatgtcaatgtttcgtccacagattacctacgggaagtacatccagagcactcatttata

SEQ ID NO: 681 - DNA, 5714 bp, Oryza sativa
atcgtcacgaggtcaaccagtcaacagcaaatggtccttggtgtcctctttcgacctgtggtccataaccatgtgtacaattattcagaagtggtagtataccgttggcaacgtcctctagtttcacatttttcagggtgttttacttttctgaacttccgatcaacgtggagtttaattagcagtcagtcagcgcctgaagatagattgcaggctgcacgtgggggcgtagctacgtagccgcgtcagggtcaacgacactactttaatacatatacgtacgtatgtacgtacgtccagttctactatttgtctacccaagatgattggagccacacgtcggtcagttcgtcacccacacgctacagtcgaccaagctgttcagatacgcactctatatatcgtagtaaaacactaatgaatcgattgatctcgtctcaccagttaattaactttagtgtaatactatatactcctaccgtttttaatacatgacaccgttaactttcgaacacatgtttaatcatttatcttattaaaaaattttatttaaatgtataagatagtataaattacactttaagtactttaagtgataaaacaactcataacaaaataaattataattatataattttttttaatataacgattaattaaatgtgagaaaaatcaactctgtttatctattaaaaaaacgaaggtggcatgtgtcgcttttcatagcggccgtaaagaaggaaatggatacgccccgtgaagccgggcactgtcgtgtcgcagtctctctcccatccctcgtctatattggagtactccagtatattttgccggccgagcagtaaactagtactactagtaaaatagtgggcgcacaagactacagcagggaagccaagcaccaacggccgcacggcccgcaccgcgcgcaccagctagtagaaaacaccgttttcctacgtaattccgagccaaaaccacgtaacaatcgcccgcccacgtcccgtgtccccccatcccttcgccattggccggcacgcgctttgacgcagccgccgcagccgcgcgggtaacaataaaaacgcccccgtgcaccgcctgcctggcgaaaaaccggatcaacgcgagcaagcgctcacctcaccacctcaccctgcagcgacagaaagagtctgtagtagcgtacgatcgcggctagctatcgagctccagcgagaggcgtacgtgagtgcgtgcgtacgtgcgggagggaggaggaggggagatggcagggggaggaggggggagggcgttgccggagacgccgacgtgggcggtggccgtggtctgcgccgtcatcgtgctcgtctccgtcgccatggagcacggcctccacaagctcggccatgtacgtgccgttgcatccatcgtttgttaatttgttcgtttgtttttggctggctctccacaaaaccgaccttgataacaccattcctggtggcctggtgcttgattgattgatattgcagtggttccataagcgggagaagaaggccatgggcgaagcgctcgagaagatcaaagcaggtcagctttagtttcaccaacctgttcgatttcttgtcaaagcaaatttcactctctctctttttgaacaaaaggcaggagctagctttgcctcttaatcttccatttttcgtcaaaacggtaccatgtttgaagtttgaagtacaaatacttagcctcttatatcgtcaaacagtcaccggagtacataaatgaccacttagttttcctcttcaaacatagaacactcgtattctaatttctaaacataaacataaaggtcgcacttatataattccaaacaggaaaacaatagccgccgcaccagttcatcacaggaagtcaagactcatcatctacatgcttccattccagtgcccatatcctgatccctgattggctctgtccatttaccttttctctctctttttttccctgtttcttccacttgcagagttgatgctgctgggcttcatatcgctgctcctcactgtggcacaaacgcccatctccaagatatgcatcccggagtcagctgccaacatcatgctgccgtgcaaggcagggcaagatatcgtcaagggcctgaagggaaaaaaggaccatcgccggaggcttctctggtacaccggagaagaagagagccatcgccggtcactggccggcgccgccggcgaggattactgcgcgcaatcggtgagcaaaaacgctgcttaatctgttgcaacgtcacacgatgatttcgagggaaattcaagtgcgaatttaacgatgatgatttttcttcgtttttgcagggcaaggtggcgctgatgtcatcgggcggcatgcaccagctgcacatattcattttcgtgctcgcggtgttccacgtcacctactgcgtcatcaccatggctctagggcgtctcaaagtgagtggctaattaaccacctggcactctgttgtcaagcacggtttttttagtagaatttgtcagtctttgatttggattgcgatgagaaaatctattaatttgcccatgcatatgttgttccttggtgtagatgaagaaatggaagaaatgggaattagagaccaactcgttggagtatcagttcgcaaacggtaattaaagaatctaactaatactaaccttcttacctgaaacttgaaacatgacagcaaagaactgataactcgtatcatccttgcagatccttcacgattccggttcacgcatcagacatcgttcgtgaaacggcatctgggactgtcaagcacacctgggctcagatggattgtgagttcttgcacctaatcgatctctacctgcctaatctttgcagctacctggttattgttcgtatccaacattttttttaaagaaaaaaaactaccatgtttgttgttaggtggcgttcttcaggcagttcttcgggtctgtcaccaaggtggactacctgaccatgcggcaaggcttcatcaatgtactactactaattaacctgacccattcgccattgttgcaatggaccaagcttttgggagtgtgcactaattaactaatgtatctttaattctttgcaggcgcatttgtcgcagaatagcaagttcgacttccacaaatacatcaagaggtcattagaggacgatttcaaagttgtcgttggcatcaggtgaatccctctctccagtacttctctcttttttttttttaagaaagaaagacaagtattcagtcttgtgttcgtccttcgatcttgacacatttggcctgtttttgcagcctcccattgtggtttgtcgcgatccttgtgctcttccttgatatccaaggtaatcttttgtcctatcctgttcgttcttttgtttgctctgaataattggtcttgtaatcaccatgttttttatctgtgtgtggtgcagggttcggcacgcttatctggatctcttttgttccactcgtcgtaagtgcgaattatatatatttcttgacttcttgtgcaaatgaatagtcaacagaatcatgattttatcctacaaggtatgcaaaacatttgacaaaaaaaatgcatgccgttgtctttagatcctcatgttggttgggacaaagctggagatggttatcatggagatggcacaggagatacaggacagggcaactgtgatcaagggagcaccggtcgttgaaccaagcaacaagtacttctggtttaaccggcctgattgggtcttgttcttcatacacttgatactgttccagaacgcatttcagatggcacatttcgtgtggactctggtatgctacttgctaattggcatcaaccttcaaaagccagtgttatgcactcactaatgagccactaatgattgacatggtttggttatttttgtctgacaggcaacccctggcctgaagaaatgcttccatgaaaacatgggcttgagtatcatgaaagttgtagtggggatattcattcagttcctatgcagctacagcaccttccctctctacgcactcgtcacacaggtgaaaccatttagacaaaaatcacttgtaaatgctcttggaggtctcaattccaacgtcctcaacctttccgtgtgtttgcagatgggatcaaacatgaagaagaccatcttcgaggagcagacgatgaaggccctgatgaactggaggaagacggcgagggagaagaagaagctccgggacgccgacgagttcctagcacagatgagcggcgacacgacgccgagccgcggctcgtcgccggtgcacctgctgcacaagcaaagggtgaggtcggaagatccgccgagcgcaccggcatcgccggggttcgccggagaggccagggacatgtacccggtgcccgtggcgccggtggtgcggccgcatgggtttaaccggatggacccggataagaggagggcggcgtcctcgtcggccatccaagttgacatcgccgattctgatttctccttcagtgtacaacggtgatggccgaaaggtttctctgtacttaagttgtatagcagcaaatataggagtacaatgtatagttggtacactacatatagagattagaaaagtacagtcgatttttttaagaaacaataaaagcataactttgtataacatattctttcggaagaaagatgcggcagcattggggaacatccaaataatctccatcctctttcgtcttactataaaactacatggaaaattcttgttaattcaaaataaaaatgatagtaatagttagctgcaaagggttcgagctgaaggagtcaacaaagtagaagctggacgatcctatcgtaagccatcactgcttatattcaatatatgaaagctaaatgacataaatctggatttagctgcaaaaggttccagatgaacgagtcaacaacgtagaacttggatgatcctatcgtaagccatcactccttatattcaatatgaaagctctctggtcccaaaaaaagaatacttgtacactatcgggaaaaatcactgatggccaggaaaaagcaagggcacttgtcatccataggctagctagtcagctttggcacgacctcttctcttatgagtaactactagggccagtgatattgccattccaatcaaatgcccagcgactgagccataagtaacagagattggccattcctacgaaaaatcatgacagaacattagcaagtggcagaatggaggtgcaggcaacgatagaagcaatgtgtaaggctcagcaagggaattatcagccttgtgcactacatagtccactgaaagcaggatgcacgacgagaacacaagattatttcagataaaagagatgataataatgagtagtcccaaaagcaacagacaacagaagtacagaatatgaggcaagctacagaaactcatgtcagctccaaaaagttagttcatgctaatgctgtttaagctggaaccttaggtagtgaacatgcaggaaaatttcagatacagagcatgcataaaaacattcaaatttcacttaaatagatgccgaagagtaatgtgaaattaattcagataaaggaggtgataatatggagtagttcttttaaatggccgatataactgtagaacttcaaacaaattactataatccatgtaaacccaactaaattagttaatgaggtagcggtt

SEQ ID NO: 682 - DNA, 3848 bp, Oryza sativa
ggtcgtgtacacaatcatttttgcagaatgtgggtgacgtacggtgtgtgacaatcagaaaaatctgacttttttttaaagatgcggacatccctctaaatattttttcaagaaattgtgagcgtgttggggattaaacatagaacctcggagttgaaactacacaccacttaccgctacactatcaaatgcatctcctactcttatcgtatcaatgtgcttggtagagccaaaacattggataggcatgtacatgaaatgtgctttcaaatcataaatttgacacgagtgttcgtatttatagctaattattctttcaatggtaggcgatgtacccgtcgacagcgatacgcccgtggtgacttcgttaatctcaagatatactgacccagtctttcggatgtcctcatatgagtagggtgtgcattcataaacggatgagtgtgcgtgtgttatgagcgtctacatttgtactgtgtttatagaaaaaactttggataggcataaacatgaaaggagcccccatgtgatatttacgtctcgcgtgggagcaacacaccctagcaaggattgcgtggtgccaccaggacatccgtttctatctctttttgcatctcttttctcaactcaacgtacacgcgtaagagttggttttaactttttttcgtccaaattgctgaaattgccaaataggacattacatgtccaatgagtccctccaaactccgttggcaaattgcaacttttgcaaatcaacctgtacatcgtacaccacctgtatatatagacagaagcgcacataggacagatagctagaaagaaagaaataaagcatatacttttaagcaaaaacaaatgtaaagagcatgtcaccttgtcgattctctatggtgatagggtccagggcaatgccatgtcatgctatcttatccctgtgctttgcacacagctttttcaccaaatccctgcaagaatcctcctataaatacccacccaattgatccatcaatttcccatcacaaaacacataaaactatatcatcatcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccaggtgctatatatatgcgcactttaatttgcatgagcctcactacatacggtgctctctactggtagtagaaatcaatctaaaccgttaatcttatttgaccgaatggttcagagatctatttatattatggtagtaaaatcgtggatgggtgttatcgtcagaaaaaaaaataggggtgaagggtatagtcgtcatttagcagtggctaaactcttttttctccttttttggctttttcgatgaaatatgagcgatgccagcgcaatagatgatcatagatcaatttagctgagaaaaaacataaatgacaaaataatttctaatcattgtattagtaaattactaatttaccttaataatactgatactagtagtataatactaccagtagagagcaccagagcgtcgatttgcatacgaggcagggcggaggcaggcctaggacaggtagggcttaagccctaggcttgttgcctccaaaatcatggttaaactctcttaaatcatcatttaaatttgggaaaagaaatgaataactaattaataacaccctacctttgtcctactcttagagtccgtcactgcatacgccgaagttctattgatagagcagaaaaaaattacaaaattataaccctgaaatgtcgaaaccaggaaaaaggaaaaaatatatattgattgtgaccctgatagatgcgatactaatgcaacatatattgactgtgtttgtagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacggaagagatggtgctgtgtaggatctccaacaaggacctgcctaaaccacccttcatccacaacagcttgttgcagttctcttcagtggggttgaatggtgatgggtataattacttgatccttgatcaccttgagcctccagcaatggagtatcctaatgttggcattggtaatgttgatgatgctgctgctggtactgatgatccgggtgaccttgatgaggagattgatgatagcatgcaaagaaaccatggtggctagaattaaccagtagcatcatgagtgaatggttttgcgggagatttgagttaaatatcagataataaaataataatacaaagaataaaaagaaaaacaaacctgtatagttagcaggttttgattcatttcgttgaactttgtgtgcttgttagctagcctatataccaaacatgccttggcgaggctttctatttgtatatagctttttttcttttttctattgtaaggttcgaactctattgagttgattgaataaacattatgcaatttatgtaacatattgtctataaagttctattggcatgcatattcatatatagttacagtcctttagttttaaattgaaatttcattttaaaagttcattatttgtcattgacaataatgacaaaatgctctagtatgttgtttccatttacaaatggaaagtccgtttggtttggctgttactgtaacaccccaggtaaccacgtacatagaatgccacaccaaaatacactcaaaaactaagtcctaaaattattagaaatttcggcagagtctcccttaaaaatacggacatcacgacaggcagttataagaaaggtcaataccgatataaaccacacaatccaaaccatcctagctccataaatcccacgtgaaaaataagaatcagaaccttaaatgacctttacaagttctatgcaaaacttatgctgagcaaaaattatagtctaaaactaatttcaattgtgtgcaataataatgtgtagtccaagggtgctactcccaccccatgccgatcgatgtcattaggtacctaaaaaccaaattaaacataagagtgagtaaagaatactcagcaagtacaatcttgaactagtaaaacatacgcatgatttatgcattaagaaaccaacatgaagggttggatttactttatttttaaaccaaagaagtcaaaagatagtagttccctcccgggcaggtgtgaatatcctcttagcattaccggtaagccaagcaagcgtaatcagcgcttcacaaggatcatgaataaagatccaaattgcactcccatagctacgcatggttcttgaataatgtaaacagaacatccggaataatgaaacatgaataacgtcatgaatttgaatatgggtcgaaacacgaataaatagcataacgtcatagccatacaatcagtaataacaagcaattgaataataattatgcaagtaaagccaaacaaaacaactcagttttgtccatcacataagtccgtcttgtacttac

SEQ ID NO: 683 - DNA, 8527 bp, Oryza sativa
atgtataattggtatagtaaccattcaccctatccaataatggggagaaactagcagtttgcacgaaatggtgtctgtgtctctagcagtttttgtgaagaaaaaaaatattctatcaatatggttttggacaatgttccaagctgagattataactttgaatgtttatatatttttattttaaaatgtttaaattggatcaatggaaaccatatatgcatattcgactcgaaaatgtgtattatactagattagttttaaattgttctgcagtaggaattaacggtcaagtagcatcttgaaatcgtattagatgtccaatgtggcatattcttttgatgtcgggaaggaagtagtccaccaaaaagtaaaaattacaattgaaagctcaaaacacatattagactcgagcattgaaaaaaaagccatggagaccttttcgtacgtgacactgaccccacctacggaatgtatgagaaaagacaaaaaaagaagatttacttttttcagtataatatttacactccttccgtttcagttttatatgataagtctttcaacaatttcctagccaaactaagtttataaaaaaaattatcaacatataaaatatcaaattagtttcattgaatatattttgataatatgtttgttttatattgaaattattatgtatttttctataaatttgattaaattttaaaaaaagttgattagataaaaagtcaaacgatttaaaatataaattgaatagagtacattatgagttgcggtctttcaaaaagaaaaagagagagaaaaaataaataatttcctgctaagcaaatactgtccgtcacgaaatctccaatcgcgtcatcagctataccaacgcaacgcgcgttctcctcccccacccccctctccccagtgacgatgacacgtgggccccacacgacgttaggaacgaggcggtccgctcgcggaactataaaccggtcagcgtccgcacggcaccaaccttccttccttgtgcagttgtgcgggttggccggcccgcccgtggatcgtcttccaaccgggcgcgagtcggagtcgcgaccgcgaccgcgacctcacccaccgtttctcgatcgtttctctccctcctcctcccgcgatccggtcttcttcctcctccccgtcgtgctcgccgcccacgactcctcctcctcctccaccaccacccctccacgacgcggcgggcggcgagcgcgcgcctcgtctcaccctcacgcctcccacgccttggaacccaattggagatagaagaggggagcgcgaggtcaaaccaggggaatcggaatcggaatcggaatccgcgacgagacgaccctacccccgcgctccggcgaccgaccggcggcgatggagggcggaaaccacggtgggggagggtacccctacccgccgccgcagcagtatccttacccgtacgggcagtacccataccagtatcctccaccgcagcagcagccgccgccgccctccgcctacctctcgccgtcccgttcgttccacggttacccctccgcgccgccgccgcagccgcagccgcagccgtacgcgcaccattccgccccgctccagccttacccgccgccgccgcagcaccatgcctacccgccgccgcagccgcatccgccctcgccgtacgtctacgacccttaccacgcgcccgccgcggcgtacccttcctacccgagccccaaccccagcccgtccatctccccgagctccagcttccaccaccaccctgaaccgccatcgccatcgccctccgcgccgtcgtacccctccattgcggatgggctcgccaacatgcacgtctccgaccgccacgactacccgccgccgccgtcgccggcggccgtgcccgcggcgtcgtccccctccgtgctcccgccttccgcgtcgttccccggcggcgggagcagccacggcggtggcgggatgcagatggtgccgtacggccctcctgccggagggtcgcagcacggtgggatgcagatggtggcgtacggctcgccggccggagggtcgcagcacggcagcgtgaggccatccctgaaggtggtgctgctccacggcaccctcgacgtctgggtgtacgacgctcggaacctcccgaacaaggatctcttctccaagagggtcggcgacctcctcggtccgcgcctcatcggcgccgtcggcagcaaaatgtccagcgccaacatgaccagcgacccctatgttaccatccaggtctcctatgccaccgtcgcgcgcacctacgtcgttcccaacaatgagaaccccgtttggacgcagaatttccttgtccctgttgggcatgatgccgccgaggtcgagttcgttgtcaaggacaatgatgtcttcggtgctcagctcataggcacagtgtcgattcctgctgagaagctcctttttggagaaaggattaacggcatctacgatgtgcttgagtccaatgggaagccatgcgctcaaggtgctgtgttgcggctgtccatacagtacatcccggtggctcagctcaaaatgtatcaccatggtgtcattgccggcccagatagcctgggagttcctaatacttacttcccgatgcggcgtggcaatagagtgacactgtatcaggacgcacatgtgcctgatggttgtctcccggatttctgtcttgatcacggaatgcgctatcagcacgggcagtgttggcgtgatatctacgatgctatatgccaagcacggcggttgatttacattgtgggatggtcagtgttccacacaatccacctcatcagggaaggagttgagaagatgccatcacttggggaactgttgaagatgaagtcacaggaaggggtgagggtgttgcttcttgtgtgggacgatccaacatcaaggagtattcttggaattaagacggtatgagttattcattgagttcaaaattgctttgttcatgacttttacaccgcacacgagaacatgattttgtgtccaaactccaaactgcaaatttataaattgaagtgctgcaatgtttatggaaaaattgggaaacattggcacttgaagattgtctaatcctcaatacacaaatacaaaaaggcatcagaaagggcatttttacaactgctgttatcacattaaagaatttacaaaacatccggttgcatcaatataacattgagaggatcttcatcaagctcatctatttcctccaaatttttctgtaatagtttggtagcttgtcctttaggtgcatgtaccttatctttggtcccatgtttcatgatgctggaaagtttgaagtagattatgctgcttatccacttgtaggatggtttcatgggcacacgagatgaggagacccgcagatttttcaagcactcttcagttcaagtattgctttgcccacgatctgctgggaaacggcacagctgggtgaaacagcaggtattgtgatgccacacaaacttatccattatgatattccatttttgtttgtcacctaaattactacaattgattgcaccaagtgagtggtttcaaactttttatatgtctactcttcatgcttggaagttatgctgtacttcacaatcgctgttccttatacctgatcaggaagagaaatttgatattcacataatgcacacatatatttgttgttggattcttttgtataatggcatttatcaagcaatcttgtattgtattaattcttttagtaccatgtatttatcatatgatggtattgaaattcaggaaacaggaaccatttttactcatcatcagaaaacagttattttggatgctgatgctggcaatcataagaggaaaataattgcttttgttggtggcctcgatttatgcggtgggcgatatgatacacctagccatcctctatttaggtctcttcagactgtgcacaaggaggattattacaatccaaattttgctgtaagtgtttgattcctttaacatatacttgtatcttgatgtggtttctgatgtaaagctacaattaacttcttgcttttgagatgatgatagtaagaaacgtatctaatatttagttcctaaccatggaatatctttcgacagaaagctgttccatctttctcttatctttggttcctgaaagtttctttctctctctgcttttttttttctgcagacagttgatgctcgtggcccaagggaaccatggcacgacttgcattccaagattgatggtccagcggcatatgatgttttgcaaaattttcaggagcgttggttaaaggcatccaaacgccatgggattaaaaagttaggaaaatcatatgatgatgccctcctcagtattgaaagaatacctgattttataagcattaatgacgcaatatattttagtgacaatgatccagagacgtggcatgttcaggtatttatagtatcttgtagtcagtgtgtgtaagtttttccttgttttaactttctacttaaactttatttgctttgaaacctaggtgtttcgttctattgattcaaattctgccaaaggatttccaaaggatccacgggaagcaacccgcaaggtaattgagtactgtttgcatgtactaatattatattcattattatgtgcttttcgctaacaccttgctttgcctagcagaatcttgtttgtgggaagaatgtactgattgatatgagcatacatactgcatatgtcaatgctattcgtggagcgcagcacttcatttatattgagaaccagtatttcattggatcttcgtttaattgggattcaaacaaagatattggtaagcatatggtgtaaagttatttttttaattaatgtgcacccaccaataaaaaaaatccagaaacaaaatacagtgcacattacattttcttgatttgcaaaccatttcagcaattcagaacacagcaaatcccttatctgatcctaaattggtattcaaattgtgagttttcaggggctaataatttaataccaatcgaaattgctctcaaaattgcaaacaagataaaggcaaaagagagattctctgcatatatagtaattcccatgtggcctgagggtaatccaacaggtgctcctacacaaagaattctttactggcaggttagatcaacatgtctgctttgtgtcttgtttaatgtttatatagattatacccagttagttcatttgacatgatcgcatgttttttttgttgctcctgtagcacaagacaatgcaaatgatgtacgaaacaatatatagggccctgaaagaagagggtctagatgatctatatgagcctcaggattatctgaacttcttttgtcttggcaatcgtgaagttgctgacagtccaagcacttcaaactcaacaagcactcctcaggtaagacgtcttgttttttcctttgacaaactatgctgaggaccctccattggttttagttttccctgcaaggttaaatgcttttttttttcatttatagtattaaatacagtaattaatgtcacattgaatttcaacaaaagtcacaatatggtcccttaagcctgcgtcatacgagaatgtgaaagctgctgatcttgccgacctctgaagataaattttgctctgacttgccatattacactggttcttaaaggatattgatatcaagtcttgttctctgatcctacatggaggccaaatatccaatccactttagtttctttatcagatgatacatggaaattctggttttgtacacttgtgccttttatttagaagaaaacattcgatcggttagaatgatttggctcaattgtctagatgttctacaataatgtttcatcttgttggagcactgtgtatagtatttaacttttgatttatcaaaattacaggatatattaatatgtatgatatgcttgctagcaatctcgctgaactttgttatttttttaacatctgacttgcatgaaaactgcctgcatgcaacctcgttcatttattctacatttactacccaggaacaagctaggaaacatagaagattcatggtatatgtacattcaaaaggcatgattgtggatgatgaatatgtgataattggatcagctaatatcaatcagaggtccatggaaggtatcagagatactgagattgcgatgggtgcgtatcagccacagtatacatgggcaagtaaggtttctgcaccccgtggacaggtaacaacacttcatgcctgtatggctgtatcacatttctggagatctacagagaaccgagctggcatcatatgctcatatattaaacattgcgccttcagtgattgtacatttgcaactcgtttgctttacactgttattgtctgttgttcagcactactgcatcaatccagccatatatatttgttgcaattatcttttgttttggcagagtaacctaaagggaaattcgtaccctatcaatcatatttttttagataaggctaaaaaaagctaccactcactcttaagaatatgttaattggaagaaaaaaagagaagctaccattcattctcaagaatatgttaattgaagaaaaagagagctatctacaccatccatcatggtgggaccagattgtagctacaaatgtatggaaaatacaaatgtatttgtagaaatagagaaaaagttgcatatcaagtacagtcatatttcaaatagccctgtacaactgtgaaggaatctcgactagttgtctcttggtttgagggatatacctattttaggatgactgatatttctagaaccacactctaattcaaatctgctgatttcatgtgtagatttatgggtacagaatgtctctttgggcggagcatattggagtggttgaggaaggcttcaactatccagagaccatggaatgcatgagacgagttcgccaaatcggtgaacagaactgggaacgatttgttgataatgaggtgactgagatgagaggccacctaatgaagtaccctgtaagtgttgaccgtaagggcaaggtgaaacccttgccaggatgtacgtcattcccagacatgggtggtaacatctgtggatcattccgagccatccaagaaaacctcacaatatgaatttcgattatctgtaagtatacaattgctagtgattctgagctattctgcttcctgaggttatagatagcgtgaaaattttgctagcaatataggttgaaaccaagtaggacatgacaagaaaaggttattaccctgcattttttatgcctttcttaagagaattcaacatttccatcttaataggttttctttttatgtatactttttatcaatgtatagaagattaagaatgtttgaaagcccggaaccctctgtttagggaacatggctttggtagcaactttgattgatttaagtatgtagcgacatgtaaagccattaaaataagtttctagtgtaattattttcagccttgatttgctggttccattttctaagtgtcaatgaaatctaatccatttatttcttcgtcatgcccttggtaacataagtttccgctttgtttttgcaatgcttcttcaaggttacataatcaacaagcagatactgaacctatgtctagagaagagtaaaaattaagtgggtgcaaataaaatctactctaaactctaaagacagttgaacattttcttttccttgaattacatgcatttttttgctcctgaaacgaaattatcttttgttcatcatttcttccatctctcggactgaatcttcacacccatatacctgcccagtgtccatattgaaaactatactgttagtgtgttgttactcatggcaatgcactttcatgagctaaaatgatgccagttacctgccgagcatcatgacggtggcctgagggttggtgccgggggagtacttgaaggtggagctgtcgatcaccctgagcccctgcaccccgaacacccggtaatcgtcgtcgacgacggcgccgacatggcagccgccgtggtagtgccagatggtcatgacggtgtccatgcagtactgctccggcgagcgcgagtcgttgacatggcgcggcagcaggttgacggggaagttggcggaatcggtgaagatggactcgacggaggcgttggcgtaggtgaagttggagaaggcccgcgactggatcacccgctcgatcgtctcgatgccatggacgcaccgctccagatcctctgcctcgcggaagtagttgaacgtcaccgacgggttcgccctcgggtcggtggttcgcagctcgacgtggccggaggacaccggcccgaggatcttctccaggatgaagcctccccggaacgccctcctgtccagccgcatcatcgcctccgccgcccgctgcagcgcctccggcgtcctctgcttcggcggcagcgtgccgagctgccccgtctgcggcgacagcatcccgaagctgcgcgcccaccggagcgcgccgtccgacac

SEQ ID NO: 684 - DNA, 2851 bp, Oryza sativa; identical to SEQ ID NO: 400

SEQ ID NO: 685 - DNA, 4829 bp, Oryza sativa; identical to SEQ ID NO: 646

SEQ ID NO: 686 - DNA, 4742 bp, Oryza sativa
ttcgaaaaagaatagtgcctttatcctaaaatataacaatttatatctctcaagatttgtctcaaaatataacaacttcttcaccagcattctcttcccaaccaatcacaatcctttaccattcacttttcccacctacctccactacttatccaatcacaaccctccaccatttaggccctgtttagttcccaaaataaaaattttcacgctgtcacatcgaatgtttggacacatgcatggagtattaaatgtaggaaaaaaactcaattacacagattgcatgtaaattgcgagacatatattttaagcctaattgcgccatgatttgataatatggtgctacagtaaacatttgctaatgacggattaattaggcttaataaagtcgtctgaatatgtaatttgttttgttattagactacgtttaatacttcaaatatgtgtttgtatatccgatgtgacaactaaatccaaaaagtttccccaactaaattaggccttacttctacctactttattactcactccacccctaaatataagggattttggttgaacttatatatcctgtctagattttgtctagattcgcatacttagggcatgctcactttaatgaaaaaaaaaaccttaccaaatttttggcatagttgccaaaattttggtaacttgttaaaattttggtaggatttcttatatagtcatcaaaatttagcagtaaactaaatatagtcatatttttagtaactttatgttaaaaatggcattaaagtaaacatgccctcagagggagtaataaccgtttccgtccgttttcatgcgtctagcctggttccgggtccggtcccaccggaccatccccgtgtgcgatgcgaactcaaaaaacggctcgacccagcgacctggggcgtccgtgtccgggtccgggtccgggtcggaccgcgctgcgcctcctccctttatttatcccgtgcaccgtgcccgccgcagaagtagtagagactagagaggccacaggcggcggcggcagcagcggaagtctctcgtctcgtccgtggagaaagggggaagacgaagatgtcgacggaggcggagaccaccagcgccgccgcccccgcccccgcccccgcccccgcatcggcgccggcgcggtgccagcggataggctgcgacgccacgttcaccgacgacaacaaccccgacggctcctgccaataccacccctccgtgagtcctcctcctccccttcttccccttctaaatctcatggggtctaactaattgccccgcggattacgggagtggaggagtctgttcttctagggggaagttgggcagttcgaatctgtaatggcggggtcaagggcttcgcctgctcttgggaaacttctggggacgaattgggcagcggggaatatttgagttctatatacaataatgaaatttagtgtcatatagagatatgttggactacactcattactcatagtagattagtggattggattgcacgattatactcatagtagattagtagattagtggattggattacacgattcaatcagaagggttattgatgccattggcaaaaggtattgtagttgtcgcaaacacgtgatattaggtggttttttttttgccccttatttgggttaggatattggtaccttgaagctgcctcttgatgaggcatcatgggcaatgtgtctgatgtgtggcgagggatttttttcccctttggatatggctcacatgagtgctgactatttacaaaaagcaaaaggaaaagaggcaaagaactacctttcccttcagagagtaaacaaaattaatttggaataaagatatgacattctctttctctttctctttttcaatccctaccgtgtctaagggtcagatacccatgttgtaccaaaaaaggattaagtacacaaacagctgctgcaaaacttcttcacaacttcttctatttccaattgtgaatatctcttgataacaatggaagaaataatggttaattttttcaagcaattcttttcttttgtctccaaagattcaaatcacattgctaactttgtgatgccatgccaaattccattgtaatatttaaacaccaaattcacactcatgtttactgcatttggtctagaagaaatacacaacagctagtataagagaatacctaaatgtggtcccattcttttttggaaaatgacgaataaagcaacatatttaaacaagactcgtataatatgtttgctaactctctttatggtttcttgtctactgccaaatactatatttatttccaattttccactgtagtgttctgaccactgtctccttttttttttcttgcagggagtaagtgtttcttctttgcatgagagggtacttctagaaggatgcataggttaattttctaagattttttttttcagcctatgtttcatgatggcatgaaacagtggagttgctgtaagcaaaaaagccatgattttagcctatttttggctattcctgggtaaggatccctctctagtatttccttttcacagcatgcacccacaacataagtcaactatgtgctatcaacctgaacattaccatctgggctggcctgttgtgtattttagcaaaaccaagcatgaatgcatgaatcgtatgctgtactgctgtgtaggtgcaaaactggaaagcacacaactgagaaaccaatcacaaaagcagttcctactaaaccatcaaaggcagttccagtccagacttcgaagcagagtgtgggagctgacacttgctcaaggtgccgtcaaggtttcttttgctctgaccatggtgagtttctgtctataagcataatgcttggatacaactgattgatcccctatttgggtgtaacagctgattgtttcgttattattttaacgactgacatccctatgcatttttatgtgttgatagaataaatcgtaacttttaatttaacagattatgcactgctattttttcaggatcacaacccaaggcacaaataccaaccgctaccagtgatactaacatggtacctgttgagaagcctgcagttccaccaccaaagaaaaaaattgatctgaatgagcctagggtttgtaagaacaaaggatgtggtaaaacctacaaggagaaggataatcatgatgaagcatgcgattaccatccaggacctgcagtttttcgcgacaggattagaggggtatgtttttggttcaaacttattgttgttttgctctattccttgatttttgccatcactgactctgacatctttttaaaaatttttgcagtggaaatgttgtgatattcatgtcaaggaatttgatgaatttatggagatccctccgtgcacaaagggttggcacaatgctgatgccgcatgaattttcaccatgccccatcttggaataagaaccctattagcataaggttctcttgtatctcgtagtgcataaggtgcaatttttatggagaattttacttggagttggggagtgtggcaaagataccgagaataggctgttttaccgtgctctgtgtgactgctgcaaaagtgtgcgtggtgtttcattttttgtctgaaacggggacttgaaattgtgtgtggagacttcggtctcgttcgttggctcgttgccaattcttcatagttagaaaatcaaatgctccatctaaatgctatcctgcagacttttggtaacacccatctttctgtttatatgagaaataacatgatttcgttatcatatcaaacacttccttttccatccctacgcaacaaaattgggtattaggtagtgtcttcgtttctcaacattttgtgctactaaagttgataacaataacttaactttgacatcaaccatacacttcttttccatcattcccaactgatttggcgctgccaaagctttgcccaaccttcaacggtacttttacatggcatcaaattaaatcaaccctatcaaattttctgtggcatcaaattgatccaattctgtccgatttaatgcatacaagtttttaaaactaaactatggattgtgacaccgcaagaatcaatgtgttgctgtccaattccagtactctgggcgctcgagtcgaaggacaccactgtttgatgtgatgaagtgcactaaggctctgttctttttggttgagttgggaacccatccctccggtacgtaaaacgaatcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagtgtaacaacatctcgaccaacttacctactccatccgtcttaatagaagtgtaatataatatactccctccgtttcacaatgtaagtcattctagcatttcccacatttatattggtgctggtagtatatgtgatatatcctaggactataaatctggattattgtctatccacgttcgtagttttaggatatgtcacatcctactactactattttttttccaaacaacagtattctctctctatattggttgtcggttgttctctcctcaccctatcacagctgctgcagcttcctcatgcaccaaatgttgg

SEQ ID NO: 687 - DNA, 5450 bp, Oryza sativa
catccctatgaatcagaggcaagagcgagagaaacgacctgagctgtgaaagccgacagaactgttgaatcaacgtgcatatatcattcgtcccaagatgaattggtttcgataacaaatcaaaatgcataagttaattttgactataggtacgaacaacttattttgagacggtacaagagcagtgcaagatatacaatgcgtgcctctgccgcccgtctaaagctacgaaatcagtgtcagagccacgagctccacaacgcaagtgcgaggaaatcgtttctttgatgtggcatgaagggacgagtcggagcaacaagtcccaaagcacctttctgttctgacgagacgaagaatgtgtctccttatgtgggggcgagagactcagtagggacgcgcgttttgtcaacacgtaggcgaatatactagccggcgatacgctataaaagctctaagaggatgcatgtctctcaactgcgtacaagttttaaaattagattttgaagttgaatttggtttcttttgcactagctttcacaaagttaaggaaagcagacatatgtaaacctttagctgtaaattatttttctattgttctatttattctttttcacggcgtagcttcacggatcaagggtgagatgaaacgtcaaacgtgccttgtgattatcttttctcgtactgcgtcgttggtagtacaggagttctcacttttttgggcccccacgcaaacagccaaaacctggttcacgagtcggatttcgcgacgtcctcgggtgcgtccggttcgtcgctttcttggcctctcggccggatcccacccacccgcccgcattatcgtccagatacgaagccccacgtcatcctgcccatacgcggtgggggccaggttcactctccctttcccacgtccttacccgcacgaatcgcgaagcgcgcatcgacggcgcacagaccgccacgtggcatccgtgggccatataagctcaccatctcagctccgaacactacgcccccctgttcttcttcttcctcctctcccctctcgccgtgctggtggtgagtgaggcggcgagcggcgagctcctccggtgatccgaggctcgccggccggcgagagcttgcctgtttcgggaggttttcagggtgatctgagagcacagcgagccgatggcggcggcggcgaacggggcggcgtgctgcggtggcgcgacggggccagggtacgcgacgccgctggaggccatggagaagggcccgagggagaagctcctctacgtcacctgcgtctacaacggtaagcgaagatttctatcccaacacagtggacatattatcccactagctacatggagcaatggagacgtctgcgattctgcgttactcacagatcttggggggtttaatcgaggattaatttagcaaggtcaattagactttgctgatgtagagtagtaccacgcgtgctcaagaactgacaactgaaatcacctggattggatggacacagttcttagtttaatcctggaagggatttctttaatactgagtgagtgcttggggtgaaagagacccgtcataaaattagcccgaattcgagtcagtactaatattctacactgtactaaacctgctttagatctccagttttgtcggaattcagttgaacagtgtgtttcgcaactttcccatgggccatattgaggcaatttttaaccacctagtatttgttgtgatgaagacaaaggattagagtgtgtgcgcgctttaatttaattcctgccactttagtggatgagtaaccaaattgattggattttcaccacaaaatgttggttctccatggcagaagaaaacaccatctatatgtccctgtatgtaagctaaggtttacatggtttattcttgacagtctgaacaaaagaataggtcagagtttcttgcaggtgtcatgaatttgttttgatggattatgaatcaacatgaacaggtactggaattaacaagccggattacctgggtacggtggacgtggaccccaattcccctacatactcccaagtgatccacaggctcccagtcacccatgtcggcgatgagctgcatcactctggatggaacgcttgcagttcttgccatggtgatccatcggctagccgccgtttcttgattctgccttcgttgctgtgagtgttaatgtggctatatttagatggatggatgaatcctcgtatctgttgatgttaaacagcgaactggatttgtaaattgctccaatgtctgttgcaggtctggccgtgtgtatgtcgttgacacgctgaaggacccaagggcgcctgccttgcataaggtggtcgaggctgaggacattgctgagaagacagggcttggatttcctcatacatctcattgcctggcatctggggagataatgatttcttgccttggggataaggagggaaatgctgctggcaatggcttcctcctgctggattctgaattcaatgtcaaaggacggtgagttcctttatcacaattctgtgcattttgacgcagaaccatagtatgttaaatgtggacaaaattatagtgggtaatctatcaacataaaaccacctcatccatattttacaacctagcaaaatcatcagtattgtgaagttacgagcatagaagttcatcaatacttgtgactattactatggatgtcaatttaaggacaaattccatcttcgtgttcatttccataatgcccattccaggatatgttccatgaaatgtcaatttatgttacacatatttgcatgacttttgaaagataaccatagtatttcccttctcgcagttgggaaaagccaggtcacagccccttgtttggctatgattattggtatcaacctcgtcacaagacaatgatcagttcatcatggggagcacctgcagctttcaggactggttttgatcttcagcatgtgcaggatggtctctatggaagacatctgcacgtgtatgactggcctggtggtgagctcaagcagacactagatttaggcagtacaggtcttcttccacttgaggtgcgtatcaaatgttgagactaaaagggatgcatcaagccgtcaacatatcaaataaccatatatcactgcttttcttctgtgcaggtgaggtttttacatgatccatcaaaggatactgggtatgtgggctgtgctctgacaagcaacatggtcagatttttcaagactgcagatggatcatggagccatgaggtttgtccataactccatgccaatgttcttgctattttcttgtataaagccctatttgtccaatttgtttagttgtttactctccttatgcttgcatgacatgacatgacaggttgctatatctataaaaccattgaaagtgcgcaactggattctgcctgaaatgccaggactgataactgattttgttatctctctggatgatcgctatctctacttggtcaactggcttcatggtgatatcaggcagtacaacatcgaggaccctgcgaagcctgtgttggctggacaagtatgggcaggaggccttcttcaaaagggcagtgaggttgtgtatgtaactgaggatgacaaagaagagcagtacagtgtgccccaggtcaaggtaattatatctcattcctcttggaattctcagttcataatattatccagaattgttggtacttataatttgttgtagttgttcaatctggttcatttgataagatatcaagtaccaaaatggacctaaaaagtatcaagctactatacttacatccacctgctatcatgctgttggaattgcgtgtacttgttctgaagaacacttcatctgcattggaattgtgtgtacttgttctgaagaacaaattttagtcgcttaaatattactcatatgaaccatcttgtatcagggtcatcgacttagaggtgggccacagatgattcagctgagcctggatgggaagaggatatatgtgaccaactctcttttcagccgatgggacgagcagttctatggccaagatcttgtcaagaagggctcccacatgttgcagatcgacgtcgacactgagaaaggaggactatcgatcaaccctaacttctttgtagattttggtgctgagccagagggtccctccttggcccatgagatgagatatcctggtggagattgcacctctgatatatggatataaagatcttgaaggatttgcatacactcaggtgttgattcatcctgtgtattcactgtaactaagactgtatgcttgctgtggtctatatgtaatttcgatggtaacaagtccccataatacctagaacattcactccatggctcatttggtaacattagcttaataaagagatgtatccaatggtgcactttctgctagtgtttggattttgagctatctgattaaatttctccaataatttgctgttgaaatggccctgtagcttttcagttacaacaatctgcattggccaacctttgctgaactgggcttgtcagttctcagaactcaaaaggctttgcttttatcaagatgaatctgatgccctattgccctgaaatctctgcaggccgatttcgagcatgaatcctttctaagaaaaaaaaattgcacagtattagtagtagtagttgataagggacaaggcaattaggcaaagttcttcacctggcaccatcggtggttggaggtgttaaagaagctctctgaatgaaagtgcagagatatttaactatttgtcactcttacaaatgataattaagaatttattactgaacccatattatcatatacgtatgagagcccatatgttatagactgcgagtggcgaatccttaattatcacaccttaaaagtagagcgaggttggacggagcggccgccgcatcgccgatggtaaagggactagctatatttagttcctatttgatcaagtagtccatgtgttggatgcaaaagcctgaacaattgtctatgtcagaaaatttcgattataatgcataaatgaacagacatgtctgaccatactgtttcatcaaacatgtcgagagttgagtagaagtgttgatcggtgttctcttcactgtcacagaatttgcagctgagtagaaaagttaatcaaatcgataggctagatgaaccgcagctgtgttcttggacttaaaaaagctactcaatccgtcctataaaaaacaaactatataaaatatgacacattctaaaactatgaatctagacatatattggactaagtttgttttttatagaatggacggaataggtgaggatatatccatggaatttaaatcaattaatggtacaatgctagattatacagcgttacaaaaccagccctaaaaatcaacatatataaccaaacacagaagaaacatctaaa

SEQ ID NO: 688 - DNA, 7226 bp, Oryza sativa
ttactgtagcaccacattgtcaaatcatggagcaattaggcttaaaagattcgtctcgcaaattagtcacaatctgtgcaattagttaattttttagctactttatgtatgtgttcaaacgttccaggtgggaagtaaacatggcctaaagttattaatttctgttttgtaatgtttatgtaatatatactctcggacctgtttgtttgttttttgttttacttcttctaatatagtcggcagagctcctgccaccttaatctttaaaaaaaagtttgctctatgcaaatagatactccctccgttttaaaatataagaacataggactggatgtgatattttctagtactactaatctggacatgtaaattttacatccagttctagattcttatattttgggacggagggagtagtactcactagtggctcctaccgaaaagtgtgctactttttgatacaagtcctctgaaattgagttccacaatcgtggtaacttctacgaattcagacactccgatcgacacgctgaattttggcatggcttgtggctgtgatcgggagacgggaattatccatatcaccgacttgatcaccagccaccaggaaaacccgcttagaactttggatattgatctcaaattctcaacgccacatgagagtatgagaccatgatgacaagggaggatggtctgccagctagtagtcgcttcctaatcacaatccgaataagtgcactaaacacacaacttgcaacgcttaaacatcaatgaaacccaaatgattccggaaacttcctggcttccggataacaaaaaacaaaccaccagagagacgacttgacccacacgaaagaaaaaaaaagataaagagaaaaaaaaaggcaaagaaaaaaagagagagaagaaaaatgaaattccaagcgtcggcccggcctctcccgcatcgaactctctagaaactcgccacacgggcccttaaaaaggcctttcaccgtgatcttattctacccctccgcgaagtcttcgtctggtcttcccccacccgcatcccccggcctcctcaccgcagccgcaaaagccaagccgccatggcaaccgccgccgcgtcggatctggagagcaaggccaaggcggccttcgtcgacgacgacttcgagctcgccgccgagctctacacgcaggcaatcgaggccagccccgccaccgccgagctctacgccgaccgcgcccaggcccatatcaagctaggcaactacactggtaatccatctctcgcaatctcccccttcctccccttccttcgattagattggtttgccgtgtgtgcggtggtggtggtggtggtctggggagtctgtgtggatgtagatgagatcgtgaggcgtggggtgtgtggttttgtgcgtttttgattcgtggtttgttgcgcctatttgcgggagttacgtcaaaccggtgtttgttttgcgtgttcaagcaattcgtgtgcgtgtgtgtgatcgcgcttcgtgatttggagaaggatctagggtgaaggtcatgggatgggccaaaataagttttattagtgacagttgacttgctgataggaggagatattgagcgcaaggagggcatagctgcattgtggcaggtaccatcctagtcgaaagaagcagcatagttgtttgtgggggatatgaggacgccacaaataccatgtttcgaattcgaaccattccgttcgcgtgccgtactgtgtgatttggatttggtctaggtcgggggttattggactggggaaatctgttcgataggtgagagttgacttgctatactccattttctaaacacttgacacttctgaccagaatcctaggcacaattcagagggcttttaaatgatttacgtcaagcatgaatgatgatggtgcgcagtagtgaattggtagggggtaaattgagtttggaagcgtgagagatatttggagtagttaaaaatcaaaggatgagaaagtattgttcaactgttaaagtatacttgattgaacccactaaccattttgtatggaagtcagacttcattaagtgaaccatacttagttgcttgtttatttctagttattgtactccctctggtttcattttaattgatgttttggacaatgacacggtctacaagatatatatttgatcttatttttctattataatatatataataaataaatgcatgtttacttttattatagtgctttaaaagacaaatctatatatgttgttctagttcctttaaactaaatatttttaaagttattgatggtcaaagttataaaagtttgacatcaatcttgttcaaaatgtcaattaatatagaaccggagggagtatatgacaaagctggtgtgcgctgtagaaaaaattgacaactaatgatccaagatgatgcatgttaatgattgtttaaaatttcccttgttctatatatccaaatttcatctgcaccgcatatcatgcctaatgattgcatatagcaaacaaaaacagatatttaaaatttgatgaaacaatcaaatttaactccttagtgtgctgatcttgcctgttccttttgatttacaaagtaagataaaacaagaaatttataaagatatgtgtgcttgactgtttagctagctatgtaggagagtaggtctactcttattttagagcaatagttagccgtggcagattttgatgggtctacctgttgttattgttcagctattacttactgagaattcccagctaaatttgccaactcaaggaaatgctatactcctgcatgtttgctgattactgttttctgtctgttatcatagtattgaattagtataagagtgctggtgctaaaatgatatctggcgacaacttgctgcttgccagcagaaaaccccttggttctgatctttgtaaaaaaaagtcaggttggactagtgtttgatcattccccttggttctgatctttgtaaaaatttgtcaggttgcacatatctttgacaattctgtccgaaatgttgcaaaattttattgccaaacaaggcattaatcatccttatcagtaatagctgtaagttgttttgtagcctgtagccctaaattatcagcactgctatatcttaaaatacctcagtataagggtgctggtgctaaaatgacttagctgcatgtttattttgttttgtttgcaaagacattatcatgctgtttcatattaaagcaacaaattgcactttgtcttgcagaggctgtagctgatgctaacaaggccattgaacttgacccatcaatgcacaaggcttatcttcgtaaagggtcagtcttgactaaattatttaatgttatgaaaaaagactaggcacattaatttattatgatggctgataagcaaatgatctttagcgctgcatgtatacgactggaggagtatcaaactgcaaaagcagctcttgaattgggttactcgttcgcatctggtgactcaaggtttactcgcctaatgaaggagtgtgatgagcgcattgctggtaagctgtccctttgagtccattgcttggttaatacatttgcagtattgtgttatatttttacctggggcataccattacgtgagactaccatattatagtatgcattttcacacatatttgtcctctgggatgaatatccacagcagtcctgtaagttgaagtgaaatgtatgcacgagacatctttctcatactttgatgctgtgcattttcttttcagaggagcttagtgaagtccctgttaagaaggctgaagatggagcagctgccccctctgttgcttcttttgttgaggaaaaggatgatgctgcaaacatggataatacaccaccaatggtagaagtgaagccaaaatacaggtaaccagttcatgaatcctttaacactgtgcttcttttcccaatacagttctttagtcaagtatcaagttattctgaattgaggggtccactttatattttggaaaccacttgacagaatccacatgaatatatgggataatgtcccacaccctttctcagacactaaaccaagtgcttcttagggctggattttaaccccaatgatttggtactgacattttctggaaatgcacctggtgttgcaggcacgacttctacaacagtgctacagaagttgtattgacaatttttgcaaagggtgttcctgctgagaatgttgttgttgattttggtgaacaaatggtgtgtaccttaacaataaattgttgcaaatcatctatatttactaatttactgtgctcactaattaagccttccattttagttaagtgtgtcgattgaagtccctggagaggagccgtaccattttcagcctcgtctgttttctaaggtatgcaatccctgcaataccaggattatttctcttcttaatgcattggaaatggaaacagtgcatattgttatgacctgaatatgtttgtgcatttcctctaatttgtaaggtatttacctgaaatatgcttccaaacctaataaagctgggtgtactgctttgcctattttctttggttgcattgctgttgatccatacatacagttctttttgaaaaccaatactcagcatctgtttattatgatttctatgcacagtaccaatcatctcacctcttaacttttgctaatctcttgactatcagatcatccctgagaaaagcagataccaagtgctatccacgaaggttgaaataagactggctaaagctgaacagattacatggacctcacttgattatgataaaaaaccaaaggctgttccacaaaagataatccctccaggtaacaaactaagcaaaactattgcagttgatttccagaaaactgttgaacctactattgtgttgcttcttgtggttagttgaaagttgcactgttcaatcttattataagaggttccccttaaatatctgtactttgctgggtataattatttactgctttatgttagtaactggtgagctgatttatagccatggaaagaaatgacttcttttccattcatgtggtagttatcaataaggtctgccgttctatgcacttgctgatcgctggctcacatgtcaggctagtcatttccattttgctggttcctgtgcttgttgaacacattaatgtcacaaaaaattggtaatcgaatttaaatgaaaatggaagagggttctgagtgttatcttgctaataccttgttgaggctgatggtttactgccagatcggcttaagcatgaactgtacatgactggaatacaaccaagatcaagtctggcttttttttggggttcaattgttattctttccccatctctcctacagttttactgatagcccttcttttatcagctgaatcggcccagaggccatcatatccttcctcaaaatccaagaaagactgggataaactggaagctgaagttaaaaaggaggttagtatgatgcacatggttcaacgtttcactgcctgtggacattccttgaactctggtaattattgaattgccatgactttgaatttccaacaggagaaggaggagaagcttgaaggcgatgctgcattgaacaaatttttccgtgacatctacagtgatgctgatgaagacatgcgacgagcaatgatgaaatcttttgtatgtctttctttagcacaattgatgaaatgtttataactagtgaccttgctgacagaagtgcgtttagtaagtttgaactttgtatacttatacatcaacgatgtgcttgtttgcaggttgaatctaacggtactgttctgtcgaccaattggaaagatgttggctcgaagaaggtagagggaagcccacctgatgggatggagcttaagaaatgggagtactaagatctcggttcgtgcatgctgtaaattcgttatcgtcgtgagtcatcacttggctggagatttcgcgcatcattgtcaagttggattttgtgtgatgctcttcgttgcgtttccatattgtaagctctctgtgtgacaggctagcttgtctaagactttatcctagttttggaagatacatctggacacaagaatacgttatctgaatctttgctccgaagtgcagaatgctctgtcgttttactaatattgcaaagtagtgctgtatctcctatcatccctgaaatgcgatgttcgtcttaattgtagcctctacaatgctcacagttagtttgttgactatctgtttactctcccatctgaaagtctagagtattttttttatgtccaatataaaaaaaaactcatcttattgtaacatagacaaagacttagattaaaaaacgtacatatgcatacaacaaaaataaaataacttaacacaaatatatgcaaccaatgagtgttagaataattgtttgagtttcgatcgaaaaataattgctcagtttccatcgaaaaataatcaattccgcaggctaggctgtgtttagtttcacgccaaaattggtttagtttcacgctaaaattggaagtttgaagaaaaaagttagaaatttatgtgtgtaggaaagttttaatgtgatgaaaaagttaaaagtttgaagaaaaaattagaaacaagcacctaatgtatcttacgtacagcatgcaggttcttcagtactctttcctcgattgttcccctttaataatctatgctccgctagccatatttccctctcccctgttctctctccgatcctgcagcactggtggttggagacccgtgcattccccttgtatgtatgcaactgattcaaaaaagatgtgctcgtttaatgtatttgttgatatcatcggatatttgtagacgtggatcagtagatggcaactagcgaagcacaaagaagataatagcttaatgtctactatcttcgttctaaaaatataatagatatgtcatatctatgtaagtgcatggacaaaatcttttatattttagaacagagatagtaaatgcttcatgagaaatggtgacgagtaatgaatccacttgataattttggagtatatattctttactgcaattcttgcagacttgtaaggtgtgcaatttatacgtcttttgctttgcaaacatttgttccgatgtttagagtgcaaagatacattgaattcatttgattttgttcagaaataagagatcaagaagtttctgtatttttt

SEQ ID NO: 689 - DNA, 16293 bp, Oryza sativa
attgttatgatatgataaaatataaatagtactccactttatggatgacttatgtttttaatttttttattttttttaaataaaacagacaattaaagttggatacgaaaaattatggctgcacttgaaataagacggagggagtatctgagatagataaaaatgataataaaaataagtgaacataaaacgagacgagctattaatgtacactagttgagtattagtcattacaaatattaaaaaatagatttattagatattttggagtattttttatataaaaatgttttcgatagtaaaaagaacttgctaacaaaagtaaggtaaaatctagtactatcctaatagggacgaacggggccttaaaaacatggattgagatcaaatgcagttacaattaggactgcaagttaatgactgcattagatctcatctattcatttttttcaacgaagggtgtagattaagtgttacagtgccactggctatagtagatgtctgatttttttttccataaacagtgcttaaataatctcaaccgttggatgcagtttcaatgaaccccgcgtcacactggggactgcgcaggaacctaatcctaaaaacatccagaagtgagcatcaggcagatgcgacgtcattcttccccgcgtcgtctgctccacccacgcggactggtatcctatcatgattcagacccccatccgtaccgaaaactacacgttggcccaacgatccgtttcaccgcccaaacaccagccaccggcgcgtgccaatcaggagtgcagaaccagcctccctatgcacgcgaggacctcgtgctagtgtcgcgtcacactgtctgctgttcgtcgcgctctaatataatctgccaatggattttcagattacggggacttgcagcgtggctcgcgccagactgccagagctgcctgttacgtggccgacgaccaccggtagtggtatgatttaaggcgaagcacgttgccttcgaattagttaatcccactcccacttccatatcggcgtaacgctcctgtaaactaatccacttctacttccgcttccgctcgcggttccagatctctccctgcacatctgcatccactcacactcgagggagagggagagggggagagatgagggagaggggagagatgagggaggcgaaggcgcctctgatcgcggaggcggcggagcacatatcccattcccacggctccgggtcgtccggcaccggcagccacaccagcggcggcggcggcgggtggaggggctcgaggcagtaccagcgccgctcggacgccctcgcctacggcaaccggtaccagaaggcggccgccctcgtcgacctcgtcggttccctcctcctctgcctccctcttgtgtcgttcgtactcgttgttaggcgaagcgcgacgctgctttgctgtaggctgctcctgtgttgggaattgcggtgatcgtggtcgtgggtttgtcggggtgggtggtgtgcgctggcgagcgtggatgtaggggcggtgtttgatggattgtctgcccgagctcggcatgtttacgtggtgcgggagcttggcgtggtcgaggtagttgtttgcagcttgtgctctgttcggagccgtgagatagggccaaggcgccactcggcataggttgcttggcgataacctgaactttgcgcacatttacgtgccaatgccagaattaagcgtggtttcagttgtgctgttttatgacagaaaacgtactaacagtgtttaagttgactttcactatttccgatgttgcatatagctgttaacttttgtttcgatttttgcaagcgctatctttgaattatgttaaaaatgtaccatctaaaaattttatcatgtgcaaattgacgttttactataactgtcgtgtcatttgcatgtgaattctcactcaatacccagtaccataacaagaatatatgttatccgtcgacactcttagctaacggacttagcgcagtaaatcccattttcttttgcaacacaactagggtatctttaatgatgcaaaacaaggtctacatttgtgttttgcgatcagggttcactctatcggttcagggttttctatcgggggtcaccgaaatcctgaaatttcggtccaaaatttccgaaattttaaacaaaatttagttgaatttgaacaaatattatccaaattcatgaaaaaattgaaaaattcaaaaatttcggccgaattaatatcgtatcgggggtcacttggaaatttcggtccgaaatttccaaccctgtttgcgatattgttgtcattttctgatgagttcacgtcctctaccataatatcactaccattacaggcactgacgtgtgggacaataggaggataggacccacatactagtgattgtaatggtactgtaatggtagtgactttatggtagaggatcctcacccttttctgatatactgggaattaattgcaatggtttgacaggcagaagatggtgtgggtatccctgaggatgtcttgaatgacacaaggtttgagagggctatgagattctattttgtgtatctccggttggattggctgtggtcacttaacctatttgctttgattcttttgaattttctcgaggttagttatgaaaatggaacccatctattacattgtacaggaaagcggctaaaatcctgcaagtcccattatggtcatgttttgagttgtttcttttgcatttcagaagcctctctggtgccggggatattctcaacatgcttgtgatcaaagggatctttactttctggggcagttgccatacttgagcaaaactgaatctctcatatatgaggtaaggctttgtctataagagtggtgtttctatgttctctgaaaactttaattgcagaaaacttcaaaaactacagtcggtagtagattaatgagcagttggaaagtcaggtcaataatttgcttttgtaattacactcaactttgttggtgaccattaaagcaacctttggtgactatactaatcacagcttctcaatattattgttgagctttgagatgtattgcatagttagttgggccagagcatggtcatttgagtacattaaaatctgaattccatcattctagattttgtatggttatttgttgtataacaggataatgcacatgctttttttaacgaacatgtaatggtctgtattgaggactgaaaacattaatctgatatatttgacgcaaacttgccgttcttttcaatttcaggggctcacacttgttattcttgtaatggatatcttctatccactgtcctatgaaggtttaaacctattctggaagaacacaataaataaactgaaggtatggcatctgtttataaaatagatatatatgagtataaatagcaagaatagcatacatgtttgtttttctaagatccattgatgtggatagcatacaagtataaactgaagttaaataaaactatgtaactgcaaaaaataatggatgatgtggattacatctggccctactgagataaaatctaaaatttgaaggcatatgtgagtgaacattcacatatttaactactttttgtaaattaactatgtgcttttacgtatgagggatggctattttttttgttagatttgactaggcccttccaatttttgatacagttacattcaagctaaataaacttccttgttttaactagactacccattgtgctaactctgccccttttaattcctacgctgcaaacagactgtaatcctgttgttttactttaattaagcatatgtttctctctaaaaatgtgtctttcttactgcttcacaaactgtggtctatccatatttctgctttgtcttgtaggttcttcttctcttcatcttagcatgtgacatactggtgtttgcatttagtccccaacctttcagagtagctccttacatccgtgttgcgtttctaataatgaatatcaggtttgcagtgttttatctactctagactacagtttctgctgctagctttctgaattcagtatgaaggttcgttactgaatcaatctcaaagaaaactagctgggtggcccgcgcaattgcgcggctagcacccatacaaaattatctattttttacatattattttacttaaattttgttaaatagctaactcattgtcttaggactttgaaagaccgaactttatcatccaagtgtttctaattttatattttttagaagtcacgctagtcgctacccctttatttgttgccgatttaccaccgtttctattcatcctcctcatttgtcatcgttgtgttctagatggacttttttttttgaaaattccatatttttcaccctgatatttttttatttataaattgttttcctacttgaactcttataattatttttctatgtttggaatttattttatttgttacttcggattttaattaatctcgtcatgtgttcttgatggtctcttctttcaattgtctttattttttattaagaattttaattatttataattgtattcctagttgaactcttattttcctttttataatttctgaatttattttattttttatttagattttaattaatcttgttttgtgttctatatggactattctttcgatgttactttttttttattttaaattttagttgtttcaaaattgtattaatatttgaactctattttatttttctaataatttcttaatttattttattttttattccaaattttaattaatcgtgtattgggttcttatatggactctttttctaatattgcttatttttaattccaaatttcagttattttaaaattgtattcctacttggactcttctttctttttctccgattaatgtggtaatttctagcctccacaacgaacgtggtgcctcctttcaatgctatcttaataatataatagatagatagatgacctagatttctgcaggataatcatactgcatagcaaagagaagacccataaataattataattagcgttcacatagacacataggcaaacacttacctgtcccatttaggaaaagatacatgtcaatgttagttaagatatatgttatttttttgattgtttgacagatgtattaactgttccttttgtgacagggaactgcgaatgtgtgctgttacactggttggtatggttgggacataccttaatgttttggtaagactttattaattatgcaaaattactatacttctagcactgtaggacatacaatgattatattccttcagaataagccattagaagtttttgtctatgcttgagagtcacggggacctttcgttactctcttcatctgatggtttgtggtgcatgaattgaaattgtggacaccaacttataaatagtgtgggaccattgtagatttaggtaggctgggaaggagggggagattgttctcttctgacatcctgttcattcttgagttctgccctttctgctttccaatataaaagtcaattttgaactacattttacggcctagttattggaatactaattacaaagatgtttacctcaatttacttttccatgagtttcttatggttctgcatgttcatatttatgtctgcattagtgcacattatgtgttcagttttgatgcatatctttttggtcgcttgcattatgtaggccctttcactattgttcctcttattcgcaagctggctagcttatgtaacatttgaggatacaccacaaggaaagactgttttctcgtcatatggtaccacgttatatcagatgtttattctcttcaccacctccaataatcctgatgtatgggttcctgcttataagtaagaaggcatcactattactgaagtgtttatgatagttcctgcatatgacatgcatacaaattaaccttatacatctttgagcaggagctctcgttggtcctcactattttttattgtctacgtacttttgggagtttacttcctaacaaatttaattcttgctgtcatttatgatagctttaaggagcaggtgggttcctcacctctgtcctaattcacatgatgatcgctatttttttttgttatgaattctgagttattattattattatgcttcacatactgctaacatggcatattttttgtgatctagctagcaaagcaagtttctcaggcagactgtacaaggaaaagtatactagagaaggcatttggtatcattgatgctactgtaagtgttttccattttatgttgtcctgcaaactagtgcaccacaatttggcaacgtattttagtgcaagtattttttatgttttcctgaaaactgatgcacctcagcagtacttcagtactttagtataactttgatgttcaggttatccttcatcagagtatagtctgatcacttcggttctcagttgggattattttaaatgttcaaattatcaaataagcagcactagctcaccttcgcaaggcgtgatgagattaatattatagatcttagattagggaaaacgagttagcaagaaaatcaaggtcctgctgctattgagatgatatagacgtgtttagttgtttggctgtgttattcatgagtattattaatattggctgctgatatccctttcttccctatctgtggacatcagggtcagggttatctcaacaaagaacagtgcctatcattactagatgagctcaacaaatacaggtaaccaaaatgccctcttacattacactccttcaaatctccttattacattatagagtgatttagtccttgagggggtaccataccttttagtattaaatttgtgctaccttcaggtacctcaacttaaatttgtgctaccttcaagtacctcaacacaagggaggtaccaaaaatttacactgaaaatacagtacctcccggtacatcctcaaggaatgtaaacactgcattttatgggtagtaagtttatttttacaatcttttttgtggagatgttcctccatttcctgaaggaatcttaagtcagtcaaaatcaatatctgtcatgcatgaaaccaatcttcaaaattaaatccatagtaggtaaagtggttagcaaacgtgctgaaggagatcccacccaacccagatgccaacaaaattaactccatgtccatgccaagggtataagaagtctctaattgccccacttccgtgcaagcttgatgctatctgtgaaagtggccgatccattaaggaaggtctttttttttttatccttacactgaaaactgaaaagggtaactaactcatgcaaatggtaagcaaaagaaaaaccctttaaacaatgacgtgactgcctttggaagatgggcatccttactggtctgtagagccaaatatccatttttatgatgatgcactggtacttgaatactcattagatgacatgccatctcgaagagaacacaggtcagaatgggtgtctgctttcgttattacaatctcaatgctattccaaattacattatttcagttttgctccattattttgacattcataacatatatcagaaatcagcagaattaattgtgtagaaaatgtcaaattaatatctagaagcctagaacatggttcttacaattgcagcatatcatgctgtccacttttcggttttgcatttattgattttattgaaccaacaacttaatggtttgtaagtgtaagttagttttgcttattatcataacatggtagggagacatcccttcccctccaaagttgatgacgacagatgttatccttgcattttaccaaattcctgctagctcctggatcagttatgggtctcacagaatggtgcctccttttgtagatcgttacctaaaacctcaagggaagattttgaattaatttttgccgagcttgatcagagtggtgattttaaggtacgtgctcctactatcttcagtaggcatgtcttagttttaataattcttcaagcacgttcaccctccatcctctccccctaagcccccccccccccccccccaaaaaaaaaagtacttgtaagaatgtttataacaaaaacacttaaggctgtgtttagtggtggttggaaaccttttccctccgcacggaaaatgaggtagcacattagcacatgattaattaagaattagctaaaaacttaaaaatggattaatatgatttttaagcaacttttctatagactttttttttggtgcaaaaaagcaccattcagtagttcgggaagcatgctcatgggaaacgagggagtagaggttgggaaacttgagttctgaacgcagcctaagaagctggtactaaggccatccccaacccagaaactatcaaatagtttccgtacttgctatgtcatatagacactatgtatagaaactacaattcaatggatggtgtcttcaaattaaattctcatccaatcacctctcttctctctccttttatctacctatccccttgttttcattcttggttcttgtgtagagatggtttcttgcatgagaaatggtttattcatctttttacctctctcctctttagctctcttgccacatcagatttttgcttatgtggcaatgcattaaatgctatggagactagatggcatggttggggatggcctaattatcacctgtaccattttctgaaagtatacatgcctcagtgaggtcttaattctgatgttaatttttatcctcatttgatggtatggcatgttagtgtttttttatctcacttatttatccttgtccaggttacctctgaagaatttgctacactgtgcaataccattgcaataaaattccagaaagaaccacctgtaagttgtacttattttgatgttcataattttctactctttctttatcatggaaaattgaaagctatactccttcaacctaaaacaaataccctctatttgacttgccacaaaccccaatgcaaaatcttggctgttattttattgttacttttagcaaaagtttaaggaaatgttttgtgacattatgtttttgcccttcccttgtttacacaatctgaatacttcaattgcaaatgtatcaatgaccaaatattgttaagagtgtcaaggatataaatacgtcgatgttgcactgtttgcagcaacattctaccttgtttgacctaatgttgtacatatttttgcagccatcctatctcgagaagtatccatctttctatcattcagcactgtgtgaatggttgaaatcttttgtgcggagcccactgtttgagtatattgttatttttgttcttctgatgaatctagtcgctgtcattattgaaacaacggtatggcagtttttttttcttctaatttgtgttttatttttattcaacttggaatcatactttatattgttagcagtattctatttccatatctgctagacttaaatttatactcttagcacttctcagtatttgttttctattttttgtttactatcaactactgagtacatggcagcgtaatcagcctactatattagctttgcaatagtttgttgactacaaaattattcaatctaagttatctatgctaatataaaagatggtaatggtgagtctaccaccaccaacacctgaccacccaactaccatgcgggacctacgaacagtgagacaaaactttgcttgtttcccagcccccacatgctatagaccccagcgcaaggaaaatatgacaatagaatattatggattttttcatctttgtgaaatgacaacaaaattagcacaatgataatatattagacaattagaaacaaattttgttgcaacatacgggcattatgctagtgtttaacaacgttttgtagacaaggaagcatggcttcattttagaaccaagaattgaaataattaaattcacaaacggatgtgaaaactgtatgtaatccctgggatatgatttttgcagctggatatagaaaacagctcctcgcagaaagtgtggcaagaagttgagtttgtctttggtaagcatattttggtgaactttgtttcaacaatgctctgtaagcagtaactatctcctataaaatctccctggcatattatcttgagtttccaacttaaagttgacacttgaagaataattgccatttctcttaggtttgatgattatgtagccgaacttcagaatttgtattctactgtagtagtctgtcgttcttaaattttgttgaaagggtctactgtgttttcctgatttaggttgctgcagtactgtggggtcgatacagaatcgcatatgattgcaatggtcataagtttattccctctatttagaaatgtatattgtatcagaaatcatgtaatcaaacttcttacactgttttcacatccgtttgtgaatttaattatttcaattcttggctgtgtacatctgtttggatgtagaggccggtttaatccatcatcttaaaaaaaagttcttacactgaggtttgacacaattaaattcgtagtttattgaacttcacgagtatattcataagaaagtacccattctgtcctttttttataaggtgcatatggtgcacgatgttatggagtgctggcattgtaatgtaataatatgttcatatccttgtcttcacgtatgtaagtatgtcaatacaaatctataatgttgcaggatggatttacgttatagagatggcactcaaaatattttcattaggatttggtgcctactggatggaaggtcaaaacaagtttgattttgtgcttacttggactatatgtaagttaatcctactaatttattttgagacgattttagtaacagttctgtgtagttgcttattttcttccattgctacttttcaccttgcattttaaagaaaaatccatattaccaagaagtatttctggttcaaaagaagagttgcatttcacaacaaaactgaattagaaaaatattgtatgggtgagaggttatattttaagaatactatatttaagaataggtgtgtgcattcactgttactgaaaaactatggagtataattgattttcccttggtcatgattggatgatgataaactctcaacttcaaaaccatgtttcctttccaagaaaataacactggtcatatcaaatgcgttatgttcttcaaatttagcttttgcctaacctggacaaccaaatattcttgttccatgcagtttccgctgaaaataagtaaataactagtactgtatattcaactgccttaattcatatctgaaaaggagtatcgttggaagagaactttttttttttttttgcatatagtaatcttcttgccaattactttgtggcatctgacttctcatttcattgtagttattggagagactctaacatttgccttcccatcgaagctttcttttctttcaaatggagaatggtaatttcactgttttggatgctttactttccaaaatttagtcaatccatcatatgtacatcaagatacaaacatcaatccttttagtatgcatcatgctctttaattgctgaaactaaattaataacctctttcctaatatgatggtgatttaagaactatgtacttaagttaccatgtgaataaaaaataaactctaacctgaaatatcatgttgagctatatgggttgttgaatcttaataattgccctgaactttactttgaatcatcactttaacattaagtcacttaaacaggttctgagtggataacagttctgacagaattctctgttaactatttatcgttgtttactgccttgctctaataatcctgattttcctctgaattttgcctggcaggattcggtaccttcttcttggaaggatgttacgcttgacaagaattctgttgcaagttcggcgtttcagagcatttgttgcaacattctttactctgatgtctagcttgatgccatatttggggattgtattctgcaccctttgcatttactgctcccttggtttgcaggttggaataaactaatggttttccatatcaagtttaatgtcctaaatagttcatccaagagcttaaagtttttggggaaacataaatatttgtgctcattcttcagtgcttcccctcacatgcagtcttgacaaaattgctggtccagtttgtttactggtcacagcaatctgttacttacactagtgattggagttccttttctttgttcttagattgtccagttactaattactattgttatttgtacttttccttgtctaaacagcacgtcattgctgtctatatatcataaacacttttcacacctcaattattgtcattagatgacagtctcgagtcttctgtttgcagatatttgggggcattgtgtatgcaggaaatccaacactagaagaaaccgatctcttcagtaacgagtaccctttttgttcttatttcaccgttttgatttctaaaaagttttagaagtgtttttgttccagtaacttctatactaaaatctcaccttctatttatttttgacaaaattctcactcttttaccttggcatgtgcagctatcttctttttaacttcaatgactatccaagtggtatggtaactctgttcaatttgttagtgatgggcaattggcaagcttggatggaggtaagaacatggcagccatgcatgtgctcaatcttgcttgttctatacactgaatattttatattttgaggggtgagagggtggttttgtatgcactgatttactttactatttttcaccttgataagttgactcatgtagagcctgcccattttactgtatccaaatgaatgcttaagatctgtgaaattaagtttaaaagtttaccctatagatgttaaaaagtatgcaactagaaaaaagatagttaagagtaataaatcagaaggaaaaggataatattttctctcttatatttatattcttataaatttagctcattgatctggatcatctgcctacaataatttaagtaaaatctgccaaaatgtcttgagtgacttattttatttgctaaccttcgtttccttatctttgttcttttgaatgaagctccttttttctttctttcagagctacaggcaattgactggaagttattggagcctgatttattttgtcagcttttacctcatttcagtattactgctgcttaatctggtaagatattaaatagttatttcagtttttgttcatgcagtgacattcatggcatttctaatattgcatgatactgttgtttttattatttatgtgcatgcagttagaaagttgttgacattcctattatcctacttatattttttagatgattatttgttgattaaataaattgtgtcctcccttttttttccctcagattgtagcatttgtgttggaggcattttttgctgagatggaactggagaaagatggcgaagctgatatccaggttagaacaatatttgtgccgacaacaaattctctttacttgtatttagaaaactgctgaaaagccagtaattaactggttacaggtagcctagttgtcctttgacaacatcgattcacactacactattatcgcacaattatttgaataagtacgaatcgaaaccttgccagtgttgccttaggtgagtttgagcagctgagggatggttgaggctaacgtttggtttgtagttgcactttctgagccagcttgccagttgccatttggttgtgcgctcatgtcatgtgtcatctccaaattgtggctaagtgtgggaaccaatcaaacgactcatgaatcccacttctcttgagcttttgattggaagtagtactatatctgtttggttgtttctaactttctgttatgtcaaatcaagaaagaatttggcgttactagcttcgcctacacaaactgtggattataaagtataaaataactttagtttgtataaacttaagcagttacctggattgaaatagctagtagttttttgagggcatctgttcatccatgcaggatcctactttggaaggaagaaacaggcggcgatctgtgcggtaataaaagaaaacgattagttgttatggcatgataacatatttctgcaacattaatttaccattgatgttgtgcagtgtgaggacaaaggggaccatggttgatattcttcttcaccatatgttgagcaatgaacttgatggatctcaaaaccgtgaccaatagcttatcttcatggtactaccctgtttttctctccaatggcaactcccgtaaaattagatgaccgaatacatgatttgaaaatgctaccagccatttctaatatttctgatgcctataccatgtcactgtgtgctaatgtatttttagttttttactctagcataggtaatcggtattactgtattagatcagccgatcagccacatcatttgcattcttgcgttctatgccttccatttaaatcaagggtgtagctatatttatggtgccatatttttcatcaaaaaatagtcggcatgtatttacattgtaagtccctaaattacatatgtaattttagtgtatttacaatgtaagtctcaaaattacatatgtaagtactaaaattacatatgtaaattcaaaaattacatactaattacatatgtaagtggggtgtaaatgaggtgtaactactgtgtaagtggctgaaaaaaatcgactatagcatatggcgccatatttctagcaactccgtaaatcaattgcttcttttaccatgattaatatttttaactcaggtcttttttttttttaaaaaaaaggccctgcaggaagaaagcaagaacagaaaaaaaaaaggaaatgattagagccggttctcgagcatggagttatgttttgttatgtcaggtactcaggtgcaaaggaatcttggtgaggtgatggaaaggactctgcttgtcatactttagttgtcaaggagaacagcagatgtgttctctttctgctccaaaggagaccttaaaggagcttttttttaaaagtaaatattgtaggagattctcctacagtgcatatatatttatacaaaggagctctttttgtataggattaaaatgtgctaatggttctggtgattttcttttttgaaaactttacaggttattatagccataatactccacatttccttattgttatactatatacacgttataagttttgatattttctctcatccttcaataggtatatacctccccatatttgagatataccttttcataaaagaaggtactagaattaatcttacaggttggaatatgattggaaacttatctttataaatatttgtgatttttcttacatttttttagacatagatatttgtgcttattaagaggaagaatatatataatcgcaaaaaaaaaggtagagtatacatactttcaccataagaagtatatacctccgaactaacactgtaagctatatatacctctctatacctcacaacaattagaaaactctgccagttctaatcataaacttagtttttctaatcagttaatccggtttaattttttacctctcaaaattataagggggtatatacctatccaagaataagagaacaccttgtaaattttctcatgtttggtcgtgttgcacaggctccaagataagagttcaaactttgaatcctttattaaggtcttgtttagtcctcaactttttcttcaaacttctaacttttttatcacatcaaaattttcctacacatataaacttccaacttttttcttcaaatttcaattttagtcaaacttttaattttggtgaggctgtatttagttccacgccaaaattggaagtttgaagaaattggaacgatgtggcggaaaagttggaagtttgcatgtgcagaaaagttcgatatgacggaaaagttggaaggttcaagaaaaaagttgaaatctaaacaaggcctaagatgcattgaaattgtacaactggcgtgagccaaaaggaagaacagtacagtaaaattcaaacgactcagatggccaaaatgactcgagtcatctggtgggcgactattgcctctcaaagatgacactcaagcacaaacccaatgcagagagcaatgaagcaactccagtcagaacactcagaacaggagcagttccttcagtctctgatgttggaattaatgaatgggccttag

SEQ ID NO: 690 - DNA, 19451 bp, Oryza sativa
gcgcacgagccctggaccttcgcgtgcttccggaccgtgacaatcaccgcgcgggctgatacgaaatctccaggtacgcccactcgagtacacgtatacattgtttgttccgtttcgtgatgttttgggccggcccaagaaaggccagggtttttcccagcccaataatgataaatcccgtgacgtagtatacgcctctgtcgcccaacctttattacgaaatttcacgcgtaaagtgacgcgatcaggcgaccaggtacaattaaccataacctaatttggataagccgacatggatcggtaaaacttattctggacggactggattggttggaagaagaaaaatagtacgcgtcgtaccgtcgtttctaccgatgtgcgcttctctcgtggagtagtgcgctcaacccaaatcacaacgcggatgtgcagaaacttagcagccaagtacgtactactacgcggtctcatactctctcaaagaaaaaaaaaaggacactgttcagaatgcgtaacaaaaatccacacgcacatactacgtagtaacacgtagaataatccagctgagagttcttgagaccatattttctccagcgacgtgagactgctagtctgctactgctcagtcatcatcgtttcagttagaacgaattgaaggaccgttatttttctcgcgtcggatgggttacccccgaattttccaaaaccaagtctgaatcgaataggtctccaccgtgggtagtcctaatcctctgcggtcactggaaggtgggcccgatttagcgaggaccccacatgttggtgagctgccactgtgccactgggcggcactcgctgatgtccacatcagtgaccaataagcagcatcagctaccggagaagaatggtccaacaaggagactgaggaatggtcaacacattcggcaagcaacatgtttcgcgctgcctgcctgaccaatccgttatcttcttccccgatgcatgcatcatcatttcctcgccttcttcgtctcgcccaaatctgctgcgtgatcgatcgcttccactgcagcatgcatccgtttcgtgctcctgcaactgccatgatctgtttagccatgctactgctgatcactctcccaatagctagctccaccgttgatgccataaacacgaccaacaccacatcgccgttctgcgagccggcgaggtgcgggaaccttaccatcggctatccattctggctcgccggcaagcatccgccggagtgtggctaccgaacttttcaggtcacgtgcgaccatagaaatgcttccctcaagaacggcatctggacgtaccaaatccagcgcatcttctaccacaacagctccttcatggtcaccaacgagcagctgacggacggccagtgcgtcatcgagagttttgtcaacgcctcctccgacctcggcctcacgcagttcaagattagccccataaaccgggagctcgtcttcctctacaactgcagccagagtcgacggcagcttccaatctcttgggcgcccgtgagttgtgcgaaaaatgaatcgtccaactcgtatgcctggcttgcggggaagtacaagcctgatgacgatttcagacaactgccggggaactgcacggtgtcaatgatcccggtgctggggtacgacggtgcggtggcgaagaactacgagcggctcatcaagggtggatttcttctcgactacacggccgcggcggggccggacgattgcgaagattgctcgaggagcggcggctggtgtcgggtgaatgtcacctacgatgggctagagtgccaatgccccgaaggcctgacgtcctccggattcacgtgtggtaagttcgtttccgcttacgatcccatttcttccccgttccgttttttttttcatcagcattcccttcgtttctgttttgcggtgatttcgattcgctagccctaacgagatggaatgatagatgatcatatcgacaaatcgtacccttgttgggagaaaaatggttgttcacgggcatgatttaccaacccaattagctgaccatctacagttacataggctatccaaaacgaacaaaacatcgacttggccagcgaatcatgttagaaaacgatatgcaaataaacgataaaaaataatatatcaatcacagaagacacgagatttaacgtggaaaacccttcactatatcggggtgagaaaaaaaccacggacgccagccaacaaaatatcttcactatatcggggtgaggttacagcgctgcacggcagcttacaagaggtatatatatgaagtggaaccctaaaagggatgacgattcgtaccgcggggactccgcccccgcacccctaggcgtccccaggtgcacaacccaatgggtcagtttggtctttattaagtgcaaatgaatttggatcacaactcaacaaatgatgtacagagagaaagaaagagcatcgtttttcacgcacaagtttcccgaactattagacgttgtgttttttaaaaaaagctttatatagaaaagttgttttaaaaaacatattaatagatttttcaagtttaaaataagcatatttaattaattatgtattaatagtttacctcgtagttttacttatcttctcatttttctctatctctcttctcaatcacagttggtacacttagctcaatcaatattatcggtggtgatgcattggttagtgttcaggaaaagctatccttgttctcggaacctaactctgttttctgaataagtgaataataaccacgtgcaattctacagtcaatggggaagcattattatgaattaaatttaaaaatatactatttatttaatttatttttaaaaatattcgggatgtaaattttattgtagaaatataccatcgatctcgctctaccgttgagcgaaaatgacgcagaggtgacgttgaggacggtatcgcgcggagaaagcgtgagaccccgcggactcgtgctgctagggcgcgagaccgtgcggtctcgcgcggtgacggcgcaagagcgcggtaaggacgagcggtctcgctcaagcagagagcgacaccatcctaaactacattaggttagtgactaatgacctaattaattatttaactaataataattagcgattaattaataattaattaaccattaatcatggtaattaatcactaattaaccattttgaaatcttgtatcgctgattggttaagcgagaccggacggtctcgctcttccatttcgcgagaccgcgcggtctcgctttttcccagcgcgataccgcctatgatgtcacgtccacgtcactttcgcgcaacggttgtgcgagatcgacggtatatttttgtaaaaagttttgaattccgaatatttctaaaaataaaatgaatgaacagtatatttctaaatttaattcgcattattatagtgttcacctttatgtcatccatcaacgtggtagaactcaatttgagatgctaaaattctggagggacgttagagtactcattagccaaatgattttatcagctatactttttttatcgagaaaaaatgtcagtaggactgatggcattttttaccattgagggagttcatgtggcaacgttgagtcaatgaccaagattgctattcttgtctaacactcctaggggttaagtagcctaaatcattgacacactttagcccataaaaattaactatcaccatggtttctatatataccagcaccaaacctttggttaggacaagaataaatcttgacacaaaaatgactacaaattaaatatgtctcaatattttatttagttgaagtattgttaacattttataatacacacatccataaatatggtatagcttagtttggtgctaaaattctggagtgtaatatattcatcggataggtctaatgcatgcacagcagtgtgtgtcagttgtcaccaacacaaatatattgctttcggtccaacgagcaatgtttcggcctataaagaaatgtacatgaaaagtttatacatatttttttattcatatagaactttataaatggaaaatttttgcatagaaacattttggtacctgatttttttgcaaatgaatttgaaaagaacttaacatgtgtctatagtccacatataaagaacatcactatggttgttttattagtgccccgaacttcatgtggttgggcgcgggctaaagtaagaatattatcacacatgtggttctatattttattttacatatcattaacattttataatatgtatccgaccaatttaattttaccaaccaataatatccctacaaactagacggactacaaattaacacaatcaaaatgttttctctatccaacaattatatataaaaactccacctttttcagcagttgttcaaatcataagatgtttagtaagtattttacaagtacaataatacttcaaaaagtgctttcacactagtatattaattttgtaccgccttcgctccataataagtgcatttttcagggttttaatctcccgctaaacggccgctatttcccgctatagctgtttgagaagggttctagctatttgctctcatgtacaatttagccgttatagctccatttagcccgctatagctatttgagaagttaaccgctaaataccttagcccgctatttaaaacattgatttttagaattcaaacgtctcataaaatagtgttctagattatttgttgtcttatcaatcacatcttgttcggatttcttcctattttaaccccaaacaccctcaactcccaatcactcccctatttaggttgttttcgttgttgtgtgttgggaacacatttccagcatacggaaaatggtgcggtccattagcacgtgattaattaagtattaactagttatttttttcaaaaatagaacaatatgatttaagcaacttttttttaaaaaaacacgccatttatcagtttgaaaagcatacatgtggaacacgaaggagttgagttgggaaatttggggaaagaactcagccttaatgatgaacataaaggtcaattttcttccagatattttgatttctaaatgctagaaatgcacttattatggtacgcatatgtagcagttatgttgttgatagaatacatcatgatactcctaaacaaatgtttcgagtttaattttttaagacttcataagaaaccctatagagctaaaaaaaaaagaaaagggaaaaactctacggatcctcccacaattacccattttgctcctgccaaagccgtcgccagtcgccacctccattagtttaattaattagacctctgaatactctctgcatttttttatacattccccttggtcggcaagcatcaatgtcagctgagcaatgcttgtaaaagatgctggctgaattgatcaaaatcattttgttgaaaataaaaaggatcaaaattagattctaattaacagctgcctgctaaccagtgaccacgcagtgtgtaaatggaacatggtagaaagtgtcagatgtcagaaaaatcggcacttttcttgtaccgctacctcatcgatcatattcatccctgcattcaacttgattgagactccaaccttaagatgataaaatcccataaataaacatttatacctctttttgggtatcgccgggaaggccgaaggaggccatccaagtatattaagaagaaataaagttacaagaaaaaactcgacagagactgtcgaggtcgaaggtgcatcgaaatgcacaaccaaagccacatgctaatcacacaagcacaacccactgagagaaaaacctagcaccgagacgacccccgctatgcgtggccgatcgccgccgggccaacgacaacaccacaaagacgagactctaaaagcgatgcccccaaggaggtcacgacatcaaggatgccgccatcgcccatctaaggagatgtggttttcacctagagaaaactcgccaagggagaaaggtatccttgccagcgccctcaaggaggttacgacgcccaaaagcgtagccgctgccagcccgatgaatcatcaggcgaggctttcacccggaaacctttcaaccttgcttgaggttcgtcgcccatcaactcaggaaccacctcacaagcagatcagcacgaggcctccaccacaccgcgccggcgcccctccaccggccgaccaccacacttgctgcatagagctgccgctaccctgggaactggcccagacctcctccgtcccgccacccgccagcctccttgccagctttggccgaaggagaacccggaattggacggcgtcgcgttggcggtctgagctcccctcgctaaccggctgccgcctcaatccaacatagaaactccccacagagaaggggatgagcttcaggaagggcgagggtgcaggccggcagcgaggaagacgacccactgccgccagctcccttagcactgccatcactcccttcacgccctgcctcagtgcctacgagccgccatgcccaccccaacgccaccaccgctgcaccagaaggccagaccgccgccgtccgaccgcccatgccgcgccgcgccgaccacgggccacgatctggccgcaccctccgggagggtcgccgccgccgtccatccgcccaggccgccgctggatgcagttggccccgccctccgtgagggctgctgccgccgcgccgacccccggccgccgccccgtgctggaccatggtgtcccacggccgcccgcgccgagccgcgacacgcgcgccgcctctgagccccggccgtcgcgccgggggtagggcggccagatccgaccaccaccggatccgccgccgtcaccaggccgcgccgcgccgccaccccgcgcttgcccgcgacgccccgcggccgaccgcgcgccgccggcgagccctggccgtcgcgcgctcccgatccggacgtggggcggccagatttggccaaagaagtgccggatccgccgccaccccgagctgccccgccgtcgtcgcctccggccgtggtggtagacatcgtcagcccaactctgtcctcctcgcgccaaggaaagggttgctacagtggaaggcctcgccgccgccttcggcggcggggtgaagaaagaggagggggagtggcggcatgggcggctagggtttcgccccccaagccgctcgcgcgagagcgacgcgggggatttagaattctttttgggtatcgatacacatacaccgtaaaagaaaatgtttcaaaacacctcgctagtactggtgctcctggctgtattcgccaccgcgacgcacgcgcagctggtcggcgagagctgcgcgccggcggcatgcggcaacctgaccatcaagtacccgttctggctgcgcggccggcagcctgcctactgcggccaccctaccttcgccgtcacctgcgacgacgacgacgaccccaccggcgcgaccgcgtcgccgccgcccagcctgaacggctcctacctccgcgtcctcgccatccactacggcaacagctccgtcgtggccttccatgccaacctggtcgagagctccgcctgccgcgccacccggttcaacatgtccagcagcctcgcgctctcgctgctcgccgtcagccgcgccaacgcgggcctcctcttctccgcgaactgctcgcggacgccgccgacggggtcgctcccggtgaactgcaccggtttcagcggcggcggcgagtggttcctgtccctgaatcggatgtacgatcccggcggccccgcgcgggcggtggacacggtgggttgccagtactcggtggtgcccgtgctgccatggtcggagctgagatcggcgcgtgactacgcggggctcgtgaggcgcggatttctgctcgagtggacgtcggtgccggtcgactgcgcggcgtgcaacgccagcggcggggagtgccgctacgacgccggcgccatggggttcgggtgctcctgccccggcggccgcctgcagccggcgacatgcggtgagtgatttgtcccgcgactcgttgaaacctctgcatttcttttgccgcgcatgcagccgaaaaatcatctgctcgtagcagccgaaatgagtagactatgatcagtttgaccatttcagctcaaccgttgataaaacataccgaatcagtttgactagcattgtcaactggggagtgccaatagtacgcacacacgtgtcattagtataaattcaaaaggaactaaaaataatcgacgtgttagtgatggattcagataatatattcctcgaaaactcttttttagtggtaggttacttgtaggccggtagaaccaacccacacaagaggacagaatcgtgacaggtgattccaccagccgatcttgaccgttgatccaaaccaatgtccgttaatcagagttacttaccatcacggcctttttactccctgcaaaagtcaaaatcaggagaaacggttggtctaaaattactaacctactaacttatctttcatcccctggtaaatctagtcgtattcttcttttttcggggaattccagtcgtattcaaacagatatataacacgctatgttaggtgcaaatatttttcagctgaagccctcagagttgttcatccgtttctttaaaatactgaagtttaattagcacacgagtagtttgcaagttgtaaggtctaaattgatttccaagtcggtgctcagataattccatctagtcactacgacatgagtgacccatcaccaagttttcacttaccccggagaaaaagaaggaatagtcactagtgattcatacggcatgaatgacataacgctgtcgacaattgacctgcaccactagtttatttacatcgcgattagaagattaaaactgtccttgtctccctcctcacaagtcagagacgatgctgacttccccattatttctgctgataaaaaaaaagtctaacaaatcggaaagactagtcaagaaaaacaaggcaatggcaatagcatttctcgagcattagaccttcccctccctttccagcattctgctgctctccaatccggcctccattgtgtagcagctagctccacgagcggcaagatgcacccgaccttgttgtgcttgccactcttggcctccttgctcctcctgtgccaccgcgcgcgcgccgagtgcgagccggcgacatgcggcaacctcaccgtcaggtacccattctggctaggcggccccaacttcaaccagtccaaccagtcgtcgccgtcgtcagctctggcctcctgtggccatccggctttcgaggtgtggtgtaacggcggcgtggcgtcgttgaggggctcgcaaatcctcgtcctcagcatcgactacaacagcagctcattcgtcgcggcacacaaaagggtcgccgacggcggcgacggcgtgtgccgcaccgacttcaacatatcgtccagcctagccctcagcccgttcacgatcagcagcagcaaccgggccatctgcttcctctacagctgcaacggcacggagccaccggagatcgacggccttgtgaacgccaccatctccagctgcagtaagcctatctacgcgtacctcggcgggatctacgaccgtgataatccaccggcgatcaaagccgggaactgcacgtactcgtacctgccggtgctgtggccggactcgccggcgaacttgacggcggggacaaactacagcccgcagttcaagaaggggttcgtgttggagtggcagaagaacgggttcggcgactgcgacgcctgtaacgggagcggcggtcagtgccggtacatcaacgattccgcggcggcgttcgcgtgcctctgctccgacggcaagctgcgccgctcgacatgccccggtgagtaccacacttgcctatcgcccaatctgacgcatgtgttagctagttgaagattttggctcggtgtacggttaactggacggccaaattggcgcgttgcgatcggtagccatgtactccgatcccaaagttgcaatctctcgtaggtcccatgtggatttggagttgaattactggcccacgtcaatgtccttggattttactcaacctctcgctcgctcgcggtctcgggtagttacatgggcggctggctagtcagctgcagagatggtggtaaattttgggagggtttgcctcggtggtgacgttgacgacgacttatcaagcaggctgcaggcaggagttgacatgggcggctagtcactggttcttccattgaccacccagcgtgattgattcttgggtaaacgcatgaattccgtcctttcctttgtctctgtctcccaacttcccagggcagagatccttctgatccttctgcttccccctcttctttttcccccgaaaattcaccattctcattagtgaactggttcattattaggacaaataagacgttagcagtagttgcctgaagcttcgagtgtgttgagctggtccataaactaatgctcatagtaggtgacaatgtaaatcattagtacatgatcaccaagtggcattctgcgtagaagtaccaaaatagtggggacagatgggcacgggctaaatttggcatcgtgcacggcgcaccagccgctaccaggggctttctttgaactgataaggctaacgggataagttacgctttatatctttcgaaagcggtcaatcggagttgttagaagtggcgggccatgaatttttggagccgaaagaagcgaatattaaggaaagacctaatatcaaataattagaagggttgatactttgaacccagatcgtctcgttcaccatcttgtggagctagccggaagaccctggacgtttctcaaatttttggagcccaacatatacgcagacataattggaaacacaatggaaagctcaacatataagacatcataatggtgcgatctattggcttcttaaccttagttactgctccctccggtacaaaaatcttgatgttttaaccttgtaaatggtgattgcgaattgttaatgcttctatcttagcatgttatattggaccgctttgccctacatgcttggaagtaaaaaccaagtaaaaaagctagggaattggacctttagctcgcaccgatacaggtgattaattcaaaccaacggcagcagtgtagtgattaccatgagtacaatactatatttaatatggtaaaatagtaaattgatactgtaatatggagtaaatcacttcttggtatgtgagatcatgttcaaaacatcaataattttgaaactggaaggagtacacactgcccttctcaacttttaaacgctactatttccaaaaagaaaactttaaaatgcaataaacagatatgaaaaactgttccctcaaaaaatatatgaaaaattcaaaacaggaaatgcggtagtgctagaaatatgaaattatgaactttaatcagtgtagtttgtattgaaattttaatacaatggggaatgaaagcttatataaaaataaaaaatatatagaaaatgcaaaacaatatactaccttggtgcccccattaacgatagtactagagattgccaccactaagctaattccggtctatgagtctatccaagtgcttttacataaaagagcattgtgagctttgctgataatgacatagatttcggcaaaatatggtaccaaatgctaatgcctttcctgcaaagattctgattctaggagttgatagatacctacataatttttaggcttacttttttttcaaaattactttccaaattgttgaaatgaattttgtgctctacgctcctaaaatatattttctcaaaaaaatattctattgtattgcacacttgttttaagttcatttattaaatgtttaatttataactacaatcaagtagataatctgtacaacaatccacttaataatccttagattgtgtttgagtgatgaaatgagaaaattaagaagatacaacaaacaagatgagtcattagcttatatgaattgagtattaactgttttaaatttgaaactatatgaattgagtattactttattatatttatctataaacatagttaaacatgagacagtttgactgaccaaaaatcaaaacaacttataatctaaaacggagggagtactggttagtggtaggaactagcaacgcagcacatatgtgttcaatctgcattaggtttttggttagagagaagatactagatattaacacgtttttatcagaaagtactccttctgtcctatattattaggttcagaaaaatgtatctacaagttctcataatattaggatatgtcaaattaggtaggtttttattaaacacatgaagtattctgtaggagtttttttttagttttagttacatccgtacaggtaagcgttgaccggttggaaagtggactagtctctgcttaccggcaagagtaggtgtggaacaaagggcgtagtagcctgttatacaacaggtagaaaacaatggtggacagcagcgtgcactagctagctggaagagggttaataggagtacacgacgatgagtccggacaaactggtccagtcacatcagggcggttataacagctagctgcccatagggcaccccggaaactcgcacgcgtggacgacgatcgttcgtgtatcaggtcaaacatttcgacacagaggaatagttcccgtgtgcaaagtttcttacttccatctcccccacaaacttccatctccttcagaaatcccctatccccctcctcctctttctgtctcgatgtccccgagcttcttctttgtcgtcgtctcggcctggtcgctagcgctgatgctcgccgcggcggcgaggggagccgaggaggaaggaggaggaggctgcctgggcagccagaaatgcggcgacctgaatatctcctctccgttctggatcatccagggccaggcggataagccgtgtggtcctctggattaccaggtatattgcaacaactccaccggcgtcgcaactcttcgaagctctacagacagcgggtttgatatcatcaacatatcatatggggaccgtactatgctcgtctttgatgtccataagctagctcgcctgaataactccaccggctgcagtatcccagtgtttaacaccttcgccaagctgcccatcacgtttacaatcagcccttccaatcacaacctcgtcttctacaactgcaccgaggcgccgccggcggagcagcagcaacaactggggctcgtggagacgagatgcggtaacaacacgtttgctcgcctgggagggcgtttccacggggagggcgactacgacaagtactatttggaaggctgcagcagaaacagcaccgtcttcttgccggtgctggaaccgcctgatggcaaggcgaacgccagcaggtatgtggagctcgtgggtggaggcttcctcataacatgggacctgccaccgccagtgacatcttctggtaagttcaccctccctgaaactattaggatcaagttcgtatagaaaatccactgtatatcctgatacttccgatctccaagcgagtactagtagaatacggttctcgctcatcagcgtgtaggacagggaatctgtcgattggctgatagggtcgtcatcttgcccaatcgtggcggctgggcaacagggatgagcaagaattaaactagaattaaagtgatcaaagcagtggaccatgaccgtcctttcgcattccatctcactccggtgccattccttccaatcttcgatcctgttctggtacatgactgagaagaccatgcacatctgttggaattggaaccgatacggcaagacgatgaggccgtagacagccattatccagtcaattttttcggccactacagagaattcccaaagttaaatgtatcgtactagaagaagaagtagcagtattaattctctcatgtcttcctcaatcctcatcaacaacacatcaccaattcatcctcttcgttttcgatgccctctccttccttgttcctcttgttcgcctgcctcgcctgggcgagtcaagcagcgaatacggcggcagacaatcgtccacaagaaggctgcgcggccagtactgtatgtggcaaggtgaccatctcgtcgccgttcgccgtcgtgccggagcaggcaacggagagcaaatgcggctggcttggattccaggttatctgccacaacgacactccatacctcggctactacaagcccagatatcggatccagatcctcgacatcttctacggcaacaattcattgctcgtctctgacatccacaagctcggtgacttcattgtcttctccggcgtcagcaaagaatactcctgccatgttccgaggaccaacacctcctccaaggtcggcctcccgttctccatcagcaccaccaatctcaacctcttcctgtacagttgcaataaggcgcttgtgccgcgggacggagacgacgacctcgtggagacgaggtgcggcaacaagacgtttgctcgcgtaggagggaattacagtgattcgggcgactacccggcgttttacatggaaggctgcaatgctaccgtcgtgccggtgctgggcacggacgcgaggagctatgagcagctcatccgcgacggcttcctcttgacatggcaagagacgccgtcatctggtaagttcgttcgcgaaattatccatttaatcatcactttcgggaggaggaaatgcgtaaaatttatggtgtcaactttatcgaatccgttaatcaatcagtgacttgtttattggttgataaggcagtcgtcatcgctaatccatctccgacctttggatatcgaaatcagagaaatatatgcaaaaactatactcccttcgtttcacgatgtaaatcattttagcgtttcttacgttaatattgatgttaattaatctagacatatatacctatctagatttattaacatcaatataaacgtgaaaaatactatagtgatgaaacggagaaaatagtacggagtacttcgtcaagaagctgtagcagcagagagagtagtagcaatgtagcagtatgttcaatccgtagactttgaccggtcaaaaccgcttcgccaccgtccttttgccccacgcctcatatcccatccctcgatctctcgtccccttcttctctctcatataatccatttcaccactgcattccgtagttgatttgcgtacccaagtccaccagatatgcctccgctcatactgctactgctggtagcttccttcctcgagttgccggcaccggcgagctcgtctagtcctggctgcttgcccacgccatgcggcaagctgaccatctcctacccgttctggctggaggagcccggccggccgccgtgcgggtcgccgcccttccagctcaagtgcaacgccaccggcgcatacctcacgcacaccatctacgaggcgtatcgcgttgttgatatcttcaccggaaaccacaccgtccatgtggtggacgagaatctcccgctcgccaccggctgcccggcgccgccgttcaacatctccgatggcatctggcaggcgccgttcgtcatcagcgaagccaacgcagagctgcgcttcctctcgtgtaacaagtcacttccggcggcggctgctcctcccggcttccatagcctgccttgtgatgaccaaaactcctccgtccggctcgtcagcgaccaccatttacacgaggatgggattccaccgggctgtaacttcacggttgtgccgatcgttcagcgtcacaatgggagtatggccggctatattgccagcatgaggagtgggtttctactagagtgggcggtggtttcaggggattgtcccaaatgtcaagtaagcggcgggaattgcacgtacagcgacgacctggagttcgcctgcaattgccccgacgggatgcaccctgacaagtgtagagagttcagaaaatcggaagagcacggtaaatttgtccagtcaattatcaattagaataaaaattttaacatagttctgtgaacatgcagcctaggccatcctaaccgattcaatgcatccaaagtgtgttcatctagttgatagttttctttatatatatagaaaagaatgacacatcatttcgttatacaggaagatttccatgctactgtggcctaatgtccactagataaactcttattataataatgcgcgtgacatctagttttgctatcgaggaaagaaattaaacacagcattgtcacagcaatgttcataagaatataaaatgcaaagtggatattgatatttttgttttgaattatgagtgtttgcttcaagttcctgctgttttggttgttagtttctcatcaaacaattatttcactgatgggaacattggcatttggcagcttatggaatcctagtcaaacgtgttacgtgtagtttgaagtattcaactacactatctgataaagatatcataccaataccatgttccaatttttcttctgctgattgctgactgacgaagaaatccctcatctgattgacagcaaataccctttcattttctaatccttaattagtgtgttccaaacatgtggaaagcataaattgcatctgtatttctgttgaattaggctgaaaagttgtataagcactgtccttcgtttcaacagggggttaggggagcaatgataccctaacaatgtgattatgaatgatcattctatttgttcatggcatatttgtgcaaggtattaaaagtctgttcttctgcaggttcaagaagcaagagtcacataataggaataggtgagtataattcattcttgtttcttggacttccccaaccattcaaaatgtaattatgaagatatgcttcagatccttggttctcacatattgatagtgctctgtctctgttattgcagcatgtggatcaagcggcggaatattattgattgtatctatattcatttttgcttggcacaaacgcaagaagaggaaacaaacccgagatttgaaagatctcatgcatagttcatcttcaatgcaatcatacagcaaagaccttgagttgggtggttctccccatatattcacttacgaggaacttgaagaggctactgctggatttagtgcctcgagggaacttggtgatggtggttttggaactgtttacaaaggtaggagaatatgtttgcacaactcccttgttgttaatagatttctcatctaatcacttcctcattagcatgcctaattgcatgcgacaggggctccgttgaactttgttccataatagataacttcccctattaacttagcagttacaattcttcctttctgccattcaggaaagctccgggatgggagagtagttgcagtgaagcgcctttacaagaacaactacagacgagtagagcaattcctaaatgaggtagacattttgtcccgcctactgcaccagaaccttgttatcctatatggctgcacgtctcgttctagccgtgaccttctcttggtctatgagtacatcccaaatgggacagttgcagaccatctacatggaccccgtgcaggagaacgaggcctcacatggcctgtaagaatgacaattgcgatagaaacggctgaggcactggcataccttcatgcagttgaaatcatacaccgtgatgtcaagaccaacaacatattgctggacaacaacttccatgtcaaagttgcggactttggactatcgcgcctgttcccgcttgaagtcacccatgtatcaactgttccacagggcacaccagggtatgttgacccagtgtaccaccagtgctacaagctaaccgataagagtgatgtgtatagctttggtgttgtgttgatagagctaatttcctcaaaaccagctgtggacatgtccaggagccacagtgacattaacttggctaacatggctctcaacagaattcagaaccatgaagttgatcagttggttgatccagagatcggctatgagactgacagtgaaacaaagaggatggtagatctggtggccgagctggcctttcagtgcttgcagatggacagagagagcaggccaccaattaaggaggtagtggaggtcctgaattgtatcaagaacggggaatgtccagcggaaaagatgaacaagaatgcgtctccaaaggaagattcgcatctgctgaaggacagcctacagtattcgcctgactcagtaatccatagatttcatagccaatctactaaccactcggtagcatcaaactctagcggatgatgagaaactttgtattgattctgatgaaataaggataactaagttgtcccctcttggttgatggactaattaatactacaagtgtttgactatgagcttggcagaaattcagacaattggtgaatgcggtaggagaaatacagggttcaaacaatctcgtgtaatctagtgttcagtgtgttcatgatttcaggttagcgagtggtatcagggagaacacatcccattgttaccctaactagaggttgcaattttgcaagcattcctcccctttttcctatgaactgcatgtacgaatttgcaacacaaacatttggaattgcgggcaaagcgtacctggctgcaagaatgcagtggcagatgcaaccgattctcgtctgatcccccggcaggcgcggatccaaatctaacctgccgcgccgcgcgcggcgtcctcgtctctccacgccgatgagtccggggacgctcgaccgcgcacagcccgtgctaaatttcgcctccgttttggggtgggggattcgccggccgcccggtctccccggcggcgagtcggcgcgtgccctaggcccgaggcgtggagacgacgcggcggcgctttgaagcgcttgctgtaatccgtgggctggatggacttacttctaggcccattacaacgccttcgattaagtgggccaggtgctgttaacattatggccttttcactaggccggcaaatcatagacgaagttagccagatgtcaaagaccttcaatacaaatctaaaactttcttctctaaatcacaaaattttcaattgaatatctggaactttcaccttgagattacgaaaacttccaattcaaatataaatcctcccaattcaaaattaaaaacttttagctatatactcaaatcctctcttctccttcgacatcaactatcaccaccataggcacaatgacatcgtgtgtgccgtgccactgctcctgctctagagaggtcagcatgagcccaatgcggcgcgtggtggctggagcaacaataacaaatagacggagttcctgcaaggggaatatcagtcgactattgataccggagcttcgacggagctagagg

SEQ ID NO: 691 - DNA, 4160 bp, Oryza sativa; identical to SEQ ID NO: 638

SEQ ID NO: 692 - DNA, 2957 bp, Oryza sativa
gactttggaaagtattagattttgaaaagcgaatggtgtgaatccagctgataagaatcggaataattaagttaccaatttcttgcttctactttattttctgaattatgctgatatagctggttataatatggacaaaatgctgaattgtttggcagaaattttaattctgagagaaaattgagctgtccgaaacctcccaaacaaactctgagattgtttagcaaaaattaagattgaggtaaaagattctcccttggtcacctccttaattaaattttaaattgctcgattggattagcttgaaaatgtttggatttaatttccgtgtgtaatagtgaatactacgggaatctttatattgtgcataaatgcttatatttaagaacggagaaaatactgagggatcgatcatccaataaatcaagtcatggtcatcataatgcaatgtctcaacattgaccacaatttcagtatatatacttctctcttggttgatattacttatcgttctgaacaaacctattgtcaaacctgaaaaaactttaactataaaatataaaatagttatattagaaatataatgaccatatgtatagattggtcctaaaaactacttcaacaaaatcatatagttattgatatttctattatactataatgaaaaatagttatcaaagttactttttaagatcatgtcattgattgttcaaagcgataattattatcaaaccggtggggagcagtagattgttaattcatccctgaccaggggctaagtttgtgcggtcataaatgccaaaagtgcagggttagttagcgggggtgtcactgtcacggtaagaagtaatcacaatcgacatgtgacacaattaatccatctattgagaaccttctgatcatcaggatcgttcgtgtgaaccatccacatagccagctagtttggaccaatcgattcggcagtataaattgcagtgcttgacacgagaaattctgtcaaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaagagttaaatcttaactataaatctagacaatcatatgtttagaacttcagattcgtcgttagaattaatttttttctaaacggagtacgccgtattgttttagctataaaatcgtgatgatttgtgcataattccaatagcctcttccatctccgctaattaattagctttatcgtatattctaatgtaaaatcaagctacttaagatataaaaatttacattaaaaattttggtattacctcttgatatcactgaagtaaagtaaattttttcgcattgaattttggtggacaaacgctcatgctattctcaagttgcagagaactttttttttgacacagtaaacctctgctttcattaaccagtatctccaggcaaatcgccggagaccaaaggagatacaaacgtcggggcttggctccagaaacacttggagctagtggccacgatacccacaccaaaagaggccaaacaatcagccactttgttacaagatctagggaaaactgaaatagaaaagacatcaaagtttgatcttaagaaagcccttaattttctgaaaatgacaccatcagggcgacggttcagatcttgggaaataagtgctttgcccagcatctgtgcatccgttttaacctcaatttttgtcatcccctgttgagacactttttctagacttttcatcattgctaacgcctccacatgcagggcgttgcccatccacgataagcttccagcagaaagaaccctttgaatccattgccacaaaaccccagcctccagtgccagtctcagcgaagaaggaagcatcgatattaattttataaacatcttcccgcggcggcttctatttttccatcacttttcttacattttattccccattcttccttatcttctcttacaagttgcagataactggttgtatatctgcagagttaatcagatgtgccattcctcataagggcccaagaacagggtaagccggtaaggccttgcttggatgaggctcattgcaggcccatctttgtgtgtgggacccaacattcaggcccataaaaggaggcccatctaaacttgcaaatcgttcagtccaatgcaggagcacttcgactagctcagtttttttt

SEQ ID NO: 693 - DNA, 3840 bp, Oryza sativa
aaatgattttgaacatgtaagttctgttcattagtgctaaactggtcctagaatacagtgttttcttaatataaaaacttattacactgtactaacatttctataaaaaaaaagagaagaactttttctcagagacagcatcaataagacaaaaaaaagttacatgggaaaaagagaaaacacaactaaaaagagaaaaacacatattaccacaattaactattctctctgttcctgaagacatacttcatttttttcatattttaagtcgttttagttttttctaattaaacttttttaagtttgatgaattttgaagaaaaatatagcaatgttttcaatataaaacaaatatgctatcaaaatatatttaatatttaatgaaactaattttattttgtagatgttgctaattttctctgtaaacttaattaaatcttaaaaataatggcaaataaatgacttgtaatatagaacgggagagtatctttttttaagctaaggatcgagagcagagtgaaagtaaaataatagggccggagtaataattaccagctggttcatcccaaaaggtagtagtgaaggagtcaacaaatgaatccaaattagctagcctaaattctttcaaggagggccaaattgtaaccctcctggttgttggcatgtggtgtttttccttgaccctgcttgcagatgcaaccagccagccagaagactcttctatcctcttaatttgacagaataatcccagatctaataaaaaacacagtttaatcctccttattttctaaaatgaaaatagtagtactactactaattatcatcacaaatgacatgattgatgctacctttagtctttagaccctaattatcctccacatgctgaaatgaaaaccacactgacattaaaaaaataaacaattgatgccttttccggagcagaaatggtagtagtactactagtagtagtattctactgtcaagaccaagacggcgacaatggctaagatgcttcctcctccgagccagtcagtcccctctcgcccaccttcttggctatatattcctcctcgtcgtcgccatggcaccttcactagctcatgcgcatttcggctctcgccttcttcgccttcttctcctcctcctcctgttcttgattttcagtatattcaattcatggattcgtggattgagcagacttccctgagcttggacctcaacgtcggcctgccgtcgacggcgaggagatcatcggctccggcggcgccgattaaggttctcgtggaggagaacttcttgtccttcaagaaggatcacgaggtgcgtggagagattgacagctgcgacgacatcgatgagaatttgattgggaatattgaaaaaaagtttgattaattagttgttcgatcttgtgtccatcgatccaggttgaggcgctggaggcggagctccggcgagcgagcgaggagaacaagaagctgaccgagatgcttcgggcggtggtggccaagtacaccgagctgcagggacaggtcaacgacatgatgtcggcggcggcggcggcggcggtcaacgccgggaaccaccagtcgtcgacgtcggagggcggctcggtgtcgccatcgaggaagcggatccgtagcgtcgacagcctcgacgacgccgcccaccaccgcaagccatcccctccgttcgtcgccgccgccgcagccgcggcctacgcctcccccgaccagatggagtgcacgtcggcggccgccgccgccgccgcgaagcgcgtcgtccgcgaggactgcaagcccaaggtctccaagcgcttcgtccacgccgacccctccgacctcagcctcgtaagcaacgaaacaattagattaatccattgatgaggtctcctcgtaattaaccaacaattggttttgtaaaaccttcaggtggtgaaggatgggtatcaatggcggaagtacgggcagaaggtgacgaaggacaacccgtgcccgcgagcctacttcaggtgctcgttcgcgccggcgtgcccggtgaagaagaaggtgcagcgcagcgccgacgacaacaccgtcctcgtcgccacgtacgagggcgagcacaaccacgcccagccgccgcaccacgacgccggcagcaagaccgccgccgccgccaagcactcacagcaccagccgccaccgagcgccgccgccgccgtcgtccggcagcagcaagagcaggcggcggcggccgggccgtcgacggaggtggcggcgaggaagaacctggccgagcagatggcggcgacgctgacgagggaccccgggttcaaggcggcgctcgtcacggcgctctccggccggatcctcgagctctcgccgaccaagaactgatccatcgttagaacgccgatgaactttgctcgatttagctgagatcgatcgatcaatttacacggtaaaattttagagttgatcgatttgcatggctttgatcggagttaggctagagagagagaggattaactgtgtatatttagtgattgattttaattagctcgctctacacgtgccaaggtggcagtttaagcaaaacgtacgataattcgttgcaatttgtaattcagctagaagattagtgtattcatggagatctattcagagtctcccagatatatatatagagagagagatagtagcattgatgttatcgcatgttgttgcgattgaacgaaaaattaagaagctagcacatgcaaatacttaaattggaagaggagactctagatatgaatgaggacgaaatgtaatcaacatttgccggaataattatgtaagtgaaaccaaactgaatcaggatatagtgttcaataatgttttaaatttaggcttaggccttctttgtttaggcttataagccaacttataagtcgaaaagtctaagccaaaacaaacaagcagcttttttatttggcttttttgaagccataagccactctaacactattaagccaaaaactaggttggataatcttttttggcttatatgagatagatgtatgactccaccactaaacttaggacattaaatccactggcttataaatcatataagccaataagttgacttaaaagtctaggccaataaacctaagcctaaataaagagggccttagtctatcaattaattagcttccggccattttgatgcatttaaaaaaaatatgaaaataatcagcctgtgattaataattagccttcaaattccagtaaattcccaagtgaaatgttggatgcatgcatgaaattatcaagcataactctccggctacatgggtgggattaggataggtacgatgcggtggccgtttacgtgcacggtggactagtcgacgacgagacgaagaccaaaagacggatcacacgactacaaaaactagctacagtaattaattacttgctcgtacagactaatttacgtgctgacatggcaggaggagtgggccccacgtctggttgaggcggcgagggagagagcctagtcccggcgtttattagtcaaacacgtgcgggcggcggtccggtcaaccgtcaactcgtccacgctggctgctcctgtacttccatccatgcagcttcgattttctttctttttttttttagggagcttacggggttgtttgttttgctcccaaagtttgccaaaggttaccacacatcatgttaggcaagtttgactaagttagcatattgtttggttcatagccatacttgtggcacgattccttctcatctatttggaccccacatgtcatcaactcaacaaagtgtggcacaatccaattttgctagctaa

SEQ ID NO: 694 - DNA, 4160 bp, Oryza sativa; identical to SEQ ID NO: 638

SEQ ID NO: 695 - DNA, 4694 bp, Oryza sativa
actgcaggtcgttgccaatggctgaaaaaaaatgatttattttttttctgatgatgcaaccgtggagacgctaagctgaggtcaggtcttcggtcgcatatggtagccctttgatcaaatcttaatgtttagatgtcatcatcaaagaagaccttgacttagtaataaaaagggaataatggtaattgcaaaataaacagatactaaattaaaatcaaagtaatggttcacacttcacaaggtgatccagtcttttattgcttctcttcctagttgggatgcagtgcagtcataaacaagaaaatgactacacgacctggtttcaggaaaataaaaagaaaaagaaaaagaaaagaaaaggactagatgtgatgcgctggaagtatagagataaacatgggtaaaaatattacagcttgtaagtaagaaaaggcactctgcacaagtaggtagcgtttgaaatagatttacttgttggattattgttgctgattatctacttcattattggaataaattaaatattttgataagtaaatttaacaaaatagtttagaacaagtagtctaagcaatgtttgacacttagcaatacaatagaagattttttttttaggaaaatgtatttctaaaagcatggagcaaagaatgcacatggtgaataagtttgtaacacctgtgatacagttagagaccaggatttacatttaacatatcatttttcagaaatcaagagacaagatgccctctccatgacaagaagttatccggagtgattcatgtagaagaaataaaatttaccatagcattacattaattgcatatgttttacaaaacaaacaatattacagtatatgtaacagttggacccctacctagcctagtccctttcagtcaagacaactactggacagtaaaacacttgcacacagagagagagagagagagagagaacgacttgcagatatataaatactcatggagccacccaccctcattaacaaagaatccgtccagccttgagaagcagagaagaggagagaaacaagagacagacagacagagatagagtaactgagtaagcatctcgatcttggcatgttctttcttcttcccctttcccttcattgattctcctcttgttttcctcatcacaaactcctgcagagacctgttcttcacctcaattctgctcttgttatattgcctggattcctttttttttttggttcttggaagcttctattgccgctgcttgttcttgagtgccctctgcaatttatagataattttcttcagtttttttatccaaaaagagttcttggattagttgtaaagaagaggttaaatcaaggaaggttgcatcttgttcttgactgattaattggtgtgccatgatctgcaggtaaacgggttcttgcctgacatttgtcttgtccgggtggccattcatggccaccgtggggcagcctgatgccatgagaaggatcaccgttcactacgtgaatccgccgccgatcgccggcgccggagaagcacacgtcgatggcctcgacgacgaggttcttgattatgtgattggtgatgttcttcaggatcaggtatgcatttgatccaacctttccatcattattagcatactgctcttacaggcttgcagaatgatgagctttagcatcaaacatatgtttctaagcctttgatatggcctctttactttagttcaacattgtttagtaaactttccactgtttctctgaaacttttttgagaataaacttatttgtttttctgaacttttttctaggagggtctgtatcaatcgatattgtatggcaaatacggggatgacatgagaggggcaagaaacactgctcttgcccaatctgatggtttacattactactatcacggagagaacagcagtggtgaagcaacaacctcgagaaattcagaaatcgaccaacagattgagtatgacttggtgttcgctaggcagctgcaggcaatggataatctgacaattgagacacctgcagatgaagatgatggtatgcattcattctcgttcagtttttgtaagcacttgatgtgcataatgattttcagtcgtggcaatcttaatcttttcacctctgaaattttgttgcccatgttggtttgattcagatataagctgcgtaccctctccatctgactctgaaaccgatgaaccggcagaaggcaacaacgaagaggtgattatatgagctgtttcagaattgcaattattcagcattgttcgtttcagacttcttgatgcaaagatacacaattgcgtattcactaaaaagatgagctgtttcagaataaagcctttccaaatggataatgtataaacatgtactacgaaaagttgagattcctatcatttgtttgcaggctgccacacaggatgataacgatgatccagacaacatgacatacgaggttagtgttatattcacttgtatcacatttcttctgtaaaagaggtttacaccatctatgaaaaagttgctgattcttattctttctgtaatccagcaaaggcaggcacttgtggaatctgtaggaaatgagaacagaggtttatctgatctgcttatctcctacttggagacatggaagtacaaatcaggctttttcccaaggaaggcaaaccatgataagtatgtctaccatttcagttttcaatcaatcacatactgatttcttgcagaagataatccaagcatgtaactgatgacactctgattaaaatcttcatcatggcatgcaactgatgatttcctcctcttttttctcccaaaattgcagctgtcctatatgtctatccgctttcagacgccgagaaacactcattacattggcttgcaagcatagttaccatgaaggttgtattgctagatggctcaagattgacaaggtaaacaccttcttgggacactagatttgctatctgaattgtgtacctatcttagattataccatttgtcaaagtttacatgagcactgatatgcactgtccatttcatataacaagatggtctttgtctttcagtttccttgagcttcttccaaattaaaagaacttcatgggcttgtgcagtggaattcctgacatttttgtttatgaaacaggcctgcccagtttgcaaatatgaagtgtttggaccttcctagcgtgtgaggaggcgatcaacaaggctgaccaactatgactcgatgagacggcatatagtggttgcagcatctgctctgcagtattaattaaaaagggaaaccttaactcccaaaaaaaacagagaagggaagaaaaagaaagcaaaaaggaaaaaggaaaaagaaaaagaaaagacaaggagaaaagaaatttgaaaacagagatgcttcgtcaagattgtgcatttttttcatgtttttttttggctgtgtacaagcgtaattttgacctgatcgactcaaggcagtcgctcgaggcctttaatttcgtaaagcttcatatgcatgagtgtgcaattgtgtgcctatagtagtatagtacatgttttctgtttgaaacggagtcaaagatctctctcctgccgaccacccatctaaaagaaggccatgtgtacatcaatacatgtactgatatatactccctctgtccaaaataaatcaacttttgtacatgtcaaaatcttcttgttcaacttgtacaaaccagaacatattactccaaaatcacaaaaaagaacatattactctaggagtactcgtcctaaataatttgtgctttgcttggcttggtaccagcaaggcagcaacaagtatgctatgccacttcacttactacctgacaggcagtccagctatgatatctctcgtttatagtgggcccatctggtagtggcaggctggcagctgccttacgtgtgacgccagcgaggcagcgggcatgggtggcgtgcccgagaagagacacgtggagtcgaacgagacaaagcaaaaacatgggctcacatccccaacgtccagaagaagccgccgctgcctcctctcatttcggaactctaaagcctcctcttatttcccacttctctcttgccgtcgacccagcgaaccctagccaacgagatcggtagctagaggcagccgctatagccatggatgtggtaaatgcagcaaccttggatgtgttaaccaaggtttcccatccgatcagttactgcacggttatcgtggtctgtgcttaccgcaagggagcggtaataggaactgcccagtatatcgacttagttaaaaagaataaaaaaatatatatttttggttaaatttgtctggctttcttctgttttgcaccgtaaccgctgttacagcggtgaaggatacccctcccctgacggtaagggaaaccctggtgttcactaggcactaggtggtaagggaaactctggtgttcaataggcaccaggctaagcagaccaatgcgtaggcaccacagatcagctagacagacaaggtggtggaataaagcctaataccagaagacgtctttcagaacaatgttaagttattaggtttgcatagttacataaacagtaacaaacttttttctgaagaagaatcaatgctatcacaattttaatatactgcctaagtaatcacctcacccagatcaacatgctatta

SEQ ID NO: 696 - DNA, 5106 bp, Oryza sativa
agtcaacggtgtcaaacatttcgaaacggagggagtattaatttctttttcgattaaacgtggcgaatgcatcccttaactatcgaccacccatgcattgcactccatatgtaacttggaatcggcaaatgcatccctcaacagtttgaaacagactcaaatagacgaaggtatgaataattctgtaaacttcgcaagaatctataaaatttggttaaaaaaacactatcctaatcaccaactaattcttatcaattttcaaggaataaaaaaacaaaagggcactagaatctaaagtttttaagtttcaccctttctccgtggagatttcaaacaaaaaccacacaagattctacgacttcatttaaaaaaccatgccaatcaccaactgattcttatctattttatcaagtcaaggcacaaaaagaataaaaaggacactagaatccttaagttttcaaatgccatattttccctgtaaagaattcgcatataaaccacacaagatcctactataattttgttagaaaaaaatatgcgccaatcaccaactaagtattactctattcgttatactatagtattatactataggccgttttaacttttcttctaatcaatttttaaaatttgatcaagtttatataaaatatagtaatattttcaacacaaaacaagcatactattaaaatatattcaatgttacttctaataaaacttatttagtgttgtagatgttactaaggtttctataaatccaaagaaatttaactcgagaaaaagtcaaagcgacttataatatgaaacggaattagtatctattttctcaagaataaaagaaactaaataaaaagcactcttagaatccttaacgtttcaaatttcatccttccccgtaaagaattcgtattcagaatcagggacttaatttgcaattagtaatttaaaacagggttggatcgtataataaaaaagtactccacccccacccccgtatttgatcctagtcagccacccctgcttccttcttcttcccaagttctcatcgagggttttcctctctctctctcgcatcgcatccatcccctcgtgtcgccgccggcggaggctgcggcgagccttcaccccccacccgcccaccgccggcgagccacggcgtgggcgacctcctctcctctcccgatcccctctcgcccttaggtaggggcttctccccagtccccaccacacgcgcgtgcgtggccgacgagcaccccaggttcggatcggatggaaggtatgatgatgatttgttctcgtctcggtgatctccctcctcgtcgtccttctccggcgcgtcgctttcgtgagtagatcggagatccgttcgggggttgggggtttgatttggggtttagtgaacaccctccccaatcccacgtagccgcatcgttaggtccgcctcccagtgattatctagattgagatttcgatcttgcagtttatggtgtacagtatttagagtgacaggtcgaggtgaaaggaaattgaatctcccttgctgctgtcgtgagatttaacttgcgtgtggacaggtctaggtgaagggaattcaacttcacctgctgatattataagatctagctttgggtattgctgctttataagaattattagctttttattttttttcatatcaatcaattcgaagtccttcactggtaaagattcttaactcttgagtagtgcttgtgatctggcttatgcgagtagtttgcatcaagcaatgaataaattattctatagcctctgataagctcctctttgtctgcccaattacctttttcagaccagaagaaaaatgcaaaaccagaggggtcttctggctcgcaaaggggagctcccccggcacctgatgcaggccttcccaatccttttgatttttctcagtttagcaacttgctcaatgtaagttcttttttttttcgcgcagctaaaagcatgatatgtgctctctttttgtgcatcacttatgtttaactgtactattcttacgtacacaactgtaatgtgatgtgcaggatccatctataaaggagatggcagagcagattgcaagcgaccctgtgttcacccagatggcagagcagctgcagaagagtgctcatgtgaccggggaacagggtggccctgcattggatcctcagcagtacatggaaacaatgacacaagtcatgcaaaaccctcaattcatgtcaatggcagaacgtcttgggaatactcttatgcaggtatcatgttatgtttccagagtcatcaccagaaaaaattttcagaatgtttcttcgcttcaagttttctgctacgcatgacaggatcctggaatgtccagtatgctcgagagtttgactagtccttctcataaggagctgcttgaagagcggatgtcccgtattaaagaagatccctctttgaaggggattcttgatgagatagagagtggtggtccatctgctatggtgaagtaggtgttgtatgctagtatttagatataactgtggcttttaaatttgctgagatggtttgcctcacttatttcaggtactggaatgaccctgaagttcttcaaaagattggtcaggctatgtcaattaattttccaggagatgctgctacttccactacattgtctggacctgaagaaactgaagaggatggtggagatgatgatgagtccattgtccatcatactgccagtgttggcgatgcggaggtaatgaagttcgataataactataggacgtgacttctgtttttactttgctctgagttgatctgaaacttgtgctggtatctatccgtattagtcttcacgactatgtgtagctatgctgcccatcaatgtagcaggttgtttacccgacctatcactatacaacaaagcttgcttctccaactaagcatatgactaaaccatgcttttcctagatagttctataacataacctggcttcttgttcttaaagctttgtggaccacctgcttattgtgtttattatccatacaccgtttgcctttatttggtgccaattctacacaaatgctacgtagaaaaatgacttctgtttgttgaatctgatatacgcggggtttaaatcagggcaggtttctcatttggctgccctttttcgttcttaatgttcctgatctttgcactagatatggtcgctcttgatgtcaatctcttatttatgtttgagcctgaggaaatatattaaatcattgtactactcatttgctgcaagtacttctttatacaacataatgactcaacagggtctgaagaaagctttagaggatggagcagacatggatgaagaagacgctgagggaagaagggccttacattttgcgtgtggttacggtgaggtatgtggaactgctgaatggtttagaatagaaatgaatcacgtaacacagattaaatacggatgtttgtagcaataaccaattgggtgaacttgtctgttttcagttgaaatgcgcagagatccttctggaggcaggtgctgctgtaaacgcactggataagaacaagaacaccccactgcattacgctgctggatatggtcggaaagaatgtgtggatcttctgctgaagcatggcgctgctgtgtaagtttaaaccagctatttcatctaaaaccgagtcgatttgatgccctgctagtttgtgcctaacttgatgaaaattgatgaccccagcacgccccagaatctggacgggaagacccccatcgaggtggccaagctgaacaaccaggatgaggtcctcaaggtgctcgagatggacgctttcctataaagaaaccaatgccaaatctcacgctcatcatcaccggctcgtcgctttacagttcagatttttactgcatacccaaatcatcatcgactcttttagctttggttttggtgtggtggtggtacattcgttgaatcgttgctatgtttggtgctccgatttgtaatctgtttcacttccccgttacactgcatcactccgtttcatcctttgtattcctatgttgctgagtctggtgttgcagacgttgctcctgtttttctcagcgttttcgtgtcagattggtagtttatatagataagagatgcactgccccggtgtacatgtgtctcaccgtcgctggtgccgtgtttgaacggtgagaggccgatcaatgcacgcgatcaagtgggcaatgcgacctcgggtaggtgacaaaacatggtgatctggagagtgcgggaagcgagcgcttcggtggtgtttgtttttaccctagacgaagctacacgaaaaatggaaaaaaaactaatattgcatgattaattgaatattactaactgttacaaatttagaaaatagatttatctgatattttaaagtaattctatataggaagaatttacacgaaatgtgtaatttagagtttgaaaacatgctaattaaaaactgagataaaatggagtatatcttaattacaaacgatcatgggccttcgtcgtcggattggagttcttctatccacttctattttcttccatgttgccattttgggcggatgcaactgttgctcaaaacgagcttatccatatgttgaattgttgactgagattggccggggagagccgtacaagttttagggagcaggagaacgacaagtaaaagaaacactttcatgcgtacgtggacgccgcagctgccgagctaggccttgaatgcttcgaacgcttcatctcactcactggcaggtgggtcccacctcagggattaaaccacacgtcagcatcttcccctcttaaagacgaatataccccacggattccctaccatacctactagttcgcgcacggtctcagtgtcactgacactgggcccccatccctgtggcccacatgtcatcgacacaaagaatgttttactagccacgtgccgaagccgtcgatggccgcggggggcaaaacggcgaggcgacagccgccgtccgatgagaatccgacggccagggtgccgccgtcagctgcctccacccgccgcgagcgatttgaccgtgcggtgacggtggtgag

SEQ ID NO: 697 - DNA, 3184 bp, Oryza sativa
agtgtggactgcggaagatgaatcgagatcaatcaattcgttatgcttgaaaggctggaataactgatcagttggctggatcgatggtatgtactagataatatgcggtctaggcctagaccaagaagcagaagaggagtcgggtcgggagtgtggggcgacgtaggctgtagctgggccggccgccccaggccgcctaatgagtgtgtccgcccctggcctgacacgatgggtaattaaatagttatgcatgtccctctttgtctaaacaatatgtataaaattgacgatatcttgggcaaaatcactgggcatggcacacaggagagctactttagcgacatgaatctaggcgaaaatctattgaaccaaaaatcgactgtaatctcatgaaaattttcgtcataattatagcaaaatcgttgttggattgattgcacgagaaaacagaagaagggagctaggtgatattatattgttttgttgcctacataaatcttaaagcaatcgaatggtctaaaatttacaagatttttaaagaggttttcgtaccgtatagaccccggccgggtcaaacttatttggtcgtcgctggttgtttgtagcacgccagctccatatatgtggattgcagctggtctatgataagttcggtcgatctgagatcaatctatcaatcgtcaaccctttgcctttgttagcgagctagcgtgtacacatttcaattatatatggtgcatgcatggcatccacgcctccacggtcaacgtggaaatatctctggaaacttactttttctaaataactgaacggattggaggcaggagacaaatttgaccaacacaatatatccacgacggctagacaatactagtagatgcatgcatggaaggatatagtagtacttgttaatcgtggaaactttggtaatgcgaatgcatttcaattcgttgctgaagatcgatgcaccatgcatatccatctctatataaagccatgcgatcccaccgattcttgcacacacactagctacttctacttctatcataccaaacaaactagcttaatttgcattgcatcacattgccggccgccatgagagctctcgctctcgcggtggtggccatggcggtggtggccgtgcgcggcgagcagtgcggcagccaggccggcggcgcgctctgccccaactgcctctgctgcagccagtacggctggtgcggctccacctccgattactgcggcgccggctgccagagccagtgctccggcggctgcggcggcggcccgaccccgccctccagcggtggcggcagcggcgtcgcctccatcatatcgccctcgctcttcgaccagatgctgctccaccgcaacgaccaggcgtgcgccgctaagggcttctacacctacgacgccttcgtcgccgccgccaacgcctacccggacttcgccaccaccggcgacgccgacacctgcaagcgcgaggtcgccgccttcctggcgcagacgtcccacgagaccaccggcggctggcccacggcgcccgacggcccctactcctggggctactgcttcaaggaggagaacaacggcaacgcccccacatactgcgagcccaagccggagtggccgtgcgccgccggcaagaagtactacggccggggacccatccagatcacctacaactacaactacggcccggcggggcaggccatcggctccgacctgctcaacaacccggacctggtggcgtcggacgccaccgtctccttcaagacggcgttctggttctggatgacgccgcagtcgcccaagccgtcgtgccacgcggtgatcaccggccagtggacgccgtccgccgacgaccaggcggcggggcgcgttccgggctacggcgagatcaccaacatcatcaacggcggtgtggagtgcgggcacggcgcggacgacaaggtggccgaccggatcgggttctacaagcgctactgcgacatgctgggcgtcagctatggcgataacctggattgctacaaccagaggccctacccgccttcctagttgatatttgatccgagcagacgaataaaatacaatgcacacgagattgtgagactcgtgaaaaacatatactacctctgaattttaatacatatctctaaaacaaagatttgatcattcttcttatttaaaggtgacttatacccttttttttcacctgacaataccatggacgttaacacaatgcggtcgaagatgatgagttgatcgctttgcatccattgtcattcttcaatgatagcaggttgaaatctgttggcaacacaacacaacacttttcccctccactaatcccctatataacgcgggaatttataagtaattttcaatattatttttcattacagttcagctagaagtaaaaagaaaaaaaataatcaaaatctcagggtttatcaatatttatcatgaaacaaatgaaatttgcactttaatatagaatatattgataagtatatgttaaatattataaaaatgatagagagatttgtaaaactattgtggaaatgatgttagaggtgatgattgaatatgcttgcatgttaatttatagaattaaatagattgtagatgttcttgcatgtttgcatgaggttgaataagtaattattgttagtgggtaataatgtggcatggttgcatgttaaactttagagtagattataaagccatgtggtccccaccttttcttgcacgaaccgcagcaactcactagttaacttcatttgctttgcataattgaattgccacaagccaccatgcatgagagagcgcttactgtactagtaaataaattaatgtactataagccaatgttaaatctaacatatataatagtatatatgttagctataaggttagctttatttttttcatcctctctctttatctctctatgaatttaatgtatatttcttggagtttgtgtggagctagctcttgcatgaaagccaatactctccacttttgtttatctctctcttccacataagcatttagcttacttatagctcaccattatccttgctctaagagctgttttccaaactaattacccttcacacacgtaaaaaggaacaacggattagcaggggcgtacccaaaaaagttgcgatcaaccctactg

SEQ ID NO: 698 - DNA, 5107 bp, Oryza sativa; identical to SEQ ID NO: 285

SEQ ID NO: 699 - DNA, 5126 bp, Oryza sativa
atcatgatgaacccattcaggccttcacaccactctagtgctgcaattctgaaaaccagtttacttgttatatacaaccacagctgtttaatctgagaagaattgataactgaagaactgtaccggtcggtcaccaagggtacttattactgtactttcttaccttggactgcaaacaccacacatatgctagccttcaaaggaacttttgtatattgatatccgtaaagagaagaaaaaaaggttttatgacgtatattggagagaaacacatgaatggactatttccttagtttatctttttggcctcttttcccatggaaatgatctcacttcggattcatgcccccaacccatccgtgtgggcgacgaagtacactgaacttccgaatcgagtttgactctccggatgctttatcagaagcgcaatgcggcgtcccgtcacggcatatcggtccgaaatggtgcgcggtgcccgtcacggggcaggttggcgctgctgcgtctgctactctccctgctcaggccacgcgccgctgaaagagattagtagtggaagaggtggcatccgcccgctctctcgcgtagcgtagacatcagctgagcccctcgcccctagccgatcgacgcggggcgccaccggcgggcggcgggcgaggcggctccgggtgttagcgattgccagagcgcgcgtcaccgcttgctgaggccagaagccgtgaaagcacatgccaccatgttaataaaacgtctttttgagtcaagatagacttaccaggtcattacctccagcccatagttgattccgctctgagttttgtaagccggaatatcttctgggccggcttggctcgtcacattactccggcccactgttgattccgttctgaaaaggggcgtactttgttagtgctgcctgcgcctgattctgacgatgttaccgaaagctagtacagcatatccctcaagtaaaatggctattgctagatcaataaaagcacgtagtgctatgtgtttctacacctccaaagccgaataaaatcggctgtcgcaccgccgcaagtatattgtactgcctgcataaggtgagatagcgtgatcccgaggctttctttgaatcttcctttccctccggagataaccaaacaaggcataaagctcaaagcccggaccaaaagcaaacagcgaaacgaaggggtagggcatcacgtcaagcaactccgctcccgccgcccaccgcccgcgcagagaaagagaaacccttcaaaacctcggctcctcgttctcccaaacccaactcaccattccaccctcgcttcgtctcggcgccaccccaggagaaggaaaggaaacgaggaggctttgcaatgggcaactgcttcaccaagacgtacgagatacccatcacgtcgggcacgatgcggcggccggcgtcgaccgcggagcgcagcaaggcgcgtggcggcgatgagccggggacgtggcggcggccgagcttcccgaggcacggggccccgccgcaccggccgccgacgggctcgtcttcggcggcgggggcgctgtcccggagggcgtccggcggcggcggggagatgggccccgtgctgcagagggcgatggtgagcgtgcggtcgctgtaccagctggaccggaagctggggagcgggcagttcgggacgacgtacctgtgcacggagcgcgcgacggggaaccggtacgcgtgcaagtcggtgtcgaagcggaagctggtgcggcgcaccgacgtggacgacgtgcgccgggagatcaccatcctgcagcacctcagcgggcagcccaacatcgcggagttcaggggcgcgtacgaggacaacgaccacgtgcacctcgtcatggagttctgctccggcggcgagctgttcgaccgcatcacggccaaggggagctactccgagcggcaggccgctgccgtgtgccgggacatcctcaccgtcgttcacgtctgccacttcatgggggtcatacaccgcgacctcaagccggagaacttcctgctcgccagcgccgacgacgacgcgccgctcaaggccatcgacttcggactctccgtcttcatcgaagaaggtcagggtcgcgatatcacacataagctacactacctctttctttctttcttttcccccctttatcaacaccatgagttaatttggctgttagaaatgcacgggtctaaagagtagaaacgtacaatatcaaagcagatgcagaaatgcatcgatcatgcatgttgaaagatcttgcgagagataatgcacgtaccttagctcgccataacaagatatgtacaagctaaggtaaaatttccccaacaacaaaacaacaaatgcaggtaaagtgtacaaggacattgtcggaagtgcttattatgtggcgccagaagtgttacaacgaaattatgggaaagaagccgacatctggagcgctggggtgatattgtatatccttctatgcgggacgcccccattctgggcaggtaaatatccatagtacatatttactctttggctaattttgctacattctatcaagtatatcgtggagataattgtcaaatttgaatatctgcgcagagacagagaaaggcatattcgatgctatactggtcaaccaagttgatttcagtaccagcccgtggccttcgatatctgaaagtgcaaaggatcttatcagacaaatgttacatagagatccccagaagaggattactgcatcgcaggccttaggtagcacacctgaattgtgtttcgctattctaatctgcggttatgaatgtaaaatttatctgcaactgtatatatacatacagtgtagccaactctttaaatggatgtctccatgctgcagaacatcgatggctcaaagaaggcggtgcatctgacagacctatcgatagcgcagtcctatcaagaatgaagcaattcaaggcaatgaacaagttaaagcaattagctcttaaggtgagaatcctccttaacagggataactactatgctttggctaaaatcaaattgacacgctgcctcctttcatctcaaggtaattgcagagaacctatcaccagaggaaatcaagggcttgaaacagatgttcaataacatggatacagacagaagtggcacaatcacggttgaagaactgaaggttggtctgacaaagctaggatcaagaattagtgaagccgaggttcagaagcttatggaagcagtaagatcatttgcttttgctaactcttcgctgcaggtttagtttacaaaaggattttactagtgatactgtggtacaggttgacgtagacaagagtggcagcattgattactcggagttcctcacagctatgataaataagcataaactggaaaaggaggaggatttacttcgtgcatttcaacattttgacaaagataacagcgggtaaaataaattttgttagccaatgcacatccttttatctcgttcagcaccatgaataaagagctctaaattgaccaacactggaacttgttctgcgcaacaatcatgttcattgtgtaacgatgtctaacacatgctttccttgcatcatatttttcttgctataaactcgtttgttaaaaaatcagtatatattaacaagagaccatgaaaaacaattccaggtacataacaagagatgaactggaacaagccatggcagagtacggaatgggtgatgaagcaaacattaaacaagtactggatgaagttgacaaagacaaggtaaagcatacctaaagtattttattttcactaattagggtcattcccatggatttaattatttcctccatcgaattcacaggacgggagaattgactatgaagagtttgtggaaatgatgaggaaaggaatacaaacctgaggaaactctctggtctctttgtgaataaatttgtatagacatgttcgagtatatgctgcaagcagatgaaacgcaaaaaagttaaccccaaaagcagttgctttggctgttgtggtttgatctagtatgtgtatttgttgataaccagtatgcaaataaaaacatatatagaatcaagaaatttacctaccgcaactccagaagactggatataccttcttttctacttttttaattattgctaacttaattcagttgaagcgtcaatgacaaaggtctgtcaggtcaatatgcacaacagtaaaagaaatataaatctcatgatcatactaaaagctgacttgaccttttttttttatgtacgaaaaactggtttgacctataaggggaaaaagggaagtgagaactggcttgaccttttttctgaatgagttgtagagcataaatctcatggtcatactgaaaagctcccagttatgtgattagagaaagaactccgagaaaggaatctgagtctttaattcgttggctcttctattgagattccgtgctgtctctatatgaggctcgtcttcttcaactgcaattattttcgcaaagtcgccatcaccaaaatagtccaccaccctattagcagcttcgagtccagtcacatatgccttttcctacataaaagttctaaattcatgaataaatttgtaatgactccaaagcattgtgtgacatattactcggtcacctttgaaaaggacccatgtcggttcactatccaatcaccagcaataaacaaatttggtaaggtagttgatcctcgcactgtgtacttgtaagaacctgcatgtaatgtaatttttatggcatatgcatcacagtaggtatttcgaagaggcaagaaagacagtgtaaggtaaattagagcgttattttataaatactaaagatgctagtgtacaactgtgcactgaaagagatcacaagtgtatgttctgattatggaaccctatcacataatcattttacaaccaatgcttgattatttttatcaagcatgatgcagtttaacgagctagcacgggtgtaagtcttgtcatcacgggtcgttcccacgaagaaagagcatcaagagcaatattcctgtaggcacttgtactgcaataaggttaaagtttgactttacctggaaggaagtgcattgtagatttaggagatc

SEQ ID NO: 700 - DNA, 8944 bp, Oryza sativa; identical to SEQ ID NO: 651

SEQ ID NO: 701 - DNA, 3122 bp, Oryza sativa; identical to SEQ ID NO: 211

SEQ ID NO: 702 - DNA, 3131 bp, Oryza sativa; identical to SEQ ID NO: 318

SEQ ID NO: 703 - DNA, 6185 bp, Oryza sativa
agtattaaatataggctaaaaaataactaattgcacatattgcgactaatttgcgagacaaatcttttaagtataattgctccatgatttgacaatacggtgctacagtaaacatttgctaatgatggattaattaggcttaataaatttgtctcgcggtttactgacggattctacagttagtttttttattagtgtctgaacactccatacgataccatatataatatacgatgtgacattctaaaactttaccgccgtgtatctaaacaccccctagtcagcaactcctatccactagcagtccaattaattttctctgtgatccggtgccctctgacccgcaacttccttttggcactaaactcgtcttatccgcatgattgttgactatagtatgtagattggcattggaagatactacgattgtatagattgacgactttacctaatacatcacccgtttcaaactttaagcgtttttagtttctttagcgaaacgaaaggtagagagaaaatattctcttttatagttattttagtcgttaaattctttcctaacatcttagtgacgggaaatatatagatttccattcattagaatatatattttaaaaaatatattacggtataaatatcaaaactctaccgatacttatattttagaataataaaggaagttatttttttccgagcaaatacaaatgcttatgagcacacctgcgaatgtgtcatctagcgtatactcatttttatcaaaaaaaaaaaacaatatagtatgttcaaatacgttgtactagaatactagattaagtatttttatagatgaagtatttgttctggttatcgagaaaatgctttgatgactaatcatatggatagaggtgtaattttagcttttttatttgtgacgtactccatccgtcgaataaatatcaacataaaactgatatgtcacattagtattaatattagaagcagttctcgttttggatggagggagtattaattttggcatgcttgcggataggcacaaagaaacagggacggtttatacttgataagcagcggcggaagcccccacgattttcagaatttgccctcctcacttctatacttcaatccccttcctttatttttttttttgggaggggccgaggcaaccgtcgccactccgacgatcccgtcccatccgccgccgccgccggagatttcctcgaggtaagccctaccccgctcctctccagcctctctccccttcggcgggcgcccagcccgagccccgacctcgatttcttggaatttcttggcgagcgtttgtttcttggggtttcctctagattttttcttttttttattattttggggacggatttagctctcgtggaggagattgggcggataatttcgtcggaggggggagggggagggggatgttggaatcgggtggtgggtaatttcgtcgattctccggtccttttccttgagtttagcctgggaattgcggttggttcttggacgcggtttgagttcttggttttttccactttctgtgcggacagatttagggcttgcgctttgcgagtgggggtaaaattcgatggtgtgctgttccagctttgtccacatactgcttggaaatttcaggaggttttttcagtcaagtcaagcacatcttttttgctagactaggccatgagatggaggttaacgtcgaactgtacccacctcagctaaaaataataataattctcaacaacagtatccaagtggctgtattgtttattcttgtttagttatgacgcagatgaatactactcgctaaagattgtgactttcttagttgtcacctcgtcgtgtggagccctgtgggttcttgctcttgacttttatcaaacaatgattgcttggcaagtgtcttgtttgattcgtctgccctttggcttgcatcgccagagtttgctggcttgcgctggcatttaatcaaaagtataatcattcccccaagtataatcaggattagcataatctttagcttcaactatttatatgatatatttggcttgtctgtagtctgtagtggccaagaacatcctgaagcagatttatcctatcaggctatcagcactaagttgatcggcacgtataggttttcttttgcgtcattctttttcattactgcatttctatggtgaattgttttcttttcttttgtatggctacatctattaccctgttgacttctgtgagcctgtgatgtactccctccgggctgataatacttgtcattttggacaagcgcacggtcttcaaaaaacaactttgaccattatttcctattataatatgtaaaaaagtgttaacaaatatatgatcatattaaagtactttttaagaccaatctatatatgtagtcaccatatttgaaagacaaatattttaaaaatgatttatataatcaaatattctaaagtttgacctcacccttgtccaaaacgacaagtattatcagcccggagggagtagtaatcttaggcatttttcagggaatgattacacagtataagtttgagtaatgtgttatcatgatatgcttttcaacaagatatacatattttttgcaacactgtttggtctaagttatctgaaattgcaattgcttgacttttcatttgggatgcgttgggcaatctattgtcctgacatacattcatcttcatttgaagccatggctttatcttttttaattcatatcttttgtttctgtttgtatgtactaaaaacttgaaatatgaatttccattggagaagttaacaccaacggagtataagcaagattatggcaaaacattcagttgttagttgtttcgttagcatatggcaccatttgtaattctgcatttcttcctttctagataagccatgggtcaagcactcggtttggtacaagtagatcaatcgacagtagccatcaaggagtcctttgggaagtttgatgaggttcttgagcctggatgccactttttaccctggtgcatagggaagcagatcgctggatatctttccttgcgtgtgcagcagctggatgtccgttgtgaaacaaagactaaggttccccagtttattttcttaactctggtttcttttatatttcatggcaagtgtctggagcaattgtcaggcatgataaaaaatggttctcaaaattcttgcattttgttccattcgtttactcctttatgataacatactgatgatggttatgtgcacatatctctgttttccttattcttcacttacactaatgcatgatgcatcaaagaataaacccaccttttctgagctctctgacgatgtataccattttgtggatatctgcaggacaatgtttttgtcaatgttgtggcatctgtgcaataccgtgctcttgctgagaaggcatcagacgccttttacaggcttagcaacaccagggagcaaatccagtcgtatgtttttgatggtaaggttcctgtatgctgtgaacattcatgcatccgatgcatttgcagttcatactcttctgattaccttctctatgttttgcctctattgttcaatgctaacagaactttcttcctcgcagtgatcagggctagtgttccaaagatgaacttggatgatgcatttgagcagaagaatgagatcgcaaaagctgtggaagatgagcttgaaaaggtttgtgttcaataattggtggtcatctagagcatagtggagttttatactgacctagtatatactctgtaggcaatgtcaatgtatggttatgagattgtgcaaactcttattgttgatattgaaccagatgagcatgttaagagagcaatgaatgaaatcaacgcaggtaagtattaattaaaacatcaattcattccatttcttcagagacattatttggcttggtgtttatgcttgacatttgagcttgcattggaaacaattttctcctgtttagacatgaaaatgttaaattctctttccgagaaacaaaaccatgtttatattgtctagttttattcaagttttatactgaaacactgaaaattgttgccacaaatatttttaggctttcaacacagtaacactgtaagttatatatagatggaacactgaaaagttatatatagatgtacataacatattatgaatattaacttcgtgaatacttgcaccataacagtcataagtaacacaggcacatgtaactgcaacctattgattacattgtgtgcaacaaaaaatgtgttggtcaactagtcaagtaaatatttcgtgctttttaagggcctgcaacatatatgtttggttggtctggtgtttttctaaagatgagctgtatggctgtaaatgtgctggacggcaacatagttttaactgctgttatttgatgatacagctgctaggctgagggtggcagccaatgagaaagctgaagcagagaagattcttcagatcaagagagctgaaggagatgcagaatccaagtacttggctggtctgggtatcgcaaggcagcgtcaggctatagtggatgggctgagagacagtgttcttgccttctccgagaacgtgcctgggacctctgccaaggatgtcatggatatggttctggttacgcaatacttcgacaccatgaaggagataggagcctcatccaagtcctcttcagtgttcatccctcacgggccaggtgccgtcaaagatatcgctgcgcagataagagatggtcagctccaggccaaattgatctaagaggatggcagggaatggatgttctggatttcttgggcattacgaaagtctgcagtaataccttatctacgtattcgatattttgtgagataaaaacttaggcaaaagaagttctattgtaagtatcacatgcacgcgtgcttcagtaccgtttgttcatagtaattcctgaggttatttccctagacgagtgtcaatatacttcttgaattgcatgtttctgtaaataattcctaagtgttaccgggctgtttggaattatttgcatgttgatgttagtgaccttaagtaatgtcccatcttattatgtgatgtcatgatgatttccagaatgctagagtttaatactgcttgtggagaaatatcaaatactccctccgttttgagattacctgtcgttcttgctgctttgtcctaagttatacttttttgtagctttgaccattaatttttaaaaattcgtttaacatcataaggtttatgttttttatttactatgaaaaatgctttcataaaatataattcacatgttgttaatctatacaaatttttaaaagttgatggttaagacagaacaaatctacaactaaaagggcccctttaaattacatgaatgaaaaaacggaggaatagaaaaaaaacatatgattctaacaagaatgtaagtgtaaaacagaggattgtaaaacacagtagaagataggaacagaggattgtaaaacacagtagaagataggaatgaccatttgattaagtcacaggaaaaacaccagaatttaaggagaaatattctttccatgaggttctaccttatgttaaattttctctaaaacttgtctgggaagagacatttcatagaaatttcatatggttttataggatttattcttttgattcaaagggatatatagaaaaattttctataagaataaaatcctttaaattttttatgaatttcctttggcctaagtatttcaaacggagggagtaccatactttttttctctgccagtgcagtgccttagagcatcaccaacagtctatctattccatcctcaatcctaattttttgggattttggttaaaaaaaactggtccaacagattcccaaaagagctctggacgttttggagttcccatctccaattttctcggtacgtgtatttgagggcgagagaacgactcccaatcccctccttccactcgaatttctaaaaaaacgatttctattggtagtttaacaatttctaaaaaaaactaaggttaacaatttatgttggtagtttaacagaagagcccacttttagtttttgagattcaatttaggtatctcttggaggaagcggttttttcaccttctattttcagtttaagggatagattattggtgg

SEQ ID NO: 704 - DNA, 6047 bp, Oryza sativa
caatttacatgcaaactgtgcaattgggttttttcatccacattttatgcttcatgcatgtgtccaaacatttgatatgacggaattttttttggaagtttgaagggagctaaacactaccctagtattggataggacgttttatagtataacgaatatagtctcgatcgcactccaaaatccgcatgcaattttaacttttcactttaacaaccatactaaatatatgttcctaagtcatgtttagattatagccaaaataacaaattttggcaagatgataatattgctaaaattttggcaggatttgttatatatttactaaatttgacaacaaactaaacatggatcatttttttgcaagttgctaaaaaatggtatagttaaaaatggcatcaaaatgaaccggccctctaatgatttaaacaccaatgtcaaaaagaaattacagtggaaaaaacctcaaaatcaatttaaaaaataacttttaagatttaaatttcggcaagaacatatacgttgtagttgtagagcaaaagaggtgaccctcgatcgcactccaaaattcgcaagcgatttcaactctgcactttagcagccatactaattacgacgcgccacattccctccaatccactggtagcacacgcacgtccattcttcgtaggcccaagatgccgagttttttttgcctaggctgtagccgccgatggcaacgtgttggtggcactggtccacgcgacacaacacaaaggccttttttgtgagggagaagctagctgctcaaagcccccggcgtgacggcgtcaatcgaagaagcgaaaacgaccgaggagcggactcggcaaagtcaaccgaccgatcgcccgcccgccaccgcgctttccagcgcacgctgcctccccccgctgcacacggcgagggggcggatcggtgtggcccaagcaggcaaagcacccaaaccaaacccaacccaacccaccgagcgagccatcccctccactacggccattctctcttcgcgaacgcgcacgcgacacgactacacgcggagcaatacaaaaagtcgccctacaccaccagcgccagccgagcagcggcaggtggtggtggtggtggtggtgttgttgctgctgctactactcttcttcccccttcctcgtgttcctcctcttcgcctcgtctctctgccctgcctcgtgcgcgtccagatccgggagggatgggggcgggggcgctgggggtggtggcgatggtggcggcggcggtggtggtggcgatggcgggggcgaactccgagggcgacgcgctgtcggcgctgcggcggagcctcagggaccccggcggggtgctgcagagctgggaccccacgctcgtcaacccctgcacctggttccacgtcacctgcgaccgcgacaaccgcgtcacgcgcctgtgagcgaccctctccctccctccctctcctcgcgctgcgctgtactgtacgcgtaggctcgagttgggtacttttgggtgtttgggggaactggatcgcgaggcaagccgtgtttggatgagcagtcgattccgttgcggccgcgttgatctagaagactagtagagctgtagttcgttgatgagaggagaaaccgatccacgaggcagcctttttagagttttactaggatgtactagattttgtaagaattttgctatggaacttgttgagattgtgtggctatgccgtgatatggctttacagttttactcaaaaggcaagtgcgctttttttattattggaccgaggaaaaattggaatggtcctgagcaaattgaaacatgacaagaatcagatagatgtatctcttttaatgagagtgttattaggtttcttggttggttgggcggttggggtgttatggttgaagaatttagatgtgagaggaatgataaggaccaaaggctagagaaaattttagcttcaattgcttacccatttgaactttcacagctttcatttcttctgtctgtcatttgtgttccaaagtccaaacctccaaaacacttactgtgcgtcagttcatgaagtaaaaaaacaatccactttactattaatctttttcagtgtggtcaaaatctatggccagttccttgtattgtatatgaagttgaattatttctcaagaacatcttcttctaattgttttcttggaatacatccctcttctaacagggatcttgggaatttgaacttatctggtcatctggtgcctgagcttggaaagttggatcatctgcaatatctgtaagcttttcttgcccatgtggtttgattctttgctagttcttctcaattattttgttttacttctaatatgacatagtttagtgattgaggtagataagataccatctcatgtccttcccaccgcactcctaaaacatgatattgtgacatggttttatacttttatgcatattctatggttgaacatttatgtaagatccattttcttttatctccaagatatctgtcaagttctattctcatacagtttgtgatgtctgagaatgatgtattgaagttttgtttagtttaatgtatgattgttagttattcgcataatttatattgatgcactttggtagtattaaccatcagcattggaacagggagctatacaagaataatattcaaggaacgatcccatcggaacttggtaatttgaagaatcttataagcttggacctgtacaagaacaacatttctgggactatacctccaacacttgggaaattaacgtcccttgtattcttgtaagtttgtgttattcaaatgatctcattgtaaaatagttctaagttctcacatgttagctactgatttcatgccgtatatgcacattctgcatacttcctccatttcaaactacaatgcctgtgtttttacattcttacttcaaaataaatacgtgtatatcatataggtttattgatccatactctcttttatctttgctgcctcttcatcatttgcgagcaaacacctacacaaactatttctatcatggctattttctgatttaacttcgttagtccctgttcatgctttataagaaataagcgggaatgcatattgatgtctttaaaactttaccttcagcttgtttgaattttctggtggtttgttgacttatgcattctatctttctaacacattattatgctttgaaggcggctcaatggcaatcgcttgactgggccaatcccaagggaactggccggaatatctagtcttaaagttgtgtaagtacaattcctggtgctgagtgcttggctgcaaacaatcttgaatgtgataaattttacccccttgttctttcagtgatgtttcaagcaatgatctgtgtggaacaattcctacatcaggaccatttgagcacattcccctaagcaagtaagtttgactgcctttgtgatactattatgatttcttcagcagtattaaagtcattatcattttatattaaatttcaaaactaatggtagcccaaaacaaattctgacacaagtttgttagtgtcgtaatcaatacttccataaggtaaattaaactaggaatttaatgttggtggccaatatgaggatcctatactaaacatttcatgcccatagccccataagtaaggtttctttctgatccctgccatttcatcatcattacatcgtatttccttctgtttttcatattcatttgtacgtatattcaatgtttccttgataacaagttaacaaacaaaatacttgtgaggaattatttttcactcattactcattagtgttttggggaggcccttcccactgtggcaaatactttattattgttccattattctggttgactactttgtagtaatatagtgtatcatccctatcttctagttttttttaggatatggcctgtaatttgaaagggcacacgtgagatctatcattgtttattgggtctttctaggaataacttttagccaaatgcccttgtgttgcaagggacttgaaataacattacaaaatataaagtcaaaaagatttatacattgcttggaaaaaaatattttcaatcaaacatcaatccagaaatagcctagccacatacccaagcaatctgtttatctagagaatataccatcttacacattttggaggctggattgaattccattgtcgaaaaacatcttgaacacacgcattggcagactcaccatcaccaacacaatatagtagagagaggtatatcacagtatgaagcagctcacctagtggctctgcgttaaattcgagagcggtttaatagttgatccatccaatgcgcttgctttgcctccccttgtgcttgcatgtttctaggcaaccttctgagtattctgtatttctctattgataaagacacataggtaggatgtttacaagtctgtcttctgatctatatgagcaagtatatatagtcttagtttctgtagacttctgtcctgcgtggatgttttctccttttgcagtgatgcatcttgcttgcattccatttcctgtttctcttatatctagttattgccctcggtggcttaattaatgttcagtgtcgatgattcctgttttggttataagtatcaacaagttgacctatgcccattatgcacattctgattacgtgcagctttgagaagaacccacgcttggaaggtccagaactacaaggcctggctgtatatgacaccaactgctagatggaaacacgaagaaaagaatgggtagaaagtaatgggcgtaaaatgttaccgaaaaccgggtgatatagattatgttaggtttggacctaccactctgtaatcctccatgcatagctcttgtttgtgctgtttgtcggcaatgaagttgtatgttgtagcagaatactttctttctgtgaaagtaaacatggaactgcttatgtcatgagtcaaatgttattgttatcacgcttccctgtgttatattgaccaaactaaagatgaaagttcttgtctgctgattatatcctttgctaatgatggcacatttatgcagcatttcccttgctgtcgctgacttgaattgtttccatcatccagtgaacgaaaccttcgatgtttggtttccgaggaacgttctattgcaattttcattatagagaatgctaaatttcagtcgtctgaagttttttttttaaaaaaaaatcagccattttaacacattactaaaattaaaagtggattactatgcaaagtgtaattttttattttactgctgcatttgcttaattcacatggttttactttcctttttttttttgttgaagtttgatatatgttttatttatttattatttttaaaaagatcttatcaattgtaaatctgaattttgtctatgatagaacaatttattgctcaaactttgattaaaaaaggaattcgtttaaatagaaaacagggggaatagtcaaaattgtgatatcaataatttaaacctagataatctataattttattaattgaaagctattaggtaactttgttttggcataaaaatgagcgtagcttaactgattaggtttcggtggtgaaatttgttcactcaagacttgacttgggtattcgtatttgcaactaattattctttcagtgatacatgacatacccatcgacattggtgtccttgtgattacttcatgaatataaagatataagatatgcatgtctagttataataggtgttcataggggtaaaatgtacgcgcgtttacatgattgtttacgtttgtattgtgtttcacacacaatttttttttggcatttacctaatccaaaattattgattataataaataaatggtaaatgtgaattttcttaagcttcctttccttttttcttacgctagagtgtccatcgtatccatttttgagtcgttaagaacacgtatataaaaagatttgcatataaataatttttatttggtaataagtgatttgaataagcatatgaataaacaaaacaa

SEQ ID NO: 705 - DNA, 5344 bp, Oryza sativa
acttctcatgaacaatcgtgctagtataccactacacttaggctgcgttcttttgtgtgatataggatgagaaagaacctcttttccgcgcgcacgcttcccaaactactaaacggtgcgttttttacaaaagttttctataggaaagttgctttaaaaaatcatatcaatccatttttaaaatttaaaatagttaatactcaattaatcatacgctaatggctcacatcgttttgcatatctttccaatctccccaatcttcttctcctcaaacacaccattattactgtctcacatcacatataatcaaacaaaactgagtaatatatgtacatatagcactaaatcaagcaggtaaaatcattgctcataagcgtagaccaagaaaccaatccaaatcctcttgtcattacagccctgtcacctcaagaaatcatggaactgttcccccacagcgcgtcccgttcctcttccgatctccaatcaacgataccacacacaatccatcatccatccatccatccaccgatttatcactcagacatcgacgactatccatccaccatcaaaccaactatccaagcgaggagtccaaccaaaagactccatcgtaaaacaacatatttacaaacgaaaaataatttataaataaaactcatatatacatattttttatctaaaaaatactaaaaataaattatgataaaaagaacccaaaaatcaattttaaatttaaagttttgacttataaatataaacataaatcaaaagacgaggccgcaaaccaaaccaacccagtccagtaaaccgcaccgccggccggtgccttgcaaacgacgactcaccatcaccaccactaccacccgccgcgttggtcggcacgtcacacaaacacacacgtgcgcgcgccgcaccgatcggacggccaggatcgcaccggccgcccaaccgacggctgcagattccccccacggggaatattcctttcccccacctctctcctcttccccatccacacctcacgggaagctgtcccttctcctcttctcctcctcggctgcggccacggcgacgacgacgacgacgaattcgagcgaggcgatcggcgatggaggcggtggcgatctgatccgctcttcccgtctcggcctcgcgctcctctccctccctcgcggtgtctcggggtgaggggaatcttttgtttttgttttttttgaccgtactgttctggctgggtgtttcttggtcgtggtccaagatcggcgggtggtttgtttgtccgggctccatggatcgatctctctctgttgatctgtgtagctggagaagctcagctccgtgggaggattacgcgcgcgtgattggttgggctgtgtgtaaatttggttgccggccatttttgtgctccggtggtgaatttgggtggtgaggctgtctgcacaatccgtggcgatgagctgggaaatgtgatgggggtgtgctcgtatcgggatgatggtgggttgtttggttgacccggatgagtgatgatgattcacaatcttgcatccatgaaccgtgggatgggtgtccatgtctttctccgggattgggaattggtaccaccaccatggcggttctaaaggcgggaggagataaatgcaggcggcaatgcatgcttggtgatggagcatctgtatgagtgtgcggggatcgatgctccatgttcattcagaaccatagccgagcaactgaaagctcatcttgaagactgggactgcgtttaatttatagctcatctttgattacaaagttgtttgatcttctgcattcatagatagtttggcagttgtgtaagctcaaaaagccgttgttatttcctaaggtagtactaacttattttcttttgtttccttagtaggaaatggcgatcatggtggatcctccaaatgggatgggtaaccaagggaagtattactactcgatgtggcaaactttgtttgagatagacactaagtatgtgccaatcaagcccatcgggcgaggagcttatgggattgtttgttcatccataaatcgtgagaccaacgagaaagtagcaataaagaagatacacaatgtttttgacaaccgtgttgatgcactaaggactttgcgggagctgaaacttctccggcatctccgccatgagaatgttattgctttgaaggatataatgatgccagtacacaggaggagttttaaagatgtgtacttagtttatgaactcatggatactgacctgcatcagataatcaagtcacctcagggtctttccaatgatcactgccaatattttctttttcaggtaatacctggacctctcttttctattctattctacatttacttactcaagagtaattgtgtgtttttaatggcccttgatgattgcttagaatttgtgacagtgcatcttatatcggcaagcctcatccagtcttataagatggttcattcccaaatgcacgaggcacaatcttaacttgaatggttcttctgtcagttaaaacttcaaagtcaaactgattttttaaacatgtaaaattgtgaatgttttgcttcagcaatgatttgtgagcatgtcaatgacaatacttttttgagtaatgtattcctaatttgaaataaccaatgtaacttgtagtatcattcagtttgattccagttgatttgatgtttttgcattagtagtatttgaaaaaaactgaaaaaatggcctactatatttattccaacccagattccaacagtttagactgataataaatagatggaaggcaaaactatatccctgtagtctgcagctttgagacaaactaaactacacactttgtgcattaagtattgccatcatgattcctctttttatacattttattttaatttgtagagttgaacatttattttcatgtgtcacaggcacaacatccatgcattcccttgttgcctcatcaagtacataaaaaagcagctattctaatgtccgttcaacctaaaactggaactggaaccatctagccctttttagatttccatctattctaacttattttattaatttcgttaaaccacatttccattaagaatttcatatacagttcataatctaaaacctagatcttctttcaaatagttctgcatagaggcttctgcatgaaaccacacaagtagaccctcttgtttacaagacataaatatttttctgatgaattgtctgttcatcctacccttcagattcatttattctgttgtcttgagttcattttggattgtctaccatgtatttcttattttttgcaatccgtattttccagatgatttaagagaatgttgttttcttgattgtagttgcttcgaggactgaaatatctccattcagcagagatactccacagagacctgaaacctggaaatctactggttaatgcaaactgtgatctcaagatatgtgattttggtcttgcacgcacaaacagtagtaaaggtcagtttatgactgagtatgttgtcacccgctggtatagagctcctgagttgctcctttgctgtgacaactatggcacttccattgatgtttggtctgttggttgcatcttcgctgagctacttggtcggaaacctattttcccaggaactgagtgcctaaatcagctcaagctcattgtcaatgttcttggcaccatgagcgagtctgacttggagttcattgacaacccaaaagctcgcagatatatcaaatccctcccctacactcccggtgtgcccctcgcgagtatgtatccgcatgcacaccctcttgccattgatcttttacagaagatgctcatatttgatcctaccaaaagaatcagtgtcaccgaggctcttgagcacccttacatgtcccctctgtatgatccaagtgcaaatcctcccgcgcaagtgcctatcgatctggacatagacgagaacatcagtgcagatatgatcagggaaatgatgtggcacgagatgctccactaccaccctgaagttgttgcagcaatgagtgcccgatgatcttcaactgtccccaggaactttgcaggctcacttttttttcttcttctaaaagcctacggcgattatcgcacctattaagtaaccaagacgtgcaagacttatttcatgtatatatgagcgaaataagaacgttgttgtatccatatagttcatgttatggaccattacttggtgtatgcatttcacatttccactggacagttatgttgttgtactagttcatgatgagaagtgctattaaagtgaattcagtaatgctgcgaagtgttaattctggattatgttataattttttgcggttactgcttctttagtggtgatctgctgcaagatctcttgtttctactttcagaaacgtatggtgtggcctgcagttttgaacttgcgtaatatggctatgaattgacttacctttgtgataattcatcctgaaaacaaatccgctatgtctgcagtactagtaagaatttggagacacaatttgtttcaggttttacaaggctctgaaaataacggcggcaatcagtgcgccgtgtatatcatcagctaaagctaacattgctctgaacttggttaaaattgtgatatatctaaatctttcgtcaacgcatggatggctatcacaataagccgaaacaaagcgatgagccatcagtccggcttcaaaatatgcagctgatgagctgaagatagtgcagaggatcacagaaaatatcacggtatatgcagcataaatacaattacggattgatctgcttttgtgatattgcatgctgcaagattttagagtggtatttttactgagcttttgtttcagggtgacgtttttccaaagcccgttttttttagtggcgtgtaggagtaaccactgaagattccattaggagcgcagtattgcatctagtttcagaatggtgttgatttccgagtcttgatttgaggggatgtttttgaaggtaatattctgttaaacctgttgtttcttagattactactacactaactaataactgcactgcattttatatttttattgcatggagttcttagctgccttcctgcagcagcagaacatgaatttctgaaaggcgttctgctgaacatgaatttcagagagcgcagcgtgctttgtcaagtgcagtttcttagtttcaaatctcatccatttcgtttgatttgctttgctatgaacatttcaaagaacgtgccgctcaatcgagaatttgaagctgtagaaatggattaaaaaactgtatattctaacatcactttatttccttc

SEQ ID NO: 706 - DNA, 4755 bp, Oryza sativa; identical to SEQ ID NO: 352

SEQ ID NO: 707 - DNA, 5913 bp, Oryza sativa
taatggttaccaatatgttgctctcctaacggtttgagcctaaaatacgtttcctttgtccttctttttgaaataataatttattcttcatgccttcaccatgttgatattgattacatttttaactttgtagttcgtagtaccatttatcttaaactattagttgtaactacttttattacttgatattggttttgaattaacatttacatatttcttggtttgtgtacacgtttttgtaacgtcccgcctcccccaggccgggcccacttacatctggcagctttcataggtcatagactgtcctcacagaccaacacatgtcttttctgcacactttgtcctcactcgtgtacacccgggaagaatttcccggtcggtcacccatcccaaattgctccaggcaagaagttgcaacttgttgatatgagtattctattaatcctattaagccctaggccgggatgttacagttttatagctaaaatacgtcttcttaagacatatatatatatatatatatatatatatatatatatatatataaatacattaaatatatttttaaagtgtgtcattcaactggcggctcgaggattcgacatcaggtcggtggcccgaaatctccaccaggtcgatgaatggattgattttgataacgcatatttctagatgtctacgcgttatcagcatgttgatgtctacgcgttttctaactaaagtcttttttattttgaaagtatatacaaatatattcaatctaattatttttaaaatataccggtgacccgggacctcgaccggatcgatgtcatgtttacaattcccccacccacccacagcccgacactactttgtccgaagtttatttaaaaaaactttttaaaaaaatatttaaaattcagaagaaaaaattgttccaaaaaaatccgaaatttccaaagatattttgacgccccaacataaataaaaaaaccgaaattgcaaacctggttgtgtttgggtgtgatcaccctttgattgacccgcacccgcatccctttcccgcaaggccgcaacaccgtccgtcgccgcctccgcctcgctccgatccccattccgcggtcgccgcccgagtcaaaaagagggggaagcttctcccaccatagtcctcctcctcctcctcctactcccatcaacgactagtcgcggcgaccaagagccaaaccctacgcctcctcccctccccctccacctcgtcctccccgcgagcggcggcggccatggattcctcctccggcggcgcgggcggcggcggcggcgcgcagatcaaggggatggggacgcacgggggccgctacgtgctgtacaacgtgtacgggaacttcttcgaggtctcctccaagtacgcccctcccatccgccccatcggccggggcgcctacggcattgtctggtgcgtttgcctcgccctcccctcccctcccgagttatgcgtgtgggtttactaattaatagcgaatccgagttgctatttttgttcgaaaattcgcgagggcgtttatgtgttcgtgacacatcgcgtagatttggctccggatgttgtgttttaggcataaggatgtgtgggggaaatgggtcacggcggcccaaaaatgttatggtttgactgcttgagtagatgtgattatattgtagtagtaattttgtttttcctatttgtagcgcggctgttaactcggagaacggcgaggaagttgccatcaagaagattggcaatgcattcgacaaccatatcgatgccaagcggacactgagagaaatcaagctgcttcgccacatggaccacgagaatgtaagagctgtttgtttaaattggttttcgacattcctagtgattattgatcgaacttggccttaccactattaggtaatttattgggtgtgatttacatttagtttacattggtaactaacttttcctaaggacatttttcgagtgcaaacaccatattccataatttgttagaaaagcggcagcaacactttagacctttctgtagttacttacttgcttgtaaagagtgcattactaattgctattattggttatgatagattaattgtactccactgaaagatcatcctatcccttatattccactcattgcttcactcatactctgctatcaagttgtgtgactagttggactagtcgacaagtcatccaaggggcatgacttaacttgttggcagcagaagatgctatggagtaagggcagcatcaatgagccactattgagcaaattgggcctcgcttgggaggcctggtgcatcgggcccattgttaatgagtgaaacagagaggagaggcaaacagattaacagtagaggcaatcggtatatatatgttgtaatggtctaatagaccagtcaaccagaacaatagtcctaactagccacaactagtcgggcaagtcagcagagggatgactcaactcgactttacgatttaacaaccttgcactcatgtgggccgtaggggatgtcaacactcttatacttacaaagaactgctatgctacaagtggaatacttcatctttagtcgtttcattactaagtcatagtagtgccagatccaagccaggatgttgtacataaggagtaaccttgggctcagctgacaccatatgtttattaggtttctatctctacaggtagttttgtttgctttatttaaacatacaaactggaatgtggttttcactttctgttatttccttttttttttgttgggcggtcaagagcgtgtgatacatttttgactcacacatttatatcatatagtctgatggtgattttaacactggatcacagattattgccataaaggacataattcgccccccaagaagagacaactttaatgatgtttacattgtttctgagttgatggatactgatctccatcagatcatacgctcaaatcaaccattgactgatgaccactgccaggtttgttgcttccagcttgtgctttgctgaaacattttgcttgcagaaaatctagacagagatttccatgcaccttgttcctttggtcgctatatgttttcttcatcctatccatatttcagcttaacattctcttgtttatctggtttaataatcacaagtgacatgttttgcattgcagtacttcctgtaccagttgctacgagggctaaaatatgtgcactcggcaaatgtcttgcaccgtgatctgaagccaagcaatttgttccttaatgcaaattgtgatctcaagattgctgattttgggcttgcaagaaccactacggagactgacctcatgacagagtatgtggtcactcgttggtatcgagcaccagagctgctgttgaactgctcgcagtatactgctgctattgatgtctggtcagttggatgcatacttggtgaaattgtgactcgtcaacccctgtttcctggaagggattacattcagcaactaaaattgatcactgaggtaaggcttgtctggttcattgcttgcatacttttaatgtctgcataaacgtaattttttatttgtacttgaataagagatacattacttgaactctgaatatgtaaatgtgtttttttttgggtccatttttttttctgttttctttgcttttctaaaatgtatccctgtaacccaagtggtatcaatattaatcagacccttttctcttcaaaagctgatagggtcgccagatgactcaagcctagggtttcttcggagtgataatgcaagaagatacatgaaacagctaccacagtacccaaggcaggacttccgcttgcgcttccgcaacatgtctgctggtgcagtcgatctgttagagaaaatgctggtgtttgacccaagcagacggataactggtacattgactttacaccaactactccacttttgttgcctttactgtaaattgaacattatttttccatgcagttgatgaggctcttcatcacccatacttggcttctcttcatgacatcaatgaagaacccacctgcccagcacctttcagctttgattttgagcaaccatcctttactgaagaacatataaaagaactcatctggagggaatccttggcatttaatccggatcctccctactaagagctcaggttcgttctagagaaccaatgatctaaaatattgtagatggctaattctagcatcctgcagagattttttgaagacttcatatggatagttttccagattgactaatttagaccctgggagaatgaatgttcttttaaagccaaacaaatgcctattccactgcgattttatactcgtaatataccattgcataaaattctgttcataactcaagtttatgagacaaaactattctatacctttttgccacaaatttcatgttttctgataattctcaacagtcaatatgctcacttcaccattttgaatgttacctccctgttaagatctgctttgaagaattcaaatgctaatttgccatacctgcacatttcaaaaatgaaattcctcatttaatctctaaccttttgcatttcttttgccttgagtgcagagcaatttatcaatgctggcatctgaagatcggtagctctagaaaagccaaatccccttgctttgtgcatctattaattttatgcccacttgttgggcgaatgagcatggattattgttatagtgacaatttttcttaaggcctgtctaaagaaacaacatttgtattccttatcagatagcctgaacttgggcctgtattataccggttgattgcataactgttcttatgtatctaagcctgtaattgtcttcacaatggcttgaactgcccgtgtatatctgagttgacatcttctctctgatattatcccatccatgttatttccatttcggactaatatcttaagttaacactgattctgctcattggtacagtgctactaggctgtcccaatgtagaggcatggacaaggatccggtgcagtagggaaacgtcaaaactttacacctttgaatctaaacaccccccagtggggacacgctaaaactttacacctctgaatctaaacacccccatagtagatactctttataagaaagaaatttgaaaatatactttattttttcatattgtgcgtttatatacctggctgtgattaatttgcaaaaatatacccaatctgcggaacggttgcgcgggaacgaggacgaaccgcagactgggaatgaaggagcggaacctgagccggtcatgcggaaccaggaagcgtgaccgagccggtcccgcaggccgaggatgcggtactgcgccggtcccgcaggacgggtgagcgcaacgctcccgcatgctggatgtgcgggaccggcgctcccacatgccgcccacatctaggttcccgaattggatccaatctcctatgcacggaaaacggagcaggccattagcacatgattaattaagtattagttatttttttcaaaagtggattaatatgattttttttaaataactttcgtatagaaactttttacaaaaaattacatcatttagcagtttaaaaagcgtgctcgtggatgagttggaaaaattgagggaagaacacagctcaaacaacacacggaaagggaaggaccacgggacctgctcggttctgcgtgttggaaccgcgggacaacaccggtcctgtgccgccgttctgcggtaccgccgtgcctgctcgcgatcccaagggctccatcacccccgcgcatcggcgccatggtaccaactcgggtcccgcagtccagtcatgcgggaccggctcggtcgcgcatcctggttccgcgcgaccggctcgcgttccgctcccgcatccctagtctgcggttcgtc

SEQ ID NO: 708 - DNA, 6657 bp, Oryza sativa
catactacttcctctgtccaccaatgcaagagatttaaactaaaaattatccataaacatgtttagagtgtatacagcttcaccgacccactggtagtttagtcatttggcttttcagtaagcacttgattaattaattattaattactataaatttgaagataaatttatttaatattgtgaaaccttttatttagaaaaactaaaacacactatttagatgttttggagtttgttaataaaaacgagggagttatcatcctaatatgcaaaaataaactaagccttaggggcataacttcaaccttaaactttgctaatagcctactcctttcattataaaatatactagtaggtctttactacaaaacaaacatatgataaaaacatatttaatgttagatttaataaaactaatttaatattttaaatagtactaaattattctataaatttggtcaaacttaacaagtttgacaaaagaaaagttaaacgactcataatatgaaacataggagtataggttattacagttgagaagaaaatatctgggtgtcacatgagaacttgttgaggtgagaggctagggtaagataaaaagaaatttaaaaagtggatgagggaggctagagtataacacatagtattatgtattatgaatactccttccatcctaaaaaagctgacctagttagggatagaagataacatagtacgatgaatattcatgtctagacttgctacgttaggttgtgttccatccttattttattttttttatgaagggaataatttctctcggaagagaggaggtgtgtaagccattatttgtgtggaagcaagaggtatttacgtttgttggctttcacgaggcaccaccaattgtgcattgtcagttactccagtctggtcaacgaaggaatgaccttgtaaaatccctaaatctacaggtgcaatgtgcaaaattgcggtttgcacctcactcctcgttttactactccatccctttcgccttcgacttcctcgcgccttcccaccagctcgggcgggaggcctcctcctcgcctcgcctcgccacgccgcgccgcgacgcgacgcgccgtggtcagctggtcgccggtgcgggtgcgggtgcgcaatggagccgccgaccagccacgtcaccaacgcgttctccgactcggacagcgcgtccgtggaggaggggggcgccgacgcggacgccgacgtggaggcgctccgccgcctctccgacaacctcgccgcggcgttccgctcgcccgaggacttcgcgttcctcgccgacgcgcgcatcgccgtcccgggcggcggcggcggcggcggcgacctgctggtgcaccgctgcgtgctctccgcgcggagccccttcctgcgcggcgtcttcgcgcgccgcgccgccgccgccgcaggcggcggcggcgaggatggcggcgagaggctggagctccgggaactcctcggcggcggcggcgaggaggtggaggtcgggtacgaggcgctgcggctggtgctcgactacctctacagcggccgcgtcggcgacctgcccaaggcggcgtgcctctgcgtcgacgaggactgcgcccacgtcgggtgccaccccgccgtcgcgttcatggcgcaggtcctcttcgccgcctccaccttccaggtcgccgagctcaccaacctcttccaggtccgcctcttcgcagctgcctctccttttccccttccattcgcgatgctcatgtcatgccagttcatctcttccctgtgcttgcttggatgcgtattgctcatagaagtgggggtttaaagatgcatttttttagttgcgcgcgtggagctttgctttaggcggcaaaatgaactacttctgaaggagaggggagatggtctgaactgaatcactcctaatcacgttaatcattgcaatttggattactgcaattggaggcctgtgataattgcattgtgattaacttgctgtcatattggcgatgaacagtattcaggtttagttgtttgcgattttggggattcacgtgtgcttggtgctgtatgcattgcagagaaaaacaaaagcttacagttgtatgaacgtgtggatgcgactccctgcttcaattagaaatcgtccaaaaagctagtacatcttaagccattaatcaactcagatcatgcactgttacatcggttatgtttgatccaatcctcctaatcagtttattctaatgtctgaatcgaactgcctggctaactgtccttatctaacatgttgctgcttactgatcttgggggtgcttgccgttctcgttgttatttatcggattcttcttggtcatgttgacgcgaaaatggaagttaactgtgtttgatatccagcaagagtggtgctgatatagtaaaggtgtttcttaaccttttcttttcttgcaaaagagcagttccttattgaagtatcttcagataaggcgattggactgtgcaccatcctattctaggctgcttcaagtacacatgtttcactcaattgtaccatgatagggacatactcacataccgcacattatccttccaaatttgtcaatgctgcattaatgtgacagtgatatttatgcacagaaagcacaatcatatgttttccacttaaacttgactgtatctcagtgtttttaaattgaaatgtcacacatattcgaagcaataataaacgaacaacaaaaaaaatatgcatgtatcttatggtaaaatttgccttggctatattacagggggaaaatgagtggctacactccaatcacagcatgtttatccaagaacacaaaaggaaatttcaaaattttaaatgtaaaagcctaaggtcactaatgtttatatatatatcaacttttattctctttacagtctttggaagttgtttttaggagttatgggggttgtttttcagtaattctgtctcaaaattatattgcttgcgtggctgcgccatacgtgccaatctgacaagaaccaaacatgattgtactaattgtatatatagcctagcttcctttggtccaattgatggccctcagccttgtatttatatttataaatcttctggcgttaacattactctacattgaacttgctatttcaagtattatgttggtgtttggcttgtaatattttggtttctaaaaagaattaaaaccaggaagtttccttttctaataaaaaatgggccttgatgctacttgcttttgttgacctttgttttagaacgtggtactgtttttttcagataaggctgttccatactgaatccattaattattgctagcccaatgcatgtcagtcggttatcgtttgtaatgtttcactattttaagaagccagaaccaaagcaatgatatattcttctttttcatgcagcggcgtctccttgatgtccttgataaggttgaggtagataaccttctattgatcttatctgttgccaacttatgcaacaaatcttgcatgaaactgcttgaaagatgccttgatatggtagtccggtcaaaccttgacatgattactcttgagaagtcattgcctccagatgttatcaagcagattattgatgcacgcctaagcctcggattaatttcaccagaaaacaagggatttcctaacaaacatgtgaggaggatacacagagcccttgactctgacgatgtagagctagtcaggatgctgctcactgaaggacagacaaatcttgatgatgcgtttgcactgcactacgccgtcgaacattgtgactccaaaattacaaccgagcttttggatctcgcacttgcagatgttaatcatagaaacccaagaggttatactgttcttcacattgctgcgaggcgaagagagcctaaaatcattgtctcccttttaaccaagggggctcggccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctcttgcaatggcaggtgagagtctacgaggaaggttgctgtatcttgaaaaccgaggtaaccttcacatatatcataatgggttcataatgctggtttctttggaattaactgtttttggtcttggcaacaaaaggaaggttacatttcagtttagtgtgtttcatgcagagtgcagtttcaagagtttcccagtgcccattttttagaacttccattttgttatgaagttgtatcttgatattatagtttttgtacgatgtagttgctttggcgaggattatgtttccgatggaggcaagagtagcaatggatattgctcaagtggatggaactttggaatttaacctgggttctggtgcaaatccacctcctgaaagacaacggacaactgttgatctaaatgaaagtcctttcataatgaaagaagaacacttagctcggatgacggcactctccaaaacaggtaatacacggcactctgtttattcacactgcctccaagcgatgtatattttgaatctaatgctacaaacttgtgtggcacactgctacacatgcaaatatttttgatttttcatattttctgatggaagctaaaactatagatgctcccattttgactgataggttcactgttgaataccctgagaggtttatgcaatgttgcatatcttttagctctaacactgtcaatgtgaaccatggacaattttgctcttttttgttcattcagaatgatagttcatactacctgaagattaaataattgacaaagatatgtacactttactgtggtaatttctaattttaatctggtcttgaataggtagcctagttaatctttcttggggtgcatgtgttgtctatagacttttgtggttgaaaaatctttgtacatcaagagcacagaatatacttaggtatatctataggaacaactgcttgagattcatcacagaagttgcaaagacattacattctcttaattggacatagactaattgcaagctgaatgtgtataccagtggagctcgggaaacgctttttcccgcgatgttcgaacgtgctcgacaagatcatggatgatgaaactgatccggtttccctcggaagagacacgtccgcggagaagaggaagaggtttcatgacctgcaggatgttcttcagaaggcattccacgaggacaaggaggagaatgacaggtcggggctctcgtcgtcgtcgtcatcgacatcgatcggggccattcgaccaaggagatgaacaccattgctcccaaatagttgccatattgatagctaactgtcctcctggagctactcacctgatggttgccttctgtcaattgccccccaaatatattctcaatggtttaggcttgtacagtattagttcttacagctattgccccgtcaattgtgaaacgcagaagtttcactagtgcttgtactcgaggtgtaatacaagtgcttgaattttgagttgtacttggaatttccagtggtttgctcgtaaaaatgagatgatttcttggctcccaaatctgatagactgatgaaatagactctctgcttgctagtggtcaccagagatggctgaaggccactgaagcatctactctaccagatatgcactaaaaactacactgtacttgttacatctggatgaagcagtagaacagtaaactcatctctttactgttccctctgccatgtcgagtggtaaaaatacaaaattacatgatggatcaaactctgttctttactgctctctgtttcaagtttcaactactaccaaactgtggccaaatgccgttaatgcgaggcaaggacctcctcctgaatactgaatgcagcagctagcagacgaatgcagcataggaactccaaaaagcttgagccctttttcctaaatcagctccaatcctggcgcgtaggaggagtagccttttggcgcgcaaccagggtccatcgcatttgcatgcgttggtgtcaaccacctggaaattgcactgatcgtcgccattgcagcagcaagaaggcaaggaaacctcatccaagaaatctctgaattctgaagagctctagtttctgaagagttcagacttcatagtagtagtagtaggtagctgaaagaattcagcagagggtggaagtgcaagtgcggctccgccatgttcgatccatgaggattctagctgatgctcatctctctctttctctctgcattcgcctttgatctccaggctgctctcctcaacgatcctgtttgtagtttaaaaaagaaaaaaaaaagaaaagaaaacaccctgtttgttgtagtacgtgggccacctggtccagcactgtacgcagttgctctcaagaaagcatcttggcccggcccaatcatactgcggcccgctaggcctctcattgtcctgtgtacttgctgactcctaatcatggactcatatatggtcatggtttcgtaacttcactattggggttttaaatatcggtgacgtggttgtacttcaccattgcataatgtaacttagggc

SEQ ID NO: 709 - DNA, 6657 bp, Oryza sativa; identical to SEQ ID NO: 708

SEQ ID NO: 710 - DNA, 4055 bp, Oryza sativa
agtggtattcttattattagctccgtgctctagttctagcgaattagaggctaaccaaacggttttggctctgattgctgaaatgctataacgtcactagtaaaaactgtgcgccaaaacctagcacatatgaagcaaacacattcagttttccaaaaaaaaagagagcaaatacattcatgtgatttattgcattgaaacatggatagctctataattacccgtcaggtgcaacccacacaaaacaattatagctatacctgtaaaaaaaaagaaaacacattcttccatcttttgaatgaacacttaggagtaacttagttaattctaacctccattacaaaatcgttataatcggatatcactgatacccttcaacttttaacacaatgattgtttcgcttatactcataataagccgtaacgactattcaacaaacaactaaatgtaattcgtaaacaaaatttttatatatgtgttcttagcaatttaaaaaataaatatcgaaaaataaagtaaacaacttaagtgcgatttataaaatttgaatccaatttaagctttaaaaattaaattttatgtgcgatttacaagctgaataaattttgggtgcagtaagctaatttaaacgggttcgacgaccgcccttctagagtgaaaagaatgtacggagcagtaaaagtttctgggcactgtagtcgtgcctctgaccaaacggcccttctagaagccgtacaaagaccaacaaaatccgcgcaagacgaggcccccaaccgcagtcccaggtagacctgacgaaatccacccgatttcccccaatttcctccccttttctattgcaaacatcacaaacccctgtactacttcgcatcgcaccagacgatgattccggtccacgcgacacagcgccctcaatggcctcaaaaccgtaacaccaccactaaaaaatccaagtaaaacgcggccattcaaaaattttctcaaccacaccgtgaccgtgcgcttctcgcctttcgccttcgcctccaaggaagccggcggccgcataaaatcccctcgaatcaaaccgcaaataatcccccccaatatctcacgctcccccctcccctgctttccctcgcgcaccgaccccactcggatcctctcctcccctcctcactgcctctctcccgtccacgagcggttggtcgatcgatcgatcgatcggcgcggtccttcgccagccatggcggcggcggcgatggcgccctcgcctccggagccggcgttgccgcgggagctcagcctgggggacctcagggcggtgtccatgctcggccggggcgccaagggcgtcgtgttccacgtcgtgcccgcggcggcgggggaggaggaggcctccatggcgctcaaggcggtctcgcgggaggcggcgcggcacaagaagaacgggagcggcggcgaggacgggcaccggcggatctggttcgagcgggacgtgctcatgtcgctgcgacacccgctgctcccctccctccgcggcgtcctcgccaccgacgccgtcgtcgggttcgccatcgaccgctgcggcggcggagacctcaactcgctccggcgccgccagaccgagaagatgttctccgactccgtcatccggtacgcttctcgcatcccccccgtttggccatcgccgcttctccgccacccacccgcgcacgaatgggttaactaaccacctcgccgttgttgattgttgcttctgattgcagcttctacgccgcggagttggtgctggcgctcgactatctgcacagcctcggcatcgtgtaccgcgacctcaagccggagaacgtcctgatacaggacagcggccacatcatgctcgtcgacttcgacctctccacgaggctcccgacgccgccgccgccaccggaggagcaggacgcaacgattgctgattccatgccggagcctccgcccagttcaccgtccccgaaccgcgcgaagggcaagaggcaaccgggggcggcctcgtgcttcccgttctgttcggtcggcgccacgaagccggccgcgtcggcggactcgccgtcgccaacgtccacctcgcgcacggcctcggcgtcgtcctcgtcctcatcctcgacggccaccaccgcgtcgtcctccaccgccgctggcgtgcggtcgccagcgaagtcgaactcgttcgtgggcacggaggactacgtggcgccggagatcatcgccggcagcgggcacgacttctccgtggactggtggggcctgggcgtggtgctctacgagatgctctacggccgcacgccgttccgggggctgaacaggaaggagacgttctaccgcgtcctctccaagcagccggagctcgtcggcgagaagacgccgctgcgcgacctcatcgcccgcctcctggagaaggaccccgagaagcgcatcggcgcgcgcgggatcaaggcgcacccgttcttcaacggcgtcgactgggaccgcatcctccgcgtggcgcgcccgccgttcatcccgcccccgccggaggacgaggacgaggccggcgaggtgctcgacgtcgagaaggtcgtcaacgaggtgttcgcggccaatgacggcggggccgcagcgggtgtggtggagaagccttcgccggaggcaggtggaactctggccgtcggcgatggcgagcagaggagagatccgtccaaagaaggcgatttctccgtatttttctgagcgtatttattgagttcttttttagcgttctctctcttaaaaatggaaaattacatagctattttggttttttctatggactagaattattatgggggtctctattagtaatagacataattaagacaaagtacggcgcggtggagtacataaatcgactttgctcttgtgtttaatggagtacagtctgtatagtatttttcccctttcccttttattttcttctttgttggatacatttccccgtgcaacgatgcaagctaggggattactgaagagtgtacataaggaatgatgaacagcaaaattggcctaatgttgtgtccatccatgtgttccatttcgctttgggtagccattgatgttaatacctgttacttcctttcagtgggagtaatagaaatggtcacggttttgtacatttttctgcaacattctctcaaagtagtaaatgctttgaagtgcccttgcgccatcaatgaggtacctatgcaaacagaaaacataatccatggctggaaatgaggtactggggtcgcttgattgatggttaactttgttaaacccagataaggtgtgacttactgacttgtcacaagaagtatggatagccacccttacacaagcttaagagaaaaagaaaaggtgtatttaacacgtgggtcacatgaaaaatatggttagccatacgttaactcaaacaactgattaagaaagtgtaccatgtctaaagtttggtttggcaagttaaggcttatactcactatctttaaaaggtcaaggtttataccgttctatatcgacgtggttctggcaaaaaaaaaggtttatataaactcttttttactcctgcaaaatgcaccgtagtaaaatccctctgggacaccatagctgtgctccatgtggctgacaaatgcgtttgagctgcccacgcagtgaaagttttccgggactcagggagggtgcccacttggccaaccaccgtccctctctccattggcacgccgagagaggagccctcggattcactcatcagcacccactccactggtcgctgctccagtaccaaatgcgtgatggtaccaagcttgaatgcattctcaatttctcatcaggcttccataaactgacatcgtactggggatcccaagtgttttggggcagtagtaaagtggtgactgcgcggccgcacatgcgcggatgcccgcgcggttggtggcgtcgtaaattttggctcctccaccaccgttcgctcgatcaccgcctgcgctgcagcttccgcgcgtgaaacatcgcccggccaccggggcggcgtgagcggctgaaa

SEQ ID NO: 711 - DNA, 3827 bp, Oryza sativa
cctctagataatccaaattatcatcccagattctgaaatgaatatctacaaaatttaaaaaataaactagtggccatgaacttagcttctcactagctggatactcccaatggcttctcgaaatctccacctctctaaggctgagtttagtttcaaaattttttcttcaaactttcaacttttccattacattaaaacttttctacacacgcaaattttcaacttttccgtcacatcgttccaatttcaaccaacctttcaattttggcgtgaactaaacacaccctaaagtccaaacattgccaataataggtatagtagtatgtagtacctctctttattaatctaaagactactagatctattttaggaaacttaagattttgaaaaacatccgataaatagtcagtgcgtgagaatatgaaaagttgtgtttagcagctcatggttttaaatttatctttttttaattctataactacaaattctcataaacagtgccctatattcctagctactacttctatctttaaaagaatgagttttaagctatgaaggtgaaaaaaaaaggacagatgtacacatgcagtagtacttgattactatggtctatggacgttacgaaataacaagtgctgtgtgtcactactctcgtgaatttgctcacctaaactagacggagagagacccagaaaagaggataaatcacggctgcacaattttataatctgaattgatcatggcaaattggcattgctgcttacttaattaaccactccctagctaattggagtaggtaatagctatctactaggagtcaaaatcaatcaggaaataaatcagcttgaaggccacgacaactacaatgttggtgaaaccaaattacatttgtgaacttcgttttttgacagtattcgacaacttaaaactgaataaaaattatcagtagctcgaccacctgacacgcgagcacagtataaaaaccgtccaagataaccggggttgctcgtgcaagcgtatcacagttcacaaaagcagcacagagctagtctagtggcagccatggcgagctcagagcgcggcggcggcggcggcatccacgtcgtcttgctcccgtacccgagccaaggccacatcaatccgatcctccagttcggcaagcgcctcgccggccatggcggcgtccggtgcaccctcgccgtgacgcggttcatcctccgccagggcgagccgccgtccacgggcgccgtccacgtcgccgcctactccgacggctacgacgccggcggcttccacgaggccggcagcgccggcgagtacctgtcccggctggagtcgcgcgggtcggacaccatggacgcgctcctccgcgccgaggcggagcagggccggccggtggacgcggtggtgtacgactcgttcctgagctgggcgccgcgcgtggcggcgcgccacggtgcggcgaccgcgtccttcttcacgcaggcgtgcgcggtgaacgcggcgtacgagagcgtgttcacgggccgggtcgagctgccgctcgccgccgacggcgaggagccgctacggctgcccgggatttccgtcggcctcacgctggacgacgtgccgacgttcatggcgaacacggaggacagcccggcgtacctcgacctcctggtgaaccagttcaagggcctggacatggccgaccatgtcctcgtcaactccttctacgagctccagccacaggtatatatacgtgatctgatccaagctcgccataaatttgtccatggcgtgtgcaagccgatcacgatcaatgtcgtcgcctgttggtaggaagcggagcacatggcgtcggcgtggcgggccaagacggtggggctgaccgtgccatcggcgtacctcgacaaccgcctcccggacgacacgtcgtacggcttccacctcttctcgccgacgacggagacgaaggcctggctggaggcgagaccaccgcgcaccgtggcgtacgtctccttcggcagcgtggcgacgccgagcccggcgcagatggccgaggtggcggagggtttgtacaacaccggcaagcccttcctctgggtggtgagggcatcggaaacctccaagataccggaaggcttcgccgccaaggcggcgaagcaagggagagggctcatcgtgacgtggtgcccgcagctggaggtgctggcacacccagctgtggggtgcttcgtgacgcactgcgggtggaactcaacgacagaggggttgagtgccggtgtaccaatggtggcggtaccgcagtggtcagaccagacaatgaatgccaagtacattgaggacgtgtggcgtgttggggtgcgggtgcggcccgacggcgagggggtggtgaggaaggaggagttggagaggtgtgtgagggaggtgatggaaggggagaggagcaaggagttcatggagaatgctaatggttggaaggagaaggccagaaatgccatgtgtgaaggtggcagctccgacaaaaatatcgtcgagttcatcgctaagattggagtggaccgaaaatttaaatgattgagacaggtggattcgtcggccattggtcatgtttcctttctcatttgatttcactatcatgttttcagatgcaataatagtcgttatctgtcgctctagtctttctttttctagtataggatcaaatatttgcgatatctttttcccactatattcaatgaaatgggcacagtcggatgccgattcgttaaaaaaatattttacgatatgtatagtaaaataatcagtcatcagtcaatgcattaattgcatagttgttcaatatgttattcgtcaaatattattccctccgtttcacaatgtaagtcattctaacatttctcacatttatattaaagctaatgaatctagacatatatacttatctagatttattaacatcaatataaatgtgaaaaatactaaaataacttacattgtgaaatgaagaaagtattattttaaaacggacgaagtacatgccatgaattataccagcccatttaaccttagtcggcaatcaccgcctctctaactccggcggccgccgctgccatcgccattggcggtggcactggcagcagcactgtgtaaacaacaaacccatcaaatttccatcggatttaccaccgtgcggtgatgcgttggccaacggcagcatggacagggacaaagtagcggcagatagtggtgtactttctctagccgcatacgcaaacgaacaacctcatctttccatttatacttatgtttgttagttaatttaaatttttaatcttaaatttgaagttgatttaggtttttttctatcgaaatttatttttcaacctctacttttagattgttaagaacacgtatataaaaattaggcaaaatttgctacaggacaccgaaagattacggcctttgctgtgagacacccgaagatcatgtatttgctcacggacactgtaaaaaagtggtaattagctgctagacactcctcctattattttattatttctggtcaaaatggagagagaaactttggttaaagacaagtttgcccatgggcccacttgtcaatctctctttctctgttattcttctctctctctttctctgttcatctctttctcattgcgccgccgccgagctccgccatggccgagccgtcgtgcatcgtcgccgtcagcggtgaaccccggctctagtgtcgaccatactgagagaggaagccctcaatctcttcgtcgccctcaaatccctcgccggccatgaagaagacaacgcccgctgtcacc

SEQ ID NO: 712 - DNA, 10772 bp, Oryza sativa
ttagctaacgtcacaagctaagctactgatcaagattattattgcacgcttgcccccctaagttcctaacactaactcatgctagctaaagaagtaagatttgctgtgatcgggagatgctaccggacaagtgatttgtttcttggttagcttataattttggcgatttctgatactacatccgaggcggatccttcagttagctagagagtctgaaaaaaaactatacaatactatagcacctcttttaatggacgtatgacaaaatttcagtgaggctctatgggggctcctatggttgcaacaccaataataggggctcgagacctcaaagccctatggtggatccgccaacatccatttgcagatatttagcaatatttttttttactgttttcactttgaccattaatatttttaaactacaatgtctctattaagatctttgtttttttatccgacgttggttagttcaaacatcaaataaaaaatagagggagtatttaatatgattcaaaccgcatttcatcccgtggacaaatataactttcggtcataatacactagcaaaaacaataaaaagttgtactactagattccaaaaccactttgcaaattaattcaaggaacaatttttcccatgagcaagtttaatagtatagccaactactagtgccaatttatctatagccaatctagtagctcattcatacaatagttacatactacactattaatacatggtccacctgtcatacacacaccgcgtcttggagtccgtgctacagctgactataaatctgtagcctgctgatcttcttagaatatgtttgcagctggcttatagcctgctattgtacctgctcttagacggttgacctttttcttgtttgggaatcgtgaggcagatggtggagagatctgccgtttactttgatccgaaggtaaaaacacacacaagcttggcccaccactccaccacctgggtggtagccagtgttcgtctcggcccagaatcgatgcagccagcaagtgcaatgcaagctcccccacaattattgctccgatactccaatcgccatctgcgaaatgctgtcgctgttcctgcctacgagcgagagagagaatctcatctcgatgctgaacaagtaattttcccggttctgaatccgttcaatcatccaggaaaaatgtccggaattccaggtaagtaattttctctaatttcttatcctgatcagatttatagtgagattcaggggaatagagatctgctggctttttcatcggaaaatttcgctgaattgcgttcgcgaaaaaaaaaattcgctgaatttcgtacagcggatgatgaggattgaaaaggttgggtgctgcaaaagcgagagggggtggggaaagaagggcgcaagaccaatcaagccaaaaggaaggcaatgccacgaaggaatcggctagggttagccatccgcagccacagccgaggggttagcgggtttagccctagcccaccatgactgttgcggcgcatttcatctcctcctcgccgaggggaagaaaaaaccgcatcgcgacggcgacatcgggggggcctctttaataatgcttccatcagagagcatggccatggccatggccacgaccttgatcttgaggtttgggggtttgcgaatttgcaacattaacaataacgcatcattgctgcccctgcctgattaccacactaattaatttctcttatagtgctttatcttatctcttcttctaactttaggttagccggggtcgaaaggttcttcttcttttgcgcctttatggcaaaggggaattcttcgtcgtcacgcaccaagcgttacgcaattcgcaaaagaggaggtgccccactgcactcatacttctattatatattcctcggtgttttatttaatttgtgttagttcagagtattatatgtgtggtgtaatttcttgctgcttttgggaaagatatggatcatggacaatgattgccaaatagtgtaacgacttagacctagtagttagttgtcagacactgttatgcgaaaatcgattgtttctttgaggtgtatactttgatattgactgaatttcatggtacttcacctccatgtttacttgtgtaagttcttgctaggcgtgtctacttacttgtgttgagaaatgaaatagctagatgcttagcatgatctgttcctcttgagaacagaaaccctcaagatcatatagctaattaaagaaacatgatatgggcacaccaccaaaaaagcaaccaggaaggaagacaagtagcataggatgagggaaaaaaaagaaaggtgtaaagggggcatctttttgggaaggttgaggaggtttagtgatcaaggagggataccccagaaatgggaagttccaccgagcagccaagttgctgaatctagtgatgtcccctaattgcatcatggaatctaacatgagccccattatagggtcatcgtattacctcgctcttaataaaattggttggatgatcttttcggctgcctagctaacaatctgaatattagttaaatcctgcttgccttcatgaggcaacaggggcactctagcaatgggattaagtcctgataagttcagtttacttgtgtggtatttgtactgtgcctgtaataactggagtactaactagtagtgtttacaactttattatgtccccttgggtgacaaactaaatctcttaactatgctcagttatggcatatgagttagtgttgccttgtctgacgagacttccttttctgaaaccaaatctccttgcatgcagctttctgcctaatcagtatttgacagtggatgtggtgtatttaaccatctttgcttggcggtttcgtaataaaaatgtgtgtggaaactgcttcctggcatgcttttgtagggcactgtcaatcacctgggttatctgaaactatcgatttttgctagtgtgtcgatctatcgaagtaaccaaggctgtgcctcagacttaaaagcgtgctacttttttacacctgaaagttaccatctttcttctctgtcagaatcatgtgcagactttttctggctctactagttaggtggtgagggatgtgtgtatgtattcctgtgtgcaagcaacttctcacatatccaactagtttacgaaaagaataattagtgcatcctaagcatgaggcccaggtgataatattagatactaaaagctcttcatacttggcttcttcttttgaagggagggcagctgtggctctttatataaccctgcatcacttcttctggctaactggtgtcctttggagctgagctacatagcacatccgtggagtctcttgtgctaagcaatttaccgttccagtgctctactttgtaggccatccatattagacggaagaactttatcaggtactaagtttctctggatatttgattcactgattctgtttttattatgtgtgtcatcttggtgaagaacaagttaagtcctactctttggctttcactatatgtgctgttgtgctagaattaatgataacttgcatttctatagggtttattacctgattgacaaagaaaaaacatcaaaccacagcttgcctttcatatcttgtttatcttttcattcctagtagagaggaagtaggaaaatatgtttcctgttaacctaaccagcagagtcatcaggtgggattttctccttcggtgatgactcgtttagtgaaagaaggacatgatttttcttggggactctgaaaaattttagcttctgaataagtgggctatctgataattctttagttcttccaagacatcatagctaagggtttttgattttgtctcgtcatgtctatcgttgtttcttttcttatttgaatgggactgcaaagtgctggagtggtactaaaactgatcatattcgcttctccagtaagtctggaatagcactcgtaaaccatatgttcattataatctttacactgttggaataaagttccttgagcgaaaactttttttttccctgagaacatatctttcttagagtattttctaagaccatatcttcttccatgttcatgcgacactggacactctagagcaactgcataactttcagtattgtttatgaattatgcagctaatattcccactctggcacatgaatttatgcagtattattattggaggagaccaattcaagaatgatataatggagctttaccctggctatcttgaagaccattttaacatccacaagcttaggtgtgtattcctataaccgaatcccttattatttctgaattttctctatttaatatttagcaaatggaaaatgacaattagaattgctgcatttttacgttgaagttgaacaagctgtcaaacgaaagagagttagcacctatgatgccatttacgcattctagtattgcaatttgcattagattttcattagttgtggcacaacatgatgtaaaccgaatagatatttattacagcaagtggactagtgctgtggtgcagcgaaagtgagatcatgtcagctaggacagacaaaggtgaagcctacaataataatacgctggctaccagatttcagaatcaccaattaagatagaagtgcgacatcaactgataccttgtgctaattctctgaaagtataacatagatgctctgctttgttctcttgtttagacaaccacatccacccatttggaacaaatcaaaaggtttcctcatagcccgtaggttactgcgaatttacactgcacatagctgtttctaaatagggcacggcaatagccgtgaactctgcgtcttgcacatagctgtttctaaatagggcacggcaatagccatgaactatgcgtcagatccttgttgtagaggatcctgatagttgactcctcaacggaaaaataaaagacgaggtcctaatttggcaaaatagtgcaggggcactagagaaaaaaaaggcattttgcatcatctccaacccagtttagggcaaaggagaggctactgcttggccctccccaagtgatgttgcgggtctgaagaaagtggtgagcgatgaccaatgcatcaccattcaccactaactaaccaatcaaagtttcataagaaaaagaaaaaaagattagccaatctagcattccttttttcttccttgacatcatctgtcctttcatgttccccagcagtgcactgtgcactactgtctacagcaaacacagtttccttaaattcctctaaaaaaaatgttacatagttatttcaggcttcagtctaaccagaaacttgagcttatttctgtgccattagagattagagccaatccctccaaattggttagaataaacatataggtagtaaatacatatatgatgcccatatatgcgggagtgaatgcgacaaaatgaggcgaccattatacagcaatgcacactgctattcctgataagttgggacatacacatagtggggtttgagctatccacggtggtcggaggtgttgcagggtgagcagacaaaacgaagcccaccggttttgcattttcgtgggcgctggataggccaacctcactcgcttttagcgcaaaagcaaagtggagccgccaataattgagcgacacattaccaaggtccctccagtgtgctggcccggcaaatcccccactacgtgtgggagtgagtgagcttcttctcctgctgctgctgctttgcccgttcgtgcagcacgtaacatcatcctcacaaagacaaagatgggttccatggacgatggatcatgatcgattgatcatagatgctgcgtcatcatgctttctgtgcttgggattagatcaccagaatcttagttacaattacagacatcccatggagttcagttcaggttcactggttcaggacttggttgacatcgaaggcacaggattgactatacttcatccgtttcacaatgtaagtcattgtagcatttaccacatttataatgatattaataaatctagaatgatatatatgtctagattcattaacatcaatatgaatatagaaaatgctataatgacttgcactatgaaacagagggaatagcttagtagtagtatatgaggatgatgactgagacagacagccgaccccacaaaaaaagagtgggacccacgaagcaaatctgagtcactgaggagaagcagcagctaccaggtggcaacttgtccgtggagcagcaagggaagcgagcgagtcactctcagcgtcacgcaccgcgcctttgcaaaagctaaagctcgcagcggcagcgccgccaccactcgcactctgctttgcttccttcgtcacactgccggcactgcactgcctgggaggctgggattccagattccaggttccactcgaactcaagcaagcatccagccactcgcgggcaggcacacgcagtccaggctgctagctagtactcagattcttctcgtctctactaggactaggcacaggttcccgcatcatttctaacaatctagctgcaactagcttgaagctggcaactgattcgtactccctccgtcccaaaaaaaaaaactaaacctagaagagaatgtgacattttctagtacaacgaatctggataaatggttgtccagatttattgtactaagaaatattagatgtcacatccttgcctaggttaagtttttttgggatagagggagtattaattatccctctgatcacagcctctttgtagtgagagagactgttactgttactgttgggctgaagatgactgtgctactgatcggacctgggctgttgagttagtgatcattctgacaattagactcgtacacatgataagaattttttttcttccctgatggaagtgcgctcgcaaagtgaacgtcatctcagccttcagatcaagcttgattcatcatcatttgttgcgcatgttgtcaacctctgcatgccactttggcaaagtgctctaatccccagtgaaaatggcgccttttgatcccccaagcttttgtggagatgcatgcggccgcacttggggagagcatatttgcctttgcatacagctagctatctctaacctttgtgctgtgctgagcacattccatttcccagtttaaaagaatcaccttttttttcttcttcctttcctccctagcttgttgcagctgctgctccaagtagtgtgtggcgatccttagttttttgcacttagggagggtgcactctgctgatcctcttttacttggttcagtatcagcagcgcctctcctccggagtacatgacctcggcgtcgacgcagttcgcggcaccggtcagaatgggggcgtacgaccggcctccgccagttggcatgtggagtcacgagcagttcaaggttgacaacggccaggccacgagtgcatccacgatcatggaggcagagatgaaatttgagaatagggtgaggaacacatccgctttgatttaattttgtttcctctagtattttgagtagctatgagctgtggcttctactaattgcctgttgaatgatcgggtgtttaatactcattttgatgagatttgcagctagaagaaattccccaagtagttctggaggaagggagaaatgttgatcaggaggcaagcaagccgccagacaaggtgagcatcacacagtacaatccaaccatctctgctctgctccattatatgaaaccgtgtaattattactcttttccttttcttaaaagatgcagtagagaaattcccaaaactcacagtccatttcatatgttaaattcagtttggtcttgcgagataaaataattttctgcttatttattcaggtcctcagaagacttgcacaaaacagagaggctgcacggaaaagccgcctgcggaaaaaggtaaaatgacaagtacttaactactaacatgctgtcaccatgctagattgtagctttcccatttttgaaaaacaaaatcctcattatcggcatgattatggtgttccataggcttatatccaacagctggagacaagccggttgaaactagcgcagttagagcaagagcttcaacgggccaggcagcaggtacacggataacaatttgttgtgcagccacttcagcttacacttgtgtcactgactccattgcaaatttgcaactgctctgatgcaggctgtgtatgcaaatgggagccttcgagaaccaaatcttggatttacaggaccgatcgatccaggttaggttttttgttgtgccgctctttctgatcacaatgttcagcacagatttaacatttttgttcattctaattaccagcttatgtggtttcatcatattacgtacatgcaggtgccttaggttttgagattaagtacagccattgggtggacgagcagaatcgcaacactggtgagctgaggaatgcgctgctgcaggggcagacgacggaccaggacctggagctcaagttgctcgtcgaggctgggctcgacaactacaaccgcctcttcgagatgaaagaggaagccgccaactccgacgtgttctacatcatgtcgggcatgtggaagacccccaccgagcggttcttcctgtggatcggtgggttccggccatcggaggttctcaaggtagctaatcgatctgcactgcacacatgtactccagagcttcaaaaccactagtgccagttgattttttttacatgacatgatggcaactctctctctctctctcgttgttgcttctgctatcagaatttgagaccgcagctggagcctctgacggacaagcaggtcgtggaagtgggcggcctgcagcaaacctcgatgcaggtcgaggacgccctctcgcagggcatggacaagctgaagcagacgatcgcggactccctgacggcggccgacccgttcgactcccccgaggcctacatggtgcacatggccaacgccgtggagcagctcagatccctcgtccagttcgttacccaggtaaccaaaccaaaccaaaaccaaccgccaaaaactccgatcgcctcattgtctcattcatcatggcatctgggacttgtgtgtgcaggcagatcatctccggcagcagacgctgcaggagatgcacaggatcctgacgacgcggcaggcggcgagggggctcctcgcgctgggggactacttccagcgcttccgagcgctgagctcgctatgggcagctcgcccgcgcgattcagggataagctaaacaccgtaatatggtcacggtagaagctacagatatcagtagcaattcgtcgtgttagttcgctacttcagtgtcaggtcaatggccagtgaaggatgaagagatctttctacctgtgcttcgtcgaagaagaacaactcgtgatcgactttctgcagcgccgctgcaactgcaatccaaggaatggtgtatgttcgcctgctgagatgaagaaataaccaaaattaactttggtctttctgatgtgggcacaagagaagatgtaatataatatgtaaatatatacatgttttgggtatcattgccagaggcctctacagctggttttatagacatgtgatgtaattatctgtaactagtgttgctcggttcctcctccctagtacggcagacataggtgacatactgccattgtattgtatgggagaacaaattagttcacttgagaactagaaaaacatgcagtgatgttttgctgaagttgaagtagtttctgccaccacaaaacttaccttgagatttggtctctgctaacatggctaaccgtattacgtagcatggcttactagtgcgtgggtgaacacatggtgtcctgcgcaagtgctccaagagatttatattaatactggtaaagtgagaaaaagagagaggatggtaaaaatagctaaacaattgagatgatgataaactatggtacaattgaggtgatgataaactatggtacatgttagttctaatattatctttttagatagtttgtatatacccctcccgtcttaaaatataagcattttagctatgatttcggacaaacagttgttcagattcattgctaaaagtatttatattttgagactaagggagtagtacatagaagaaaatataaaaaatgaaaaggatactttcatacttataggataatataaggaaatagaaaaaataaaaataagggtttcacacttataggtaatacaaggaaatatagaaaatgaaaatgaaatttttgaaagagtaaagtccatcaccggtccctaaacttgtaccgctatgtcatcccggtctctaaactcgcaaatcgaccgttcatgttctcaaacttgttcgattgtgtcatcccggtccctaaacttagcagatcactcgtttaggtcatctaacttgttcagttatgtcacctcggtccctaaacaggacggtctaaaaattttatattaaaaataattcatatttttttcatgtgaactctaatgaagacaaactttatatcaaaattgtagccttttttattttaagtcattttttgtcccaaaatgtaattttaaatttaaaatttcaaaatctataaacatgcaacaatattttggaaccctaaacagtttcaattcaaaaacttttcaactacaaagtcgtaggtcacatcgagggctacaattttgatataaagtttgtcttcattagagtcacataaaaaagttatgaattattt

SEQ ID NO: 713 - DNA, 4004 bp, Oryza sativa; identical to SEQ ID NO: 444

SEQ ID NO: 714 - DNA, 3976 bp, Oryza sativa
tgtccccttcttcctccaacttcttctttgccaattgcaaggcatgcagatagggatctttattaatagcaggcatgtgtggtgtattttcttgactttggaccctgccccactatccagcccaaagaccatgcatcatgctgctggccgacatcctgactagtctcccacccactcgttattacatcccctaattaattaatcatttctattttgacaagataaaccatacctttctctaaaatatagagatttctaatatttatactttggactatttggtagagtttcaactcctaaatttagcttcagaagtaattaagtctaaattagaattgtgaagcaacctaaacctagttccaactcttaattttattttgtgagagagctccacccaactctatttctattttaggtggagctgaaattgtttggttgagctggagctgtgccaaacaggctctttatctaaaatatagctatttcttcttgtgctatgtcatatcaaacaattataacaatgttttatttaatttatctctatatattttatttcaaataatcataaccatcttttgttaaattataaaacgtcttatccactcaaaaaccctagtaatattttaaaacgagtattatgaaatgacgagatgacaaacacaagaactagagggatgtggtttttatttttgttttaaaaaataataattcagttggcgccgctagctgttccggtcaccctccagtctccttccgattcttccgccacatccgcatgctcgaattccccctccctccatttctttactcatttcccttcccctccgcttcctaatcctgcgtgaccccagacgacgacgacgacgagtacacatgcgtttgagcgcgacatccccgcgcgcgccttcttcttcctcttcctccctcctcccatgactagaccatcctcgccatattcccgcctctctatatatattagggctcagctcctcctctcacctcgtctcctcctctcctctcttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggtaggtcatgtgattaagcatacgtgcacggacgatcgacggccgccatggctgggagcgtgatgagcttaatttcttgagctgatttggggttttttttgttgtgaaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaacccgtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccagaccgagtgcacctccggcgagccctgcaagcgcatccgcgaggagtgcaagcccaagatctccaagctctacgtccacgccgacccatccgacctcagcctggtacgaatccccaaccccaattaacatccgatcatctcatttcatgtgcctaacttaacttctttttgttctgaattctagccttgattaattaattaatcctgttcttgcaatgaatccatgcaggtggtgaaagatgggtaccaatggaggaagtatggtcagaaggtcaccaaggacaacccctgcccaagagcctacttcagatgctcatttgctcccgcctgccctgtcaagaagaaggtaacttaaattcctctaactaattccaaagtgatttcgtaagttttgctaaatttagtgcaaattcgagcctgtttctgaactttgttcgtggttcaaatgttgtttcaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtggtgccgcaccgtcagcacgaaccggtcgtcgtcaacggcgagcagcaggccgcggcggcgtcggagatgatcaggcggaacctggccgagcagatggcgatgacgctgacgcgtgacccaagcttcaaggcggcgctcgtcaccgccctctccggccgcatcctcgagctctcgccgaccaaggattgacgattgctactgatcgacgcggcggattcgatcgcttcttcttgcaactgcgggcatggccattgccatcctctcctgtctctgcctctctgttcttggtggcgccagcaagaacacgatcgacgcggtgtccatccatggcggagttcgatcgatcgattgatcggctagggaggaattgatgattcgctgtatataacctagaatttttacacgattactcgagggatagatcgacgagcaacattttcggccggcgcccatggctgatcaaccaacgatcatcggcggcggccggacgtgagcaagacgattcagaaaaaaattcagatatttgcgtcggcaaaagacgcttgtaacatgtagagtagggaggaaaattatttgaagtgtacgtagtgcagtccttttgagcaaaattaatcccaaatttgcttcggtcccgaacaattcaacgaaatcagacaaactccccaaactttctgtacacttcactgtctcacttgaggtgaagtatcaagagtgaactgaaattcaacgaggagagacgctgacatgtgggcccatccgtatacattttttactgaagacaagtctgcgaaagtaggctactgacacaagctggttgacgcgctccgctctgcgacaaaacgaggcgagaggagacgaggactcgatcgggacacgtggcaggcggtggcgggtgccgcgggaggcgggggaatcgaggaaggcgagtggaaacgggctgcgcggcggcggcccgggtgggcccacctcggtgggcggtcaaccacgtgcagggcggcgggggcccggtccacgctcgccgcttcctcctctcttcttccgcgacttttaatgtttttccttggagactatttttcgctaagaaaatcagtgagaaacattctgctcctgcatttctaaaagcttgggattatcttgtgattttccaattaaacgtattattttacatccaatttcaaaaatatattgataactggtcgagaagaataagtgtaaattttataaaactacatgtactttagtcaaactatcacagaactatagattcaatataatatattataaaattacatatttaaagtaatttatcacataactatcacaaattacaagttttagatcaatttaatcataaaatttcaaccattataactcaaagcataatattagagaaacccaaaatatatagttttgtgataatttttttattaaatttgtagttctgtgatatttagccttaaatctgtagttttgtgataaatttatcgttaaatgtatagttttgtaatatatcatcttaagaatgtagttttccaatagtttagctcaattatttgtaatgtgtgaattttacttaaaaaataaattagttttgcatatagggcctatttagatcccctgacaaaatttttcactctattacatcaaatgtt

SEQ ID NO: 715 - DNA, 3591 bp, Oryza sativa; identical to SEQ ID NO: 634

SEQ ID NO: 716 - DNA, 12238 bp, Oryza sativa; identical to SEQ ID NO: 525

SEQ ID NO: 717 - DNA, 6541 bp, Oryza sativa
gagaagtcatacttaaagtgcttttaataataaagcaaatcataaacaaaacaaatattaattcgagtaaattgcacccacagtataacaacttgataggtgggtgcgatatagtgcaagaacttgagaattgaacgttcgagtgcaacaacttgacaagtgggcgcgttttagtacaagaacttgacaatttagtattttagtgcatcaactaagctaagcatatgctaggtgagtttttctcacgatatcaatatgccattacatagcaatcatacggatattaccttgtaatattgaattttatctttaagaattatactgcatatccaatttacaaccaattacctttaagaatttttgttttcttcacattcctaaatctcaaccgaaatataataatttctacatctagttaattgacttttagttattagttattagaataaaaatataaatatgcttatatgcaaatccacgctagtatattgtcaaaataagaacttaaaaattgaatatgtataaaaagtgctccaaataattaagttgtcgcataacttcttatcttattgtatcaaaatcgtacgtatcttacaagttgttgcatttatacaatcacttataaaattttttagctaaactgcacatacctgcgaagttgatgcactagaatgctcgtttctcaagttcttgcaccaaattgcacccacctactaagttgatacatcatgggtgtaatttactctattaattctataatttttgaataagacgaaagattaaaagttaaaaaaaactcaaagcgacaagtattgtaggacggagaaagtatttatttttacgcgtcttgtagttaagtacagtatatttttaggtagagggatgaataatctccctggttgagaggtggagagagaaggatggtacccattgaaaaatgaagaattccaataccacttgcaggtaggttgttgctcgttttaattcctactgccctcttgctgctcaccaaactgctactctctcctctcccaccatttcgtcaccctgcctcctcctgtctctgcctctgctcggctagtctagtgtactactctatcttctcctcctctctttctcctacccaaatccatccacccaacatcttttttctcagccgtcgtctcatctcgccttcgtagcgttgcgtcgcgccgcgtctaccctttccaggtgagcctccccgattacatcgctcgttctagctagctagctagctagctcctgtgttcttgctgtttctttgtttctttttgcgtttttaattttcctttcttggatctttctttgctagctcgttttgatttgtgtgcttctgtatttgtgtgttttgtgggcgaaaggggggctttcttggttcttgttccgggcgattgttattcttgttctggagaatcggattacgagtgtgccttgcagtggagttttgtaatgttaggctccaattgagcaagaaaaagatgaggttcttgttaaattctaggttatccagctcttgtttggttggctggtctggaactctgaattccctctgtagctttttactaggtaatggaatcccctttgtaatgcaaaatgtagatgcctctgccatggctatgttttatctttagatgtccggaattctcttctaagggagcctaaacacggcagttcagttcagattaattatgggtctgggtttgaagaaaagaataaagggagtgaaataaagaaacaaacaggtctgaatttgtgaccctgtttagctgaaagtgaaactgaaaaggggaacagaaaggaagaattgaccatcgatttaatgttaggtgttactgcatatgtgcaagcaaagattgttcttttggcagtggataatgctctgatggtctctggccatgatcaagtggttgtttttctctgcaggatgtggtttaccttttgctgttggtcaaaaggaacttgtgccaccactttctagtttgtttgttttgacacttggtgctggcaattcggttgctcacgggctgatcaattccttttgctgatttctttttgagagaaatccctttttctttttcttttttatatatatgcctttttatcttgcaactcattcatttctcatgtttctgaaggtaacctggataagacggtggaggagctatcaaatgtttatagaggagctcaagaaaccaatagaaagctctatcaggaactgttcccaattcaggtagtatactggtttccgtttaccaattgtttcttgctatcgatcgatatcattaatcatcatatcttgttcaagccttcttgaaggttcaaacatccttgtaaatctgaactgagacatcatcttagtcactgttgtttgtccagcagcccacctgcatgttcacatgtaatctgacaccactaatttgaacctactgttactgtcaggcattgaaaaaaccaggcatctctgaatatcctctatttgtagctatcatgaacaacctgtttgagacccctcataagattcttgcatgcttgccagtgcaatttagaatcaagttacttagcaaaattttctgaataaattttgtagtatgctcctcagctatatttattctgcctatggtctgatatttctctccaaacagagcttctaacaatcttcattctgtgcactgcagattatgcaaatgtgtggatggttactgaaggttgttcgttgggaaaacttaaattgtgtgcacatggaagctcatggcaatcgtcgcagcagtccaacataccttgttatgctgtggatgatttcggtagctagcctattgataacatgtcgtggcagtatccagaagcaagttctctttccagggttcactgccgcgcaaatggattacattgataacgatgggatatttctgctttctaatggctctgtctttggctttggttttgtcacgagcaatgtctcagacaacacgttctacattcttgcagtggttcacatggccactactaccacagtctggtctgccaatcctaactctcctgtcacccattcagatgacttttttttcgacaaggatggcaatgccttcctgcagtcaggaggaggctccaatgtatgggctgccaatatctccgggaaagggactgccacctctatgcaactactggactctggcaatcttgtagtgcttgggaaagatgcctcttctcctctctggcaaagtttcagccatccgacagacactcttctgtctggtcagaatttcatcgaagggatgacgctgatgagcaagtccaacacagtacagaacatgacctatacacttcagatcaaatctgggaacatgatgttatacgccggcttcgagacacctcaaccatactggtctgcacagcaggatagcaggataattgtcaacaagaacggtgacagcatctactctgcaaacctcagttcagcttcttggtccttctatgatcaatcagggtcccttctatcacaacttgtcatcgcgcaagaaaatgccaatgccacattgtctgctgtccttggtagtgatggattgatagctttctatatgctgcagggtggaaatggcaagagtaaattctcgatcacagttccggcagactcttgtgacatgccagcctactgcagtccttacaccatttgcagtagtgggacaggttgccaatgccctttggccctcggctcgtttgcaaactgcaatcctggtgttacatcagcatgcaaatcgaacgaggagtttccgctggttcaactggatagtggagttggatatgtaggcactaacttcttccctcctgcggctaagacgaaccttacgggttgtaagagtgcctgtacaggcaactgctcttgtgttgctgtgttctttgatcaatcttcaggcaattgtttccttttcaaccagatcggaagcttgcagcacaaaggtgggaatacaactcgtttcgcatcttttatcaaggtatcaagcagaggaaaaggtgggagtgatagtggcagtgggaagcacaataccattattattgtcattatgctcggaactttggctatcataggcgtccttatttatattggtttctggatctacaagaggaagaggcatcctccaccatcacaagacgacgctggttcatcggaagatgatggatttctgcaaacaatatccggagcaccagtgcggttcacttacagggagctccaggatgcgacaagcaacttctgtaacaagcttggtcagggagggtttggatctgtgtatcttggtacactcccagacggcagtcgtattgctgtgaagaagctggagggcataggccaaggaaagaaagagttccgctctgaggtaacgatcattggtagtatccaccacatccatcttgtcaaactccgaggcttttgtactgagggaccacacaggcttcttgcctacgagtacatggcgaatgggtcgctggataagtggattttccattctaaagaagatgatcacctgctcgactgggatacaaggtttaacattgcgcttggaacggcaaagggattggcatacctccatcaggactgcgattcgaagattgtacactgtgacattaagcctgagaatgttctacttgacgacaacttcatcgcaaaggtatctgattttggccttgccaagttgatgaccagggagcagagccatgttttcactacgctcagaggcacgcgcgggtaccttgcacctgagtggctcaccaactatgccatctcagagaagagtgatgtgtacagctacggcatggttttgcttgagataatcggtgggaggaagagctacgatccctcggagatctccgagaaggctcacttcccttcctttgcattcaagaagctggaggaaggcgatcttcaggacatcttcgacgccaagctgaagtacaatgacaaggatgggcgggtcgagaccgcgatcaaggtcgcgctctggtgcatccaggatgatttctaccagagaccatccatgtcaaaggttgtgcagatgctcgaaggcgtctgcgaggtgctccagccaccggtgtcgtcgcagatcgggtacaggctctacgcaaacgccttcaaatcgagcagcgaggaggggacttcatcagggatgtcggactacaacagtgatgctctgctttcagctgtgaggctttctggtcccagatgatgtgaagaatcccatgtacagtgccttgtctagttaggttgcaaagtgtgcaaattttgctgtagtttccagtgttttggtgatcatttgcttcacactattgtacatatcttcttggtcatttctggtggtagtttatacatatcttgctgattatttatggtggtagtttatcggtgccattctttttttgttgcccttttgcttatacataaggtctccaaaacctttgacaattaccttttgtagttatgtcttggtaaaaataataggaaatgcaatgatacaaaagcctttttcatcagacctttcagtatcattttcaagtcacaattcttgtaaccttttgtgtattcaagaggtcattgtttctgaaatttgacattaaaaaaatggcataacaatggcacagtgatctgtaactagatcggtcaactcatgcaagcgtagtagcacgttctgaactggataggcaggatggcctcgtcgatttattaatggtctttccagatttttcatctacctgccattgttacaaatcaaaattaggcctttttttgtcatatctaaactttttatgagaaactttcgtcctaaatcaaaatgatccctaatcctgttttagataaagcacgtcacactaaacttgcttacactttcgtcctggcttcttcgtatagataaagggtatcctagggaattgaatgaactagtaagaccataccgatcaagttcatccttcttgggccctatctcattcaggctatacatgccccctcaacttcatcatttgctgggcaattcatctcatttcctgaatagtgatttttctttttcagcaagtcaaaacaatactgtttttaccatgtattggcgctcttccaagctaagaggctacttccttgcatcagtacacggagatatctccaatataaacagcgagacatcgccacaaagacgctttggcttttaacagagatatcacatgacattgcacgcttgatctttttcagcttgcaactggctgttgaagaaggaagcacttgaggagaatgcttaggacaaggaggggcattaggaagaagagcagccagactgagctgtggctataaactgtgcttggggtaggaaggggtctgaacttcgctagctcttccagcagatcgtcgtgatcccggaaaagaagtgaaagctgcactcgaaacagaacggatcaaagtgattgtgatttatgatggattaagaagctacagatctatgatgaaatttctcatgagagaaagggtgggtttttagttctggta

SEQ ID NO: 718 - DNA, 11048 bp, Oryza sativa
tcgccaccgccgttgtctctccgccacgctccctttctccagcttcgccttcacggccgtcaccaaggcctgcaccgacctctccgcgctccgcactggcatggccatgcacgcgcactctatccttctcgggtttggctccgaccggttcgtgcagacggcgctgggcgtgctatactccaagtgcggccagctacctgttgcacgcaagttgttcgacgcaattcgttacaggagcgtggtcgcttggaacgccatgatttctgggtatgagtagaatgggcttgctgagcgtgcgattgaggtgtatagggagatgcaggtggctcaggtggtgcctgattccgccacgtttgttgctacactctactcgccgaagttcgattccctcctcgtcgccggcccgcgcaagctggcccacgcgcgcctcatcgtcgccagccacggcagcttgctcccgctcgtcaccaagctcgccaccctcaccgtggccgccggcgccgtgcactacgcgcacctcctcgcggcgtcccaccacgcctgcgacttcttctttctctccttgctcacctgcgccgccgcacatcgcaacctccccggcgcgtccatcgccgccgggagattcgtggaggtggtgggggccagcggtggcgaactgggcggagacggcgtggccgacgacgccgccgccgccgccgcggcccacctcgcggagcgcgcggcgggcgcgccccaccggcctcctcccctcctgtcggctagcctgcgcagatcgagaagtgagagagagaagggagagaagaggggaaggagaaatgtgttgaggtggcatcctgacatgtggggtccacgtgggtcctatgctgactcagcagccacgtaggataaaaccggcatcaaaaccgctgagggacctattgtaaccggttttgtatagttaatggacccgcgatatttggttttgcggttcgaggacgtttttatattccgatgataagttgagggaccttctgtttacttttcccttcctaattcctccttccttccttcctccgccactagattttttcccgtctcgtgccattgactcgcggtgcgacgagacgagccaccgggatctcccgccgttcggagacctaggggagcaagggggagactagagaaggttgcgctccatgaagtcatggtgcaccttaggtatcttgaaaggttttaccaagcgacctggttattgaagcgtggagaagaggctccagtgcggcaggagaaagcagatgagtagaggtacgatctcttcaggagaaagcagagcccagctgcccaggtggtggggagagattatcaaatttttcggtggtggtttggcacgggactctgccgcttcgctgccttcaaggctcaagctcagggtgactggcggcatctgacaggttcatttcctcttgcttatgtcttttagttgcaaatcaattaccattggttgtgggtttgaattattgggcgaaatgctcatgcgttggtcttgaaatttagctttttatctatctctatgttttacattataagtcgctttaatttttttctaattatttttttaagtttgatcaagttcatataaaaatgcaacaacattttcaactcaaaacaaatatattaatataatatattcaatgctatatgtaatgaaactaatttagtgttatgaatgttactatatttttttataaagttggttaaatctaaaaaggtttaattaaaaaaaatcaaaactacttataatacaagtaaaatagagagaattgcatagaagtggaagtgtgtcggtgtctgtactggttctactcacctagtcacctccctgccactgctattctgctaatagtgttagagaatacgcacgcacagataatggcaaggacgtcatttagaagagcccactagtgcgtgtcatgttgcttatgtgcaaattttatacactttcttgactgaccaaaggttgtatgcggtcattttttttttctctcggtgctagctttaatatacggaaagccgtttagagaagatggcatgacaataatggagcatatatatataaactagctcgtaccctgcggcgttgctgcgggtagatattgtaattgcaagtgtccagagaataacaaataaaattttccatggaacaatcatgatggccaaattgtataatatatggctgaaagttcacattatctaaaacaaatatttttcgctgcggtcggagtgtatattaagaaggagagagtttaagcaaactgtacaagagaacaatcagagccaaagctcacatacagaaccaggacactggttcgccacacacacatggttcaaacttcaaacattactgggagtctgatatacatttctttcttgtcttcctgcaaatttgtgttggcactagcttcatacagacctcaactctactgatccaagaacaacatgtagggctacatcctacatgtatacccaaatacccaatacaaacacaaaatagacgaagctaccctgcaatgcaatcagtaataagatcaatagttgataccgaagccaccagccagcatttcgggtaaacatagagcaacaatgaatataagcaagtctcttaagaattacgttctcattttgataaactggcaagcacgggtgaattttgcatcaacacccaacggaaatttgattagcattccttgaaatatgtcactgttgatgaaggtaaaaaagtaaacacaaagtgaagcccatagagcttcagtttagttcaggcatcaacatagtttaactcatgaacctccaaattaaataaattatttatttcattattatatatcataccttggtacatttgtcagcctcacggcagtagattttgcccatgttgcagtaagttacacacacaaacaccaaatatgctagtttttaaactattcttgtttcactagatttaattgcatttggttttttactatgctatttcggagttgtttaatttgatagtgggggccatagagtataatgaaaaacagcaaggtaatgagaaccagagcatagtccggctagaatattttaggagtccttttaatgaggtccagcttgttaagggtagtatgtctaggggtattttagatatttcccatctctctcttgtacaaatatattttgccctttgggcctaatctaattggaacagttcattctccaatttctccaaattgtaacatggtatcagacccttgttccaaaaaccctagccaccaaatccgatcatcaccggcgcaccggcggcggtgagccgccggcgagccatcatcatcgtcctccttcatccctcaacgtttttgtctccaagcagcaagcctgcagttcgtcgtcgtcaccgtgttcctgttcgccggtcgcagccgccgccagttgcggcgccgcgcccgttcccacttctccacccacgcagccacgccgtcgtggtgttcatccacgctgctcgtcgcggggctcgttcttgccgccgttcgagagccgccgctgtggcctcgtcaatctacatcaaggcatcaagcaacatcagtttttggcccatttcttgtcagttagcatcagcaaaccatcgtcctctctgatctgcagcagcaacaacaacaactcccgttcacctcctagtagatgcagcagctagcccattgttgtctcctaatttcagcagtagaatttccatgttccattgtttgtgttgcaacatgcattctgcagattgtcatcaagcttgtattccaccacatgtgttagtcagtttttgcgcttgctaatcgctgccatccactactcactcatcaatcatcaccatgctttgttattgttagctacttattataatccaattttacttctccaaattatcatgatggcttgtagtagtcactggttaggtcattagctgcttgcttgctactgtcaacatgttcactagcatcctttgtgtcttttgctagtaatgtgcatctctgcttgcagtccatctatcaatattgcctttttgctatatccatcaatccgtgttctttactaatcaaattcctgtgtttcctaccgagtccagcaaaatccattgcatatccttcattttgtcgaagctgtgccagtccatctcttcatggtcatttcatcatcaccagctccccgtcggagctggccttcattgtcacttcatatcttcatcatctccatgtcggagcttgtcatcatcatcatcaatcagtgaaggtccgaagaacagtttgtgaagggccttcatcaatatcaatgtctcatcatcaatcaaaggaccgaagaacagcttgtgaaggtccattgtcatcatcatcaacatctccgaatcaatgaagagccgaagaacgattcgtgaaggcttcaaggtaccgagggccgaagaacagtttgtgaaggctccgaggtccatttcattgaggagggggtcttttcttcttcatcatccaagaattgacacacttcgacgacatcatcaagactttggagataggctaatatttagattgtgttctcatgtttagtttacctttcaaatgcaatgttattacatacacattgcatttgagtgggggtgttaagggtagtatgtctaggggtattttagatatttcccatctctctcttgtacaaatatattttgccctttgggcctaatctaattggaacagttcattccccaatttctccaaattgtgacacagctcatctgaatattagagaaatataaatttgccactaacatttaacaatgtcccacttgtctactccctccgtcaaaaaaaaccaaacctaagacttagatgtgatataatctagtatctgtctagattcgttgtactagattatggcttaaatactagattaagttttttttgggacggagggagtatgtctaaccaaaataacacaattgatttgcatattgtgttttgcctcgcattgtgccgaagcaatcttatctgtggcaattggtagagttcttcctctcacaccttctctgcaatacaaacgcatctggctctggtaaccttgcactcctctcttagtatttctttccttcacgctttcttgtctctgcttaagttctctatcgtttggtaccatcatgcattaattcctttttcctctatttcccactccaaacatttccataaccactcacatacacaaaaataaaaaaccagacagagagaaaaaaacttgttttgggagttctgttgttatcttcctcacagaagaaaaatctctccatcaccatctgttcttatgccctgcttctattcattcacttgttcacagctgcagtagtgctgttccatggcggaggtggtgttggctggcttacgtttggcagcaacaccaatctgtgtgaagctcctctgtaatgcttcgacgtgccttggcgtggacatgacgcgtgagctccatgaactggagaccatcatcataccacagttcgagctggtgattgaagcagctgagaaaggaaaccacagagccaagctggacagatggctccgggagctcaaacaagccttctacaatgctgaggaccttctggacgagcatgagtacaacatccttaagtgcaaagcgaaacacaaggattctctagtgaaagattccacccaggttcatgactcttccatcagcaatattttgaagcagcctatgcgtgctgtgtccagtaggatgtccaatctgcgcccagagaacagaaagatactttgccagttgaatgaactgaagaccatgctggagaaagccaaggagttccgtgagctgattcacttacctgctggtaatagtcttgagggtcccagtgtaccaacaattgttgttcctgtagtgacatcgctattgccgccaagagtatttggtcgcaacatggatcgcgatcgcataatacatcttcttactaagccaatggctactgtttctagctcagtcggctactctggtttggccattgttgcacatggaggagcaggaaaatccaccttagcacaatgtgtttacaatgacaagagggtacaagaacattttgacgtcaggatatgggtctgcatctcacgcaaacttgatgttcatcgccatacacgtgagattatcgagtcagcaacaaatggagagtgccctcgtgtggacaatcttgatactctccagtgcagattgaaggacataatgcaaaaatcagagaaattcctgcttgtgttggatgacgtctggtttgatgaatccgtcaatgagagggaatgggaccagttgcttgatcctcttgtttctcagcaggaggggagcagagttttggtgacttctagacgagatgtacttccagctgctcttcactgtaaggatgttgttcatttggaaaacatggaagatgccgagttcttggctctattcaaataccatgctttctctggaacagaaatcagaaatccacagttgcatgcacggctagaagaggtcgcagagaagattgctaaaaggttaggacaatcgcctttagcagcaaggacagtaggctcccagctgagcaggaataaggatattgccatatggaaaagtgctctaaatattgaaaacttaagtgagcccatgaaagctctgttgtggagttataataaattagattcacgtctgcagagatgttttctgtactgcagcttatttccaaaaggtcacaagtataaaattgatgagatggttgacctttgggtggcagaggggctagttgattcacgcaaccagggggataagagaattgaagatattggcagggattacttcaatgagatggtgtcaggatctttctttcaaccagtttctgaaagatatatgggtacatggtacattatgcatgatctgcttcatgatttggcagagtcactgactaaagaagactgcttcagattagaagatgatggggtgaaagagataccagccactgttcgacatctatctatttgtgttgacagtatgaaattccataagcaaaagatctgcaagctacgttatttacgcactgttatctgcattgaccctctcatggatgacggagatgatatttttaatcagctattgaagaatctgaagaagctacgtgtactacatttgtcgttttacaacagtagcagcttgcctgaatgtattggtgagctgaagcaccttcgatatttgagtatcatcagcacattgatttctgaactgccaagatcattgtgtactcttttccacttggagctacttcatttgaatgacaaggtcaagaatttgccggacagactctgtaatttaagaaagttacgacgtcttgaagcatatgatgacagaaacagaatgtataaattgtatagagcagctctccctcaaattccttacataggcaagctatctttgctgcaagatattgatggattttgcgtgcaaaagcagaagggatatgagttgcgacaactgagggacatgaacaagctcggtggtaatttgcgtgtcgttaatcttgaaaatgtaactggaaaggatgaagcctcagagtcgaagttgcatcagaaaactcatcttagaggtttgcatctctcctggaatgatgtggatgacatggatgtttcacatttggagattctagaaggtttgaggccgccatctcaattggaggaccttacaatcgaaggttacaaatccaccatgtacccaagctggttacttgatggatcctattttgagaatctagagtcttttacgcttgctaattgctgtgtgataggaagcctaccacccaataccgagatctttaggcactgtatgacacttacccttgagaatgtcccgaatatgaagacactaccttttcttccagaaggtctcacaagcctatcaattgaggggtgcccactgcttgtgttcactactaataacgatgaactggaacaccatgattatagggagagcatcacgagggcaaacaacctggaaacacaacttgttttgatatgggaagcgaattccgattcagatattaggagcacattgtcgtccgaacactcatccatgaagaagttgacggaattgatggatactgatatgtcgggaaatcttcaaaccattgaaagcgctttagaaatagagagagatgaagccttggttaaagaagatatcatcaaagtatggctctgttgccacgaggagaggatgagattcatttattcaaggaaggctgggttgccgttggttctaccatctggactatgcgtactctctctttcctcctgtagtattacagatggagctttagctatttgccttggtgggcttacttcacttagaaatttgttcttaacagagattatgactttaactacgcttccaccggaagaggtcttccaacatttgggcaatcttagatacttggtcattcgttcctgctggtgtctcagatcattcgggggcttgcgatctgctacctctctttcagaaataagattattttcctgtccttctttacagttggcacgtggcgcagaatttatgcaaatgtcccttgagaagctatgtgtatacaactgtgtgctttcagctgacttcttctgtggtgactggccacatctggatgatattctcttatctgggtgcagaagctcgtcgtccttgcatgttggtgatcttacctccctcgaatcattctcactatatcattttccagatttatgcacgctggaaggtttgtcttccctgcagcttcaccacgtgcatttgatagatgttccaaagcttactaccgagagcatctcacagtttcgcgtccagcgttcgctctatattagcagttctgttatgctcaaccacatgctctctgctgaaggtttcgttgttccagagtttctctctcttgaaagctgcaaggagccatccgtttcattcgaagaatctgcaaacttcacatccgtcaagtgcctgaggttatgtaattgtgaaatgaggtcaccaccaggaaatatgaagtgcctatccagtctaacgaaactcgatatctatgattgccccaacatatcatctataccagatctgccgtcctccctccagcatatatgtatatggggttgtgagctcttgaaggagagctgcagagcacctgaaggagaaagctggccaaagattgcgcatatccgctggaaggaattcagatgaattgtgcttcagaatcacaactagagagaaacggaaaggtgaaggttacatcaatgcattgtcagaagtattttcttttctgtattatttatttcgttaacccatgatcatgcaaacacattatttacttcaatgtttccttgtttatttattttgaacagacaccccaagattggcacatatacgtttccctgctgccatccaccgactcgccgcctccttttattcggtttctctgccactgacggcccatgatcgtgtcctgttgcttaaatggagtcttgttggtttaagaaaatctctgtgtctcttgaagactcaactatcttgtatttgttaggatacgataggcaaccaaaccataaaaaacaatagatcaatcataaaatatacgagattttaacgtggaaaaccctaccaaaacaggagagaaaaaaccacgggcgtcagccagcaaaatatctttactatatctggggtgaggttacaacgccgcacgtcggcttacaagaggtatatatatggtggaaccctagaaggaatgacgatccggcccaagcctcccggcgacgggcctccgctccactacggcagaagctggcctttattaagtgcaaatgaatttggatcataactcaacagtattttattatgtgatgtgatatactattccagtacttggattttacacttcacacaaatatacagtttgcttcaaatgtttgtctatgtagtttgcataaagtttgtatggatatcgattatttgtgtaagtttctgatgcttttatcgcacgatagttcttgatagttctcacctcacttcgaatgtgtccttgactccttgttgagctgcccggcagtctgacaaaatttgatcagtccccattgtttctgttgcactctggcgcttggattgtttgacttagttctctctctatcctcccggttgagtaagatataggtggtgtttgaatctcctgaagataaaaataaagataaaaattaaatgtttcacacaaaacgaggtggtaataacgtgtgagtaattaagctttaatcattacaaacttgaaaaatagattaatatgatattttagaacaactttcatatagaaagttttcacacgaaacgaaccgtttagctgtttaaaaagcgtgccacgagtatccaaaagtttatccaacgtttgttagcagattaattttgataatagtagcagaatgtccgtccgttgctaccggtggaagcacgtgacttcgcgcgtcacctacttcctccgtttcataatggaagtcattctaacatttcccacatttacagtgatgtttctagattcattaacatcaatatgaatgtggaaaatgctagaatgacttacattgtgaaacggagggagtagttgttagttcgcaatataattatgggaacataagaaaaacttactaagaatagtttaacccaatatatcgattcttaattttcatcaatagaaaggggcatccgagtatccgacagaactgaatattggactctctggttgaatatgcatacatgtactgagcactgatccagatcaataaaaagacgttactgacacggaaacacagcatcaggtatgcacgaactgaaagcataactctgcatgattgcatctttggctaacggctgtctatggagtgttagacgtcgataaattcaacccagagatcattccagcccagctatgcatgattgcatctttgcctagcctacttagtgaccaactgccccctccgttt

SEQ ID NO: 719 - DNA, 3248 bp, Oryza sativa
cttccaacttttccgttatatcgttctaatttcaacaaaactttcaattttgacgtgaactaaacacacccttagaaaaaaatggaacctagatctctaaagaatggaacctagatctctagggtacgagtaccactagtctacattaaatgctctctctgtttgttatttgacgccatactatcttttccatctctactagttcacattaaggctccgttcttttttatttgacaccttaggccgagtttggttctaaactttttcttcgaacttctaacttttccatcacatcaaaactttcctacacacacaaacttccaacttttccatcatatcgttccaatttcaatcaaactttcaattttagcgtgaactaaacacacccttactgtcttttccatctctactagtctacattaaggctctgttcgtaagagggagttcacaactctcctctctcgttttccgtgcgcacgcttttcaaactgctaaacagtgtattttttgtaaaaagtttctatacgaaagtttcttaaaaaaatcatagtgatccatttttgaaaaaaaaatagctaaaacttacttaatcacgtgataatggaccgttctattttccgtgcgtagacaatgagttcccaaccgccacttacattaagtaccacactccaggcctcatcttctactcccaccgtcccataaaaaccaacctaatcaagattagatatacctagaacaacaaatgccaaatccccacctaggttaaaagatacggaaactgcatgagaacatatgtaagcttgtgcaattacataagctagaccttgaaggatgtcactatcttgtcacgttgcctacaaagaagagtaaaatgaaggagcttcagtacctaaatgttctcaattgctactcactcacagcaatgcctcatgctatgggccaacttacacatcttcacacattgcttggttactttgtccccaacattggtagtagtgcaatgtcagagcttcaatcactgctagacctcaatagactatggctgtatttagatccaaagtttggatctaaacttccgtccttttccatcacatcaacgtgtcatacacacacaacttttcagtcacatcatctctaattttagtcatttttcaaactttgcgctgaactaaacacagcctatcactagtgaaccttgaaaaggtttcagacactgaagatgcaagaatggcaaaacttcaagagaaagaaaagctcgagacattgatgttgaggtggaatatggatgctggaaatgccagtagaatagatcatgaagtacttgaaaccctccaacctaaccagtgcctgaaaactttggagattgttgcgtatgaaggacatgcatttccatcttggataacaagcactgagccatatctcacatctctggttgagataaggttggttaatctgagatcatgtgaaaatgctttacctccacttgggctactgccatgtctgaagattgtggagataagccgagtttttttttttttgcgaggaagtggagataagccgagttgagaatatcagttgtattgacgataatttctatggtcagaacggtacatttccttcattggagaagctgattctctcattcatgactagccttgaagtctgggaacagtcatctaggatgaatctgtttcctcgtcttgcagaacttgtcatcattcagtgcccaaaattgagagcactgcatatggagtttccatcgattgaaaaattgattttgtggatgaataataagatgttgtacagctcgaaggaaggtctgagaggtgtagagaagagcctcgaaaatctttcaatttctttctgtgaagagttgcatgcttcttcaggctgtgagggtctacaggctcttgatcgcctcaagaagttggagatatgtggttgtcatgaattgtcatgcctcccacagggtttgcagcatctttcctctctcgccagcttgaaaattgataactgcaacaaattggagattttgccagaatggttggagaacctaccttttctacagataatgtgtttgtctggctgtccaattctgcactccattcctgaaggcctaacatgtagcgacattattgttgaatattgccccaattttaaagaaccatcaggtatgtcatcagtgctctgttcatggaaagccatgtttctgattttcattgagctattcttaaagcaattgaactagctttgatagattaaataaacaattagttatccttgctatttctttttgatgttcaagtgaatgaactcatgttcagttattaatacatatcctcttgagttgaattggcacgatatgaagttgtttctttcaacacttgtgacttattattgtgtgaaaaacagctgcacgagggcaaacgaatagtcgtcatggaagattagttttacattagttcagcgatttaagggaaggccaattttccaccgctgatcttaaaacattggtcaagacaaaaacagtggtgaactggtgatcagaagcagagatttcatgatcaacctgttgatctgtttctgcaactggagattatttttaaaattgaactagatttctcattgtggatgtggttagaagagaggaatagtaaatgggaactcatgaatttaatgcttgtgaagtgtaacttgtgaaattctcaagctactgtatcttcagaaatgcatgagaataagaatgatttaggtagcaatttagaaactatcaatttgctcctctgaaattcccagctatattgtgaggcatcagcaacattattaacctgaacacaataggttggtcacctgtgtaacaaaatgcctctgacattatttggttaagccaggattatcttacaaaggggcggtaccatgcataagaaaaaaaaactagttaatactctgatatttgcatatttataacacacaatatccacatataaataacattcaaggtgcttcaagctatcacagattaagagcaggtggtgacaaattcattagttagacaacacctggcagttctcacatctcagaactcacaagagacctagaggctagaaatggaacaactagcagtaatacaccatcatatacaaagttacaattaatcacgttcagtattaacatgtcatggaagattaaacaggtgccgcttccccttctgatgatgattttgacataaaggccagatcaagggaaca

SEQ ID NO: 720 - DNA, 7486 bp, Oryza sativa
aaaaataaacagggggaaaaagaacggcccatggtttacggttcaggtgtccttataaaggggtctattttaaatgatctatttgaaataaatcttaaaaatatttttatgttaaaatagaacccttaactattaggaaaaagtccaaataaccccctaaactttggatggaagttcgtctagcactctaaactttaaaaccagatattcaaccaacctaaactttacaataccgtttatataaccccataagatgattttgcatagtgatttttatctaatttatatataagttggatgagtctgagctttggacatatatatatatattaaaattttaactgaaatatttctttttgcttcatattaactcttacttacaaacaattgtatcaagatgataatagtatgatatcactgtacaaaaataaattaataacttataactgatgatatgcaaatatattatattagttatttaaaattattcgtttaagcttctaaaatatgcaaagccatcatcaaactaccttaggagctaatatggatggtatggcaaagttcggaactcccgtttcgcaacttttgctccgcgagcacgtttcacgaactgctaaacgatacttttttttaaaaaaaaattctatagaatagttactgcagaaaatcatattaatctatttttaaagttttttagccaatacttaattaatcatatgttaatgagctacctcgctttctgtgcgaagtgaaaagctactttagaacatcttaatcctgtgcataatagcttctcatatacaccaaaagttatagaaatagcattgcatctatatataaagtctcatcttcttattagtatattttatttagctgctctaagttggtgcaggcgggcgctggtttggcactaagataaaaacaatcatcggatgctcacttaactcgcaatccaccctaccctagtgaccaccagtccacaagcagcacctatagctaactattagtgagagaccaccgacccaaaatcagtgcgaggcggtggcgagcggctcccatggccgtatacagcgtcgccacgggggccttggctcccgtcctatcgaagctctccgctttgctgggcgacgagcacttggatcttgcggagaggacccggagcgacgccatgttcatcaggtcccagctggaggccgtgcactctctcctcctcccgaggattagttggggaatgacgggggaggaagtcgatgctttgtgcaaggatgagttgatggcggaggtgcgtgagctgtcctacgacatggacgacgccatcgacgaattcttcttagaggagcccatggcgggcggcgacggtggccctttcgatgagctcaagacaagagttgaggatgtctccaagcggttctccgacagccggcggtggaggccaccggtggagcaacatcaaccatccctaaccgccgcaaccgtagactgtccacctcctcacgctcgcttcgtccacaacatgatggatgtgtcagagctcgtggagatggacaaacaacatgagaaagagctcatcaaattgctggaacaaggtgcggacacaagcatatatgcttcccggtggcgcatcgcaacaccatggcatgataaggaggtaaagacgacatccttttatttcttttttatctctacttctctatttatatattatattatattatattataaaaatttaaaatgttttcgctgtgtgtattttggtacgtcgtggctatcttcgtatcgtattcgatctcccgttcagtatattttgtgttgtacgtctctagcttccagatatatcatatatctttccattcccatgttattctttctttccaaattccaattattaattatacctcatttaatgagggacatttataccattttatttcagtagtaatttcatcctttcctagtgctagaagtgcacttgcatgaggatggaggcaaagctgaaatacccattcgttgtgatgaaattttaaaagcgaaccctaccgtaaactctaaattaagccccaaaaattataatgcaagtattcctgttttaatcaatatttggcatcatttttttacaatgtataattcagctacacaatttgctcatttttttttacaattgcttataattaagctacacaagctaccaattcagctacacaattggcacatactactatactagccaaatacccgttattttctacgtattaaaacaaattaatagtgagatttttggggcaattaatttggttttgtagaagttatatcatagagaaattattttataacggtaaagttggttgaaaatatgatggagaatgtggtaaataaaaaaaatactatagttggtggcagattcactgccaccgccattgccctcttttgaaaggaatatagaattttatcttgtagaagttatattgtacaagtgaaatatgatggaatcatatatgtagaataaaacattaaagtatgtgggggtatttggttgaaaatatgatggagtatgtggtaaatagaaaaaaaatactatacttgatgatggggcgatgatagattcactgccaccaccattgcatttttttaaaaggagtatataaacatatataggaacccacctactcattacttggtaagaggtcttacttggtaattgtgctggacggtagtatgccagtttaccattcatcatcattattggattccttttttttcttaaaaaaaggtataatatgatatgcaacttcttaattgctttatttcttttctagattaattttagataaaaattttattggatatggatcagctagcgtagtaaaaagtgaacgatacatgagaaaaaagattgatttgacaaaacaaaaacacaacccattaaattggagtgtcttattcccgtagactgcagtaacagaatggttcgatgatcaactaatgttttttgctgcagcaaagtactgtggtcaaggtgccggaaagagagtggggcttcccggacaatcggaacagtccatttatatgggcgagtgattcgtttgaacgattgcgttcgggaagtttgtgtggagatacgttgcggttggatggtgaaggcgcgaacatccgcaagctcttgtccaccctccggaataaggtgggccgcgcccagttggtgcaggtcgaggataagagaaaaagggtagaggaggcgacgaagccttgtgaatttcacgaggtcaaaacaatatgcatccttggattgcctggcgcaggcaaaacaactcttgcaaaactgttgtactcccatcactcaacgacagagcagcaattccaacaccgggctttcgtgtcactctctccgggtgccaatctcaccgacactcttactgatattttattgcaagtaggagcatataatgatgatgcaacaccatattgtgggaccggaacaccgcaccaacagtatctcattgacaatatatcagcttatctcattggcaaaaagtaagcagagttctttagaatgatgttattttaaataataatatttttttttaaaaaaaaattaacaaacatgttgatgtgtatttgatggaattaataaaaatatgttttaagagaaattaataaaaaatatttgatatcaaattctgcaggatggtcttaattagaatttctataaaaagagagtagatgagaaatacccaggggttcttctggctagctccacaagccaatctatgtttgaagcctcacccctacctatttatttaatattaggtctttccctaatattcgctatttatttgatattaaatccttccctaatattcgtgtttttaaaagagagtagatgacaaacagacatcaaattaagctgattgtttttcgatcatctcaaaggggaagcttctcatgtgggtggactcatatcttcgaaattattatatagttgcatgtattagtgctaatatattgaggcttatttactttttttcaacttctgaaggtatcttattataattgatgacgtttggcactgggaagagtgggaagtcatcagaaagtccattccaaagaatgatctgggtagcagaataatcatgactactcgtcttaattcaatagctgagaagtgtcgcaatgatgacatggatgcgtttgtttatgaaactgaggctctggattatgtggatgcttggttgttgtgtgacaaggtagcaagaaagtctgtcacatgtatgaacattaatccatgctatgatatcgtggacatgtgctatggtatgccgttagcactaattcgtgtgtcgtcagcattggcagaagagatacaagctttagacagtgatgaacggcaaatatggagggctctgagacgggtagaggatggtattttggacatcccatccttgaagccattggcagagagtttatgccttggttacgaccatcttcctctctatctgaggactttgttgttatgttgtagtgtgtaccattggcttgatggtgggattgttcaaaggggccgtttggtcacaaggtggattgctgaaggatttgtttcagaagagaaagcagcagaaggttactttgatgagcttgtcggcagaggatggatgaagcatagagggttgaacgagtatgagatccaccctatgatgctggccatccttagatacaaatcgaaggagtacaattttgtaacttgtttgggtacgggatctgatacttgtactagtgcatctctatcctactcctctccaacaatggcgattcgccggctttgtcttcaaagggggtacccaatgaaatgcttctcaagtatggatgtgtcacacactcgcagccttgtcatccttggcgacgtgataggagtccccttggatatgtttaaaagattgcgagtgttggaccttgaagataatatcggtatagaggactcccacctgaagaagatatgtgagcagctagagagcctcaggctgctcaagtacctaggtctcaagggtacgcgaatcactaagctcccacaggagatacagaagctgaagcaactggagattttgtacgtgaggagcacaggcatcgaagagctcccatgggagatcggggaattgaaacaactgcggactctggacgtgaggaacacgcggatcagcgagctcccgtcgcagatcggggagctcaaacatctgcggactctggacgtgagtaacatgtggaatatcagcgagctgccgtcgcaaatcggggagctgaagcatctacaaactctggatgtgaggaacacgtcagtgagagagctgccatcgcaaatcggggagctgaagcatctgcggactctggatgtgaggaacacgggggtgagagagctgccatggcaagctggccagatctcgggatcgctgcacgtgcatacagatgacagtgacgagggcatgcggctgccagaaggcgtatgcgaagatctgatcaagggtattcccaaggctgagctcgcaaagtgcagtgaggtcctatccatcaatattgtcgatcgtttaggatctccccctattggcatattcaaggttattggcttgcacaagagtatcccgaagctgatcaaagatcatttcaatgttctttcttccctagacatcaggcggtacaacaagctagaggaggatgaccatgagtttctagccaacaatatgcctaacctccagatgcttgtactgaggttcgaggccccacaaagagagcccatcatcattaaccgcacaggcttccagatgctggagagattccttgtggagagccgggtgccacggataaccttccaggaaggagccatgcccaagctcaagcatctcgagtttaagttctacgctggcccaccaagcaaagatcccataggaatcacccacctcaagagcctccaaaaggtggtctttcgctgctccaaatggtacaagagcgacaaccctggcatcaaggctgccattgacgtcgtgaagaaagaagcaaggcagcatcccaaccggccgatcagccttctcatcactgagggcgataaggaggtaccgaatattgaggcacacgggagcagtgaaaacattgtcgttgtccacgctgctcctgacgacgccatcagttgctctagctgcggccgaaccagcactagtatccaagagggaacagtccgagatcgaataccagctatggatttgttctggccggagtttaacagctatgaaaaagcaaaaagaaactagctagtgctattgtattctaattttacctgtactctgtatagaaaaatctctctttcattcatgtactcatcaaagcctcctcttaatttttgttgcctctgttgctacatatgctatccatcgtacgtcaagatagtaatgtgtgtagctccttattttttttaatttattgagaaattaaattgtactttatgttggatagggtgtaccttttcgtttcatttatagtgccacgctccaaaattcacctactcccaaacttaataagacccattcgaaactaatgactgcatttaatttatcttaaacatattatacttgtcactcttccgaaaagtttatccgcttgattatttgtgtcacgcttaaaaaaatatgatggaaagcttggggtaatgtgctccattaaaatagttaacttggaaaaatcaattggtatagttaacaccagaatttggtatagttttttagcagattcggttaagaaaagaaatagattggtagatgaaagtttatatagataaggccgagtttcagaagaaatcgtgaaaaccacagcaagatagattcatatttttcaaaaaaaaaagtaataaccaccgatgaacctatatatgtaggtacattttactcttttgtgtcagatttaatttggtctattcattgaagtaattctaaattgatgacaaccccaataaatgacatcaaccggatgagtatatattccttttagcatgtagagttggaaattaaacgaactgcatcagtaatctaactgcacatgctagatgtacaatctctacaaattcaaggcatctaaaagaaaaggacaaaagaggaaggagtctatatgttgctagattctgctagctagtagaacatgacgaattatcgataaacaaaattggggcgtaaaaattttcatgttccatcccaagcatgggtgctattctagctactaccactatataggaggtccatcaaacaccaagatcaatgtatacatagaaaaagatgtattcgtaggacaagattaatttactaatcactacccattcaaatattcatctaatcagatgttgttcttacagttaccaagtactgcattttttatattgaattctagaagaagaagaaaaaaaatatagaagtactgatctctggctctcagctgcatgtgacatgcatcatacatgtat

SEQ ID NO: 721 - DNA, 8011 bp, Oryza sativa; identical to SEQ ID NO: 631

SEQ ID NO: 722 - DNA, 6686 bp, Oryza sativa
agttatttataaattgtattcctatatggtctctaaactcttcttctaatatttcttatttttaaattccaaatttcagttatttctaaactctttctaaagtgtatttctacatggactgtaaactctacttttacttttttcttatttttaattccaactttcaattcttttaaattcctttatgaactctaaactttatgaattttaattatctctaaattgtattcctatatggactctagactcttcttcccatattccttaatttttaattttatttatttctaaaatgtatttctatatggactttgactatacttttattttttaaattttaaatttcaattaagtctaaatcgtattcctttatggactcttcttccaatatttttttaatttctaattttagctatttaaattgtatttctatatggactcgttttttattttttttattaatatgagaatttttaggccgtgagagcgaacatggagactctttttttattattttgatatgttaatagattgtaacccctaataaaaaaaatcatacaaaatgtatgtcattttgaagaaacaatgattatgtagattctcatcaaccatagatgaaaaacctcaatctttaaggtggtattttaaatagctttcttatgttttaatcaacccgtgattttgtaattcatatccattcatcgtacgacctctgtaataattggttatagtttcttaggaatgaaatatattattaaaaaaatatgtttttgaagaaataataatccctcaatcattcttacttctctaggctcgtatagtataaatgtaataataaaaaaatagggtcgaaaattgttgttattatgatcgccatcacaccatgttcatcgaataggggcttctctgcaaaatgttttatcttattctactagtactagtagggatgaaaggaaggtaatgtaatagtggagtttttgttggacctgagtgcaactcagtgtctgtcggcttttgcttctgcttctgcttctggttctggttcgccttcctagttcctacccccaccagcaagcagcagctgaggtgaggtccgtggcgttggagtgaggactgaggaggaagaagagggcgggatctagggtaccggatgcgctggctgtgctgagtgagagtagagatgagcgcgtctcggttcatcaagtgcgtcaccgtgggggacggcgccgtgggcaagacctgcatgctcatctcctacacctccaacaccttccccacggtaggcaatccgttctttccccccttcttcttctcgatccttcctgcccgcccgagtatgcatctgatcgactccatggtaaacattctttttcttgtcttgggactggggactggggactgggtgtagagaagacatagatcagctttccttccctttttgcttgctaaaatttggggactgatgattatgataacgttattcttctatacgcgtccttctctctgcgggatccaggtgccttcttctccaggtataggaattaggatagtattgccgatttctcagctgccaacattcactccttatacagatctaaatatacactctttagcttcacctccagattttgttgtattactatcaggagtaaataataaactcataaatatatgttgcggtatgtctgactttttgtctgctattactaaccgtggctccatcattccgtagctaatcgccaccattgacctctagacgtttctctttgttggtgaatttgttttagctctgtatcattctaaccgtgacctctgtcaatcaccgtcagtaactcagctaccccttttcgttttgtgcgaaaaaataaatctaatgtattgcatctttgcatttttaattggcagactgtatgtttaatgggacatttcttcatctctatgttacaggactatgttccaactgtttttgataacttcagtgcaaatgttgtggtcgatgggagcactgtgaacttggggttgtgggatacagcaggttctactttcccctccttttaatggatgcatgcgtaaacctccttatatacatccacctttcacggtcatcaaaataaataaaaatttgacaaatttaacaggacaagaggactacaataggctacgcccgttgagctatcgtggcgctgatgttttcctgctggccttttctctgatcagcaaagcaagctatgagaatgtttctaaaaaggcaataaaatcttgccgcccactttctttgctctctctccatgaagtaccttagcttagtcaacctgttatcttgcactgacacatatatatttctgttgtcagtggatacctgaattaaggcattatgctcctggtgtgccaataattctcgttggaacaaagcttggtatgcccttccaactcttgttgcatagcatttgtgcaaagcatcacatatctgtagaattaagctattatattttcactcccacttaccagcagcttggcgttgcacttaactgagtggtgattgctgtcttcctataaattgtctcatcatttgagtgcttgtgtgctgtgaacactctatgaaagcatgtttgtatatgtaaattcaattttactgttattcacagcaaagccatatgcttatgatatctgaaaatcatatttaaatgtaaaatatttgcatgtggaaatctatgtgaacatggtttcatggaagacaagatatttgaattcgacgatagcatgattgctgcccagcagtgttttgactgaatatatggcattataccttgaaacatgttacctgtaacacatgaagtgttatatgctatcaggggacatttgtagatgcttggtgacctggtgtccctcaggattgcaggacatgcattatatcaagaatgtttgttttttggtgggtgacatccttagactaacgctgaatgtttttttttttcaaatttagattttgtggggaatcggtagctaagagtctcttattccactatgggtggcatagttccattagaattgctggataaaaaatctatgtggtttaatgctagtcaataataaaggagagttaagggtttgtccagggccgtctccaggaattgggggccccggagcgaaatataatttgagatcctaaatttacttttgattcggtccttaatttaaattcgtaattatattcatggtaatttgatttgaaaagaagagtactgaaatattcaattgatcattacatgcatgcaattcaacaattgagtatcaacaattcagtattagaaactctaatatgatagacgaggtagtcggccagctgctctgggcatcgtaaccattgatcaaggattcagaagctggttcgcatgcatgcacatgaacacacacatgacatcagttgtatatgctaaggctggctggttgtactggtctctctgatttgggggccccaaatttttgtggggccctgcgctgacgctccgttggcacgccctcgttgacgggcctgggtttgtcccatcaccttatggctcattttcctgttttgaacaaacttatggctgtcttatggtagaaagctggagatgtaaatcatttccattatctaagaatgtttgaaattaatgctttctttttttgcttgattgttaaccattacctcagcaacatttcacatgctatgacagttgagtatcatagctagtttgagagacaaatgagcatgcaatggttttgtttgtatttcattgagaccttgacgatcctgccctgcaaatgggtctttactagtctccaaagttaagcctgtgacctatactccagttggtcctgtacatatcacttattgatttatgatcaagaaaagaaaattcctctgaaatatattttgtcttgttccttcagcaaatgctaaatgttgataaatctgcatttctagttttcatgctaagttgctaataaaaaggcacatatgacccgatccaataccttacactgcatgattgaataccatgagaattccattctgttgatctcacaaggcaggtgggcttttaggattgtcccctgggaacacatcctctgtaggctatttattcacggtttcatactgcatgctcagttaaaatggcatctagcgaacatttgaaaggctcaaaatggatgttcaccattgaatttctgctccagcggagcaagttataaatagataaagcctgtacagctaacagcaagttataaatagataaagcctgtacagctaacagccttgtcaacttactggccttagaggcaagttaggtggttagagacttagtcctcactgaccaaaatgggctcttgttagattatgttcttaagttggattactggagttagaaatcaggttcgatgtagcagctttggtggtgcaagttgtactttgctcctgatacaatcatacacaatatagttttcagaaacatgtcctagcctcagcatgtaaatgcaatattcttttgcttttctgttcattgtgcttttattaatcacttgcgtacttgatgtaatccggcggtgcttaaccattaagttactgttaatagatctgcgggatgataagcaatttttcgtagatcaccctggtgctgtacctatttccactgctcaggtattcaaagcttagtttgcttgtatttttgttgcttcccagcattgttacacaagtcattaaaattattttgctaatcaatgtagggcgaagagctgaggaaactcattggtgcagcggcatacattgaatgcagttcaaaaacacagcaagtactacattttattcttcttttttgaaaaagggttcattttactccctcaaattattttgccaaagggcctaggtttttatggttcaccccttaaactagtaaaagggactctactccctaataccatttcacttttttattctccacatacggcaacaggacctgtgtttacagttttttcatgacaattgacatgcggttttaaatctccatgtttaatcagtgttaggtgcttgcaacttgtgcaaacagtgatcttttaaatatataaaaaggttgagacatatggtgtaatacgatttatcatcccacaaacttaacatacaacttttataaagagaaacaaaaaatagtgagcccaaatatagttgaggggtttgattgctgatccggtgatttttgaatcaatgctgatccggtgatatagttgaagggagtaaaatggacttgttgcgttgagctccattgcggtggcatggttactgattgctgctgctttgcctttgcaactgcagaacatcaaggcagttttcgatgctgcgattaaggtggttctccagcctccaaagcaaaagaagaagaagaaaaaggcgcagaaaggatgtgccatcttgtaattaaatggtagacagtgcagtgcagatcgatgtatcccttcatttgtagcctctggcttcaatcgtcgcttgtttgtataattacgctagatgccaccggcagaagatataatatagtcctcctgcctttgtggtgttggtctctaaggtcgtccagactccagagtccagacgcatttggtttcttttgttctatctataatcaatctatctatatctgctagtgttgtgcttctgctagttatgcggatgagaaagggaatttaccttccctgtttctgggcttctggcttgcacgggaaaggtcggtttgtttgcaatatactactaccactccagcttgctaggttgattaaaataagctaccagtaagaatcgatatgacgtatcagcattttattaaatcagtgattaattttatcataaccttatattctactctccgatcgttctccatctctttccctagcggtcttgcaatgcttggtgccgtgtcctcgatgggaggatcattttggcatcgccattatgtctccctctttgtttttcacagtgagttgcatggccatatgtaagttgtgtttagttaagcgtaaagtttggataaagtttagattttgattgaaattaaagataatgtgactgaaaagttgtgtgtatatgacatattgatataatggaaaagaactgaagtttggatccaaactttatatctaaacaagaccgtaatatcgaaatccagaacagtactgaagttaaaagcgcaaaagcagttgaccttggcatgatcacacacggcatctggactggctacatcaaacgatcggtatatataggcatccgttgatcttgttattgttgctgatatgccttacaattaattatagagatgattgcatcacatactatatttataactttgaaatagataactcattattggttaatgaatatgtgatttattcatgtgacctttttatgttgtatgttgctatttctaaagaatccttaatcaaatatcatatgtggaacaaatatggtttaatgatcaacacatgtattgaatgatcatgtcttatgaatcatggtatggaggcaccaaattaataatgtggacacatgttggaaaacatgttgttggatagatctaacatgagaggctatatatgacgtgccatcagtgatcttatttagtgttagtgtaaatccttagacctgagattattatgattcccaatat

SEQ ID NO: 723 - DNA, 4532 bp, Oryza sativa
gtgtggtgcacgcagctagcaatattgaaattatttggtcttctttacagcaaaataatgtagtatgatgtgtcttaggccccatttgattcaaaggaaattcataggaattttagtggattttattcctataggaatttttcatacaaagccctttgaatcaaaggaatgaaccctatgaaatcctataaaatttctatggaatgcctcttcccatacaagttttagaggaattttaataagaggtcgaacctcatggaagaaatcctttgagtctttactctcctcaaattcttgtgttttttctgtggttcaatcaaacggtcattcctaaaattttcttgtgttttgcaatactctgttttacacatatattcctgtcagaatcctatgtttttcttattcctccgttttttcattcacaaaggggcccttaataactgggatacctcaataatttcagatggctgcgtcatgtacaatggatgaaattattcctgccacaatctaatataagtccatccgtttctttccgttactactaggtactagccggcaatgaaataaccattaaaatattattttccctgagtcatcttatacttgaatttggtaatggcagtagcatcaatctttcagaaaaaaagagatgatggttctccgttgcagttgcctgatgcggacacgaatacacgatgaggccgtcgccgatggtgtactttgcactcgccgagggagcaaagcaaagaatttctggctgccgttgcagttgttaaactatagtaggcccatacctcacggacctgaataatcaatgggctgcgccttgactgtacatctgggatgggcttattagtgcagcccatttaactggacggcccaaataccctgaccactggcatctaacggctaggatcttccaccacccgactccaaagtccttcctaacccagcgaaaaccctagcgcccgcgccgccctcggtataaaaggcctcgcctctctaatcacccgcttcgcttcccaatctctccccagcgccgccgccgccgccatcctccccgagccctagctctcccctatccctcgccgcacgcaccaccaccaaccatggccggcgcgcaggagtctctggtgttggccggcgtgatgcacggccacaacgacgtggtgacggccatcgcgacccccatcgacaactcgccgttcatcgtctcctcctcccgcgacaagtcgctgctggtgtgggacctcaccaaccccgtccagaacgtcggcgagggcgccggcgcctccgagtacggcgtgcccttccgccgcctcaccggccactcccacttcgtccaggacgtcgtcctcagctccgacggccagttcgcgctctctggctcctgggacggcgagctccgcctctgggacctctccaccggggtcaccacccgccgcttcgtcggccacgacaaagacgtcctctccgtcgccttctccgtcgacaaccgccagatcgtctccgcctcccgcgaccgcaccatcaagctgtggaacaccctcggcgagtgcaagtacaccatcggcggcgacctcggcggcggcgagggccacaacgggtgggtctcctgcgtccgcttctcccccaacaccttccagccaaccatcgtctctggctcctgggaccgcaccgtcaaggtgtggaacctcacgaactgcaagctgcgctgcaacctcgagggccatggcggctacgtcaacgctgtcgcggtcagccccgacggttctctgtgcgcgtccggtggcaaagatggcgttaccctgctgtgggacttggctgagggcaagaggctgtactcgcttgacgcgggttccatcattcactcgctctgcttctcgcccaaccgctactggctctgcgcggcgacccaggactctatcaagatctgggatcttgagtcaaagcacattgtgcaggaccttaagcccgagatccctgtctccaagaaccaggtttgtttctccaccttatgcttcatagtggtcatcttgttagttatggaaattatagctattgtagtatacttaggtcgcatgctaatgctattcatatgtggtgagctaatgcttgatgtaccatgttattcagtttgatgcagttctatattactgtcattcgtccacatgattatttgtgctataatttaatagatacttcctctgtttcacaatgcaagtcattttagcatttcccacattcatattgatgtgaatgaatctagacatatatatctatatagattcattaacatcaacatgaatgtgggaaatgctagaatgacttacattgtgaaacggagggagtagttcctatggtctcctttgttgaagttgataacttgtgctataaactatggttgtgaactcaattgtaacttgtttctagcttttatttgaatattgtacttatgcaggatgatggtatttagtttggcaactcttctgttaagaattgtcattgctatatcttagaatctgttcttttacattgttggttattttttgcagtttcaaatcggtacgacaatgtctatatatggtctgatcagcttagactgtatacactaaacatcttgattctgtcatcttaaatatttgattgttagatgttaagttaaattcttatctaccaaaataaagattcattctcataatactaaacggtggaatcatttagctcatttactatctatatacataatcacattatatatatttgctagtaaacccttgaattgtagtatatttttgttagtaaattgctaggagtgctagtttatatgtttatgttactcactgcattttgcatgctattcatatttttctatccatctataaagtatcttgctttgtttatgaagtattatgggtagcttagctttttaagatgaattttacttgtttatgttttatttttctcttggattcactgttcttatacttgtgttggtaacctgtattctcagagtagtatgtttaagctggttagtcataggaaaactttactgtacctttctgatggactattttttgatacatgaaaaacaatcatttttttctagaaaattctgtacctattttgttgatccttttgttgctctcttggctcttgcagatgctctactgcacaagcttgaactggagcgcagatggaagcaccctctatgctggttacacagatggaaccatcaggatctacaagatctcaggtttcagctacgccggctagagatggggagtgttgttttagttatcgcgttctggtaaacgactgtggtatcaccctagtgttctttttggctgtttgaaaggcattaatctgcctgagtacttctgcttaatttacccatctatgtagtagctccagtactgagctcatggatactgtggaatagggatctgttttgcaccatgttttgttttgacttccttttcaatatattgtctgatgaaccatgcgatccatggtgcttctctctttttaattctgccgcaggccgcagctgaattttctttgtttctttttcgatcagtgaagtggacacataaattaatctgcttcttgttttgcctgcctgatctcgccaaggtgttgcaaagatcgcgtcgcctgcgcttgtcgcaaagcctttttcgccggcgaagctacctacagataacagtggcgccaagttcgcaaagcatcagacctcacctcactcacggatggtagttgtggatgttcactgttctggttttccctctacgtggggtcggctgacccatcaacccagcccacaaagtaggcacggagcagaacccatcaaatttgatggatcagatcatgggtggaaaaagtacaccgaaggtcccaaaacttatcatcgagttacaaaatcgttgttcaaccgtaaaaccagatatatgacattcgtcaacttacaaaaccattcaatttagatcttttgatgattttgaccttggttttattcaacgtggcggctgagttaatgtgggatgccacatcagcaccctctctttttcccctcctctcctgtccccccctccatctctctcactcacacttttgtcgaggagcacagccagcaggggaggagtgccggcgcggcgggcacgccggcggctggcgggggagtagacgtggccggcagggggagcgcggcggagataagggccggcgcggcggccggtgagggaggaacgtggctaagaggagggctggtgcgactggcggcagtcagcgacgcggagcatgacgacgacttggtgcccctcccgtcagccctatccctgctgccgtgcccccacccctctgctcccccgcctctatgctccgcccgcccatagccgccaccaacgatgaggctaagcggcgcggagtcgtcagcgccgtcgctccccatccgcaaccgtgctcgcctgctgccgccgcctctctgttaccgcgctcgcctgccgacgtcgcctctttgcttgctctagccg

SEQ ID NO: 724 - DNA, 4496 bp, Oryza sativa
taaggctcaggattaccctctaccaacgcaaacctatcttacaactgcagagttaaaagaataaaaaaaactcgttgattctgatacatctttcggttgcctttctttctgaattttgacatcacttttgcaatgtgatttgctggtttggatagtggagaagttgacaggtgcagatgttcaatggtggattaggcctctctatggcttttaggaatttattattatttacgtatatctaatcccaaaagcgaggattctcttgcagcttctactgctagtatgatttcacagtgtttatctaggtgtattattccacacgtgttgcaccggattgtaattgaagctccagagtgacgtcagacggtcagagtgagaaccccgcaaaaaaaaaaaaaagtttcacggcgaaacatagggctcttcaccaatccggcccaatgagcccaagcagaagaactcattggtccaccaaagtcttcgatatttcggaaagaaaattaagatactgcaagcctgcatcgtatttttcaaatttcaattcacactatctctcacagctcacatccaaattgaacagtcctatcctaaaaaaaaaattgaacggacacagcatcacttgaaattctgagttgaatggtgcaccttgttttcaatgttttcatagtttgatccgcactgtatttttcacagatacttccatcgtcaaaaaaacgaatttaaaattggatgtgacatattctagtaatccattaacacaataaaactatgataaaactactgaaaaaaatatctaaattgaacgggcgcagtataacttattcaacgaaatacccgattatttagagttcataggtcgacgaaagaaaaaaaaagaagacatacactcttggccgttcgatcccatccgacggtcaggatatcccgtccacgtctctagcccagataaaccctacccccccactcctcccgactataaattcctcggcttctcccctccgccgcctcctctcctagccttcccctcctccgccgccgccatctgccgtcgagagccccggttgcccacccccgcggcgacgatggcgggccaggagtcgctcaccctggcgggcgtcctgcgcggccacaacgacatggtgacggcgatcgcggcgccgattgacaactcgcccttcatcgtctcctcctcccgcgacaagtcgctgctggtgtgggacatcaccaacccgtccaccgccgtggccacggatcccgaggcggccccgccggagtacggcgtctcgtaccgccgcctcaccggccactcccacttcgtccaggacgtcgtcctcagctccgacggccagttcgcgctctcgggatcctgggacggcgagctccgcctctgggacctagccaccggccgcaccacccgccgcttcgtcggccacaccaaggacgtcctctccgtcgccttctccgtcgacaaccgccagatcgtctccgcggcgcgcgacaacaccatcaagctctggaacaccctcggcgagtgcaagtacaccatcggcggcgaccatggcgccggcgagggccacaccgggtgggtctcctgcgtcagattctcccccaaccccatggcccccaccatcgtctccggctcgtgggatcgcagcgtcaaggtctggaacctcacgaactgcaagctgcgcaccaagctcgagggccacaacggctacgtcaacgccgtcgccgtgagcccagacggctccttgtgtgcctccggtgggaaggacggaaccaccctgctctgggatctcaccgaggggaagatgctgtacaagctcgacgccggcgccatcatccactccctctgcttctcgcccaaccgctactggctctgcgccgcgacagaggactccgtcaagatctgggacctcgagtccaagctcgtcatgcaggacctcaagccagaagtccaggccttcaagagccaggtataccttttgcactttgcctctctcgttagccttgcttgtcacatgtatcgtgcattcgttgctgcctgaatctgaataggatgtaccgcgtgatgcatgttctgtcgttctgtctgattaggatgtattgtgtgattcgttccatcgtggttctcgcgtgttgcattttggattcctggtgctattattgttacgcccttcaatttatcaggatcctctgtagtaggatagggtagttttgatgcttattaagctcattgcgagcaggttatccaatttaactcacagcatcatgttcatgtggtcaagcatcacatgtacgtatgttatcagcaggtcatatacataattagtcccgctgatttatatttctaggtaccgaatcctctgttctgtgttgatctaatgatctaatcagttttatgatctgttctcagtaatacgtactcatcaatgatgctgttgatgtttatgctcatcccttctccactgaattgtatacatgtatttatattactatatactaagtagatataaaatgctgcattttatttgtttacatgttagtttcatcaaccatggtgctgattggtccctcatgtgcctgtgtaactatttggaaaccagcatttcggtatacctctgcatatccttgtagagctgtagcaatattagtctctgctataagtaattcaatttaacttcaaactataatttgaccgcaccttctcactagagtggtacagttttgacaaagttgatctttacaccttgaattttgtgttagttttgcaaacttttcttaatgttatgttttgtttattttctaccacggaaaccttttctgttacagttctcataccccttttgattgagcacatgcaatttgttatagaggatgtgcattctccttgaaatctcaatagtccttaaattgttctattgtgcactttggctgtttccccctagacttatattctactgtgcaccttgtattaatatgtattcaattctttaactgaacttgattacgcatttattttccttaaaaagaatgtgtactgacacctgccgttacatttgcttagatgctgtactgcacaagtttgagctggagcgctgatggcagcaccctcttcgctggctacactgatggaactatcagggtttggaaggtctcagggtttggcggctatgcaatctaggtggtgaatttgttgaaaggcttaggaatcttaatttaaacatcgtgatgcctatcaagtttttgacagttctgaggcataacatttgcctggtactttctacttcattttcattaattaatgattagatttgccaatgagcttatcggtactctggaactatggaagaggatccttatgcatattttttgtttttggctaagttgaaaagatattagttatgcaactttcggagcctcattgcctagatgtaaataatgcttcatcaattgctattttctgatgattttgatggtgctaattagcttttcatctgccgctgataccttaaatcttccatttgtttgccttattttttattatctttcattctgtggtttttaccgtcaccatcaggttagtttgttctggacatgtacattggatgttattgcgtttgtaatatgtgatgtttatttagcccctaaaagcctcttaagttaagaaatagtatgtggtataactacgacagaccgaatcacctggtgtggctgtcatctagcataagcattgaccgtattatctgcatttcataatcaaccacagtgttcttcagttggataatcaactgtcacctgccttctgttttcaactgtgaccatcgtcgtcatatcttgcctaacctctatcattttttaatttcatcgtcttctatgattgaaattttctcaatgcttagtttcttattaaatctatgattggaatttttctcgatgattaattacttatttaatctcaaacacatggttatgcaatccttcacgcaaactgcgtcctcgaccaatccagtttcacgacgaagtcgtcgacccgaacctggtcaattattcttcttcagattcagaaatcaccatgtattagcaactctcttaactcgtctaaaattgcaccaattcattctatcattgttgccgccatgtcgtcgtcttcctcattgtacaagcagctcggcctcggagccggctctcccgtctccgcctctcacctgcttctgctcgtcctcggcgccggcttcctcgcgctcaccgtcttcgtcgtccaccccaacgagttccgcatccagtctttcttctccggcggctgcggccgtcctggcacggacgccgccaccgccgccgttgctgcctcgccggtcaagaatgtcagcggcggcgcaagtgatgctgctgccgcgaccacggcggcgcggtcgccggacaacgacgtgagggtgctcatcggcatccagacgctgccgagcaagtacgagcggcgcaacctgctgcggaccatc

SEQ ID NO: 725 - DNA, 3343 bp, Oryza sativa
ccacacagcgacagatccaccaccaccgaccttgggagtagcggggcctcagcggtgacgacgatggtagatcgaagctagggtttctattttttttgctgcaaaaatcactttttacacatgggtacatgtatgttttttacatacacctagtgttaggtgggccgtccacccgttcgcaaagatcatttatgcagtcgtcatgataggagatggaaccatggaggcatatatgcaagtatttggccaacatgtccaatgtccaccagattgggacgtcaatcctacccgtggtatgggtatattaccgtgcgcctgatatttacgtacgctggtttaatatatttttaaaaaatttgctacatactccctccgtccccaaggttggctttttttttttgagggagagagtaatatttagagtttgtggtttttgttattgaacaccttaaaaggcatgaaacgacttgtcggagaacgaatctcctctagcagggaagcaacgaacctcccaaaaaaaaacaaaaaaaaactcctcctttcatgattcaaccaaagggcaatttgagatcgagcctactttgtgtgatgaactcaaaacacaatcaagtatacttgtgtgatgagcggtgagccagatatgttcctgctctgtccgtgctcgactcaattcattgtcaaccctagcgatttccattaatgcaatgactatatgaaatgcaaagatgtactatatgactactagttggatgcacaatagtgctactatggaaccccttttcccctctaaataagtagcgcatccctaggcaaaatgactttccaataatcacagttagtaagggatgcatgcatatgcatgatatagtgatgtctgttaatcgtggcaaattggcaatgcaatttgttgttgaaaaataccaagatgccaatactacgcccacttcccgcgcgctctatataaagccatgcgctcccatcgcttcttcctcacaaactttccctcaatcagtcaatctgtatacagcaactcagcgatcttatatttacccaacacaccatgagagcgctcgctgtggtggccatggtggccacggccttcctcgcggcggccgtgcatgccgagcagtgcggcagccaggccggcggcgcggtgtgccccaactgcctctgctgcagccagttcggctggtgcggctccacctccgactactgcggcgccggatgccagagccagtgctccgccgccggctgcggcggcggcggcccgaccccgccgtccggcagcggtggcagcggcgtcgcgtccatcgtgtcgcgctcgctcttcgaccagatgctgctccaccgcaacgatgcggcgtgcccggccagcaacttctacacctacgacgccttcgtcgccgccgccagcgccttcccgggcttcgccgccgcgggcggcgacgccgacaccaacaagcgcgaggtcgccgcgttccttgcgcagacgtcccacgagaccaccggcgggtgggcgacggcgcccgacggcccctacgcgtggggctactgcttcaaggaggagaacggcggcgccgccgggccggactactgccagcagagcgcgcagtggccgtgcgccgccggcaagaagtactacggccggggtcccatccagctctcctacaacttcaactacgggccggcggggcaggccatcggcgccgacctgctcggcgacccggacctcgtggcgtccgacgccaccgtctccttcgacacggccttctggttctggatgacgccgcagtcgcccaagccgtcgtgccacgcggtcgccaccggccagtggacgccctccgccgacgaccaggcggcgggccgcgtgccgggctacggcgtcatcaccaacatcatcaacggcgggctggagtgcggccatggcgaggacgatcgcgtcgccgaccggatcggcttctacaagcgctactgcgacatcctcggcgtcagctacgacgccaacttggattgctacagccagaggcccttcggctcctaagcttcgcctacctagcttccacacagtgataaataatcactgatggagtatatgtttacaccatatcgatgaataaaacttgatccgatcgacgacgatgatcagtaatgcacgacgaagcgattggtaaaatataatgtattatatggaaagaatacagtaccacttgattaatattgtatggaaagaatacagtatcatcgagtggacaaaaatcggagagcgtgaaatcatagctactactaattgatgtgcagcatacccatgaaagatattccgatatacatcaaaatgggattaattcagcccaatcgatgtacacgtccacgtctaactatggtaatcaaacccatgaataagaacttgtagtctcttaaaatactacaacgataatttagtccgtatatttgttttgcattaaaatattattatattttttattaacttgattaaacttaaaatagtttgactagaaagaaaatcaaaacgactcataattaatatgaaacagaacgagtagcaattattgacactatccaatgtctttcttccttcgactggttatgggcagtcttcggattactagatccttcagaaatattttcttcatgtttgggaattagttatataacgggatgatgaatgggaagtggattttgatccctcgagggattccctcattgtttgcatgtcactcaaatagttatgaaaaaaatttgacaagatgtattaacatgtgatatatcactctgcaaatatgcaagttcaaattcaacttatacatctcgcaatgaaaaaaaacaaatttaattgtgaatatatgttaactacctatggtttaatttgtttttcgttacgagatgtagaagttgaatttgaacttgcatgtttatggagtgttatattacatgttaatacatctttttaattttttctaatttttttataatcatctaagtgacatgcaaataacaatgggatattccctcgaggatcaaaaatagtttccccgatgaatgtaaggtttgaggatttttttttcgcgtggctgctttatgttgggttaactaattgtgttgtttctgcaatagcaatgacacactatacttttttgttttgcactacgtctgtcaaaaaaaaacaatatagtattggatatgtggcgtttcttagtacaacgaatctgaactattatgttggtttttttttacggagggagtatgttgtttggttaaataaaaatgatattgctttttagaaaagacgaaaaaaaactgcatgtctaaccctataaatggctga

(The sequence listing continues in the following parts.)

What is claimed is:

1. A method of providing a modified rice cell having a modified genome, comprising effecting in the genome of the rice cell targeted modifications that result in a change of expression in at least two genes, wherein the targeted modifications comprise an insertion of a predetermined sequence encoded by a single stranded DNA donor molecule, and wherein the insertion of the predetermined sequence comprises a transcription factor recognition site sequence;
   wherein each targeted modification is located at one or more site-specific double-strand breaks (DSBs) introduced upstream of, downstream of, or within the two genes;
   wherein the targeted modifications are effected in a rice cell by a site-specific DSB-inducing agent and at least one single stranded DNA donor molecule encoding the predetermined sequence, wherein the single stranded DNA donor molecule contains no nucleotide sequence that is sufficiently complementary to permit hybridization to genome sequences immediately adjacent to the location of the DSBs;
   wherein the at least two genes are associated with the same trait, wherein the trait is selected from the group consisting of abiotic stress, architecture, biotic stress, flowering time, nutrient use, photosynthesis, and senescence; and
   wherein the targeted modifications improve the trait in a rice cell comprising the targeted modifications relative to a rice cell having an unmodified genome, or in a rice plant grown from or comprising a rice cell comprising the modifications relative to a rice plant lacking the modifications.

2. The method of claim 1, wherein the site-specific DSB-inducing agent is selected from the group consisting of:
   (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;
   (b) a polynucleotide encoding one or more nucleases capable of effecting site-specific alteration of a target nucleotide sequence; and
   (c) a guide RNA (gRNA) for an RNA-guided nuclease, and a DNA encoding a gRNA for an RNA-guided nuclease.

3. The method of claim 1, wherein the single-stranded DNA donor molecule has a length of 18 to 300 nucleotides.

4. The method of claim 1, wherein, after the targeted modifications are effected, a loss of epigenetic marks occurs in less than 0.01% of the genome.

5. The method of claim 1, wherein, after the targeted modifications are effected, the modified genome is more than 99.9% identical to the unmodified genome.

6. The method of claim 1, further comprising the step of growing or regenerating a modified rice plant from the modified rice cell.

7. The method of claim 1, wherein the trait is abiotic stress and each of the at least two genes is a gene that encodes a protein having at least 90% identity to a sequence selected from the group consisting of the sequences identified by SEQ ID NOs:932-1172 or is a gene having a sequence selected from SEQ ID NOs:210-450 or is a gene selected from the group consisting of AP2/ERF-N22(2), AP37, ARAG1, ASR1, ASR3, ASR5, COLD1, CTB4a, CYP-like, CYP94C2b, DCA1, DREB1A, DREB1B, DST, EG1, GA2ox6, Ghd2, Ghd7, glyoxalase II, glyoxylase pathway, gr3, GS2, JIOsPR10, LOC_Os03g61750 (OsTRM13), LOS5, LRK2, microRNA319 (miR319), MicroRNA528 (miR528), MIDI, miR169r-5p, miR390, MSD1, NF-YC13, NUS1, OCPI2, OgTT1, ONAC022, ONAC045, ONAC063, ONAC095, ONAC106, OrbHLH001, OrbHLH2, Os09g0410300, osa-MIR393 (miR393), OsABA8ox3, OsABF2, OsABI5, OsABIL2, OsACA6, OsAMTR1, OsANN1, OsAOX1a, OsAP21, OsAPXa, OsAPXb, OsAREB1, OsAsr1, OsbHLH068, OsbHLH148, OsbZIP16, OsbZIP23, OsbZIP46, OsbZIP71, OsbZIP72, OsCA1, OsCAS, OsCBL8, OsCBSX4, OsCDPK13, OsCDPK7, OsCEST, OsChlI, OsCIPK03, OsCIPK12, OsCIPK15, OsCKX2, OsClpD1, OsCNX, OsCOIN, OsCPK21, OsCPK4, OsCPK9, OsCTR1, OsCYP18-2, OsCYP19-4, OsCYP2, OsCYP21-4, OsDERF1, OsDHODH1, OsDi19-4, OsDIL, OsDIS1, OsDREB1A, OsDREB1B, OsDREB1F, OsDREB1G, OsDREB2A, OsDREB2B, OsECS, OsEm1, OsEREBP1, OsERF109, OsERF10a, OsERF3, OsERF48, OsERF4a, OsERF71, OsERF922, OsFAD8, OsFKBP20, OsGGP, OsGL1-2, OsGL1-6, OsGME-1, OsGME-2, OsGRAS23, OsGRX8, OsGS, OsGSTU4, OsHAP2E, OsHBP1b, OsHKT1;1, OsHKT1;5, OsHOX24, OsHSF7, OsHsfB2b, osHsp101, Oshsp16.9, OsHsp17.0, OsHsp23.7, OsICE1, OsICE2, OsIFL, OsIMP, OsiSAP1, OsJAZ9, OsLAC10, OsLEA3-1, OsLEA3-2, OsLOL5, OsMADS87, OsMAPK5, OsMGD, OsMIOX, OsMPG1, OsMSR2, OsMT1a, OsMYB2, OsMYB30, OsMYB3R-2, Osmyb4, OsMYB48-1, OsMYB511, OsMYB55, OsMYB91, OsMYBR1, OsNAC10, OsNAC2, OsNAC5, OsNAC6, OsNAP, OsNDPK2, OsNF-YA7, OsNHX1, OsORAP1, OsOTS1 SUMO protease, OsPCS2, OsPEX11 (Os03g0302000), OsPFA-DSP1, OsPgk2a-P, OsPIL1, OsPIP1;3, OsPP108, OsPR4a, OsPRP3, OsPsbR1, OsPUB15, OsPYL3 or OsPYL9, OsRab7, OsRacB, OsRAN1, OsRAN2, OsRbohA, OsRDCP1, OsRINO1, OSRIP18, OsRZ2, OsRZFP34, OsSce1, OsSCP, OsSDIR1, OsSGL, OsSIDP366, OsSIK1, OsSIK2, OsSIT1, OsSIZ1, OsSMCP1, OsSNAC1, OsSPX1, OsSRFP1, OsSta2, OsSUV3, OsTIFY11b, OsTOP6A1, OsTPP1, OsTPS1, OsTZF1, OsVPE3, OsVTC1-1, OsVTE1, OsWR1, OsWRKY11, OsWRKY30, OsWRKY47, OsWRKY74, OsZFP6, OVP1, Rab16A, RGG1, rHsp90, ROC1, Rubisco activase, SAPK4, SAPK6, SAPK9, sHSP17.7, SKC1, SNAC1, SNAC2, SNAC3, SQS, TLD1, WRKY62, ZAT10, ZFP177, ZFP179, ZFP185, ZFP252, and ZFP36.

8. The method of claim 1, wherein the trait is architecture and each of the at least two genes is a gene that encodes a protein having at least 90% identity to a sequence selected from the group consisting of the sequences identified by SEQ ID NOs:1175-1348 or is a gene having a sequence selected from SEQ ID NOs:453-626 or is a gene selected from the group consisting of MIR172B (miR172b), MIR172D (miR172d), ARGOS, BZIP27, MIR156B (miR156b), MIR156D (miR156d), MIR156E (miR156e), MIR156F (miR156t), SLG, LAZY1, LAX1, CKX3, GN1A, SG1, HAP3A, RAN1, RAN2, PROG1, LG1, SDIR1, FIE2, DRM2, RMC, CDPK9, JAR1, JAR2, ERF108, FZP, G1, G1L5, FON1, FON2, FOR1, APO1, EG1, RAG, MFO1, LFY, SDG708, RFL, HD3A, MADS18, MADS24, MADS50, BRD2, SK2(T)(SCL, FGR), SLR1, ILI5, 1116, BGLU18, BU1, GIF1, GL2, GS5, LK3, RDD1, GW2, GW5, GW8, SPL16, SPL17, SPL7, D18, ETR2, EXPA4, GA20OX1, GA2OX3, GA2OX6, HOX4, IAA13, NAC2, D2, D61, CCA1, PDR6, ACO4, Rab6a, ZFP179, ILA1, OsSERK1, D11, FTL1, NAL2, NAL3, R9-LOX1, BC1, FC1, RTS, SNAT1, AGO1A, AGO1B, AGO1C, AGO3, GRF10, GRF3, GRF5, DL, DEP1, DEP3, DN1, EP2, EP3, MIR529a (miR529a), RAE2, RA, CUC1, CYP734A2, CYP734A4, CYP734A6, RDD4, APC6, BLE3, CEL9D, SD37, SD1, GATA12, PSK, PSK2, PSK3, DRO1, CKX4, CRL1, CRL4, NAC5, ABIL2, CSLD1, CSLD3, EXPA10, EXPA17, EXPA7, LSI1, PHR1, PHR2, PHR3, PT1, PLT1, PLT2, ERF3, EXPA8, SIZ1, RAB16A, NAM, OsCLE402, OSH15, PNH1, QHB, LOG1, SH4, SH5, SHAT1, SH-H, SERK1, PIN, PIN2, SDG701, RSR1, LPA1, NAC106, MADS57, D14, D17, D27, AGR1, EUI1, ric2, GHD7, GS2, IPT2, IPT3, IPTG, IPT8, SGL, MIR398A (miR398a), SPL14, ZIP4, and ZIP5.

9. The method of claim 1, wherein the trait is biotic stress and each of the at least two genes is a gene that encodes a protein having at least 90% identity to a sequence selected from the group consisting of the sequences identified by SEQ ID NOs:1349-1456 or is a gene having a sequence selected from SEQ ID NOs:627-734 or is a gene selected from the group consisting of SAP1, ONAC122, ONAC131, PI21, PITA, PIZ, VAMP714, WRKY76, PIKH, XA21, XA5, WRKY45, ALD1, CEBiP, RLCK185, PBZ1, WRKY4, WRKY70, LCB2A1, RAC1, DCL2A, DCL2B, RYMV2, WRKY51, ACDR1, ACS2, AOS1, BIHD1, BWMKY1, CIPK14, edr1-rice ortholog, eIF4G, GAP1, GF14e, GH3, GH3-2, GH3-8, GLP1, Gns1, LOX1, LTP1, OSBIDK1, OsBIMK2, OsBIRH1, OsBISCPL1, OSBWMK1, OsCBT, OsCCR1, OsChib1, OsEREBP1, OsLOL2, OsMAPK6, OsMAPKY5, OsMKK4, Osmlo, OsNAC6, OsPLDbeta1, OsPR1a, OsRAC1, OsRar1, OsSBP, OsSGT1, OsTPC1, OsWAK1, OsWRKY 45-1, OsWRKY13, OsWRKY28, OsWRKY45, OsBBI1, OsBIANK1, OsChil1, OsCIPK15, OsCPK12, OsEDR1|EDR1, OsERF3, OsERF922, OsHIR1, OsLRR1, OsMPK3, OsMPK5, OsMPK6, OsNH1, OsNPR1, OsOxi1, OsSGT, OsTGAP1, OsWRKY62, O5WRKY71, OsWRKY76, PDR6, Pi-d2, Pi37, Pi54, PiK, Pita, RAC5, RACK1A, RACK1B, RCH10, RF2B, RIM1, RYMV1, TPS1, WRKY6, WRKY71, Xa13, XB24, and XB3.

10. The method of claim 1, wherein the trait is flowering time and each of the at least two genes is a gene that encodes a protein having at least 90% identity to a sequence selected from the group consisting of the sequences identified by SEQ ID NOs:1457-1484 or is a gene having a sequence selected from SEQ ID NOs:735-762 or is a gene selected from the group consisting of CHI, DTH2, Ehd2, Ehd3, Ehd4, ETR2, Hd1, Hd14, Hd16, Hd17, Hd2, Hd4, Hd5, Hd6, OsCO3, OsCOL4, OsDof12, OsGI, OsLF, OsLFL1, OsMADS50, OsMADS56, OsPhyB, RCN1, RFT1, SES, Spin1, and SPL11.

11. The method of claim 1, wherein the trait is nutrient use and each of the at least two genes is a gene that encodes a protein having at least 90% identity to a sequence selected from the group consisting of the sequences identified by SEQ ID NOs:1485-1546 or is a gene having a sequence selected from SEQ ID NOs:763-824 or is a gene selected from the group consisting of LHY, TPS10, PAL, PAL1, OsAGPS1, OsNAC5, NRAMP1, NRAIVIP3, NAS3, ATM3, OsMTP1, OsRMC, OsYSL1, OsYSL2, OsNAS2, IDEF1, IDEF2, NRAMP4, OsIRO2, OsIRO3, OsYSL15, DMAS1, NAAT1, MIPS, OsLpa1, OsMRP5, OsSULTR3;3, RINO1, ABC1, AlaAT, AMT1;1, AMT1;2, AMT1;3, GRX6, GS1;2, GS2, NADH-GOGAT, OsAMT3;1, OsARG, OsE-NOD93-1 (LOC_Os06g05010), OsGOGAT2, OsGS1;1, OsNRT1.1b, OsNRT2.1, OsNRT2.3b, OsPTR6, OsPTR9, IPT, OsSPX1, RBCS, NLA1, OsLPT1, OsMYB2P-1, OsPT1, OsWRKY74, PHF1, PHR1, CASTOR, INO1, OsARD2, OsIRT1, and OsNAS1.

12. The method of claim 1, wherein the trait is photosynthesis and each of the at least two genes is a gene that encodes a protein having at least 90% identity to a sequence selected from the group consisting of the sequences identified by SEQ ID NOs:1547-1565, 1728, 1730, and 1732, or is a gene having a sequence selected from SEQ ID NOs: 825-843, 1727, 1729, and 1731, or is a gene selected from the group consisting of GA2ox6, NAL2, Os02g0465900, OsBRI1, OsBZR1, OsCBSX4, OsDET1, OsERF71, OsHAP2E, OsHAP3H, OsHox32, OsMGD, OsNAL1, OsSNAC1, OsSUV3, OsTLP27, SsNHX1, SUV3, TIFY11b, PsbS, VDE, and ZEP.

13. The method of claim 1, wherein the trait is senescence and each of the at least two genes is a gene that encodes a protein having at least 90% identity to a sequence selected from the group consisting of the sequences identified by SEQ ID NOs:1566-1653 or is a gene having a sequence selected from SEQ ID NOs:844-931 or is a gene selected from the group consisting of MADS22, SNAC1, RT, SE1, GAMYB, HSP90, AOC, AOS1, AOS2, ACDR1, WRKY45, SPS1, NYC1, D35, PIMT1, PIMT2, WRKY16, SAUR39, CKX3, GN1A, MADS47, MADS55, SGR, CGA1, Rbs1, SPLS, TYDC, SPIN1, SPL11, WRKY14, AP2/EREBP77, TET13, VP1, KO1, SPL32, JAR1, TET5, TET9, FON1, HD3A, PHYB, CYP703A3, MYB, GW8, CZOGT1, CZOGT2, CZOGT3, D1|D2|Os07g0558500, CCA1, RAC1, ABA8OX1, ATG7, D14, NCED1, NCED3, OsABA2, ZEP1, CP1, UDT1, SNAT1, AGO1C, NAS3, ALDH7, CHS1, GST, GRX6, SWEETS, GATA12, NAC58, APX2, ERF3, C3H35, NAM, LOX1, LOX11, LOG1, CKX1, DOS, SHL4, HOX33, NYC3, APX1, AHP1, ERF108, D17, PME1, GHD7, and GS2.

14. The method of claim 11, wherein the nutrient is nitrogen, and each of the at least two genes is a gene that encodes a protein having at least 90% identity to a sequence selected from the group consisting of the sequences identified by SEQ ID NOs:1513-1533 or is a gene having a sequence selected from SEQ ID NOs:791-811 or is a gene selected from the group consisting of AMT1;1, AMT1;2, AMT1;3, GRX6, GS1;2, GS2, NADH-GOGAT, OsAMT3; 1, OsARG, OsENOD93-1 (LOC_Os06g05010), OsGOGAT2, OsGS1;1, OsNRT1.1b, OsNRT2.1, OsNRT2.3b, OsPTR6, OsPTR9, IPT, and OsSPX1.

15. The method of claim 11, wherein the nutrient is nitrogen, and the targeted modifications result in increased expression of at least two genes selected from the group consisting of OsPTR6, OsPTR9, OsNRT2.1, OsNRT2.3b, OsNRT1.1b, OsNPF6.5, OsGS1;1, GS1;2, GS2, NADH-GOGAT, NADH-GOGAT1, OsGOGAT2, AlaAT, AMT1;1, AMT1;2, AMT1;3, OsAMT3;1, IPT, and OsENOD93-1.

16. The method of claim 1, wherein the insertion of the predetermined sequence consists of the enhancer OCS set forth in SEQ ID NO: 184.

\* \* \* \* \*